United States Patent
Sulakvelidze

(10) Patent No.: US 12,419,313 B2
(45) Date of Patent: Sep. 23, 2025

(54) CAMPYLOBACTER BACTERIOPHAGES AND USES THEREOF

(71) Applicant: Intralytix, Inc., Columbia, MD (US)

(72) Inventor: Alexander Sulakvelidze, Brookeville, MD (US)

(73) Assignee: INTRALYTIX, INC., Columbia, MD (US)

(*) Notice: Subject to any disclaimer, the term of this patent is extended or adjusted under 35 U.S.C. 154(b) by 11 days.

(21) Appl. No.: 17/645,423

(22) Filed: Dec. 21, 2021

(65) Prior Publication Data

US 2022/0264896 A1 Aug. 25, 2022

Related U.S. Application Data

(60) Provisional application No. 63/128,634, filed on Dec. 21, 2020.

(51) Int. Cl.
| | |
|---|---|
| *A01N 63/40* | (2020.01) |
| *A23B 2/783* | (2025.01) |
| *A23B 4/22* | (2006.01) |
| *A23L 3/3571* | (2006.01) |
| *A23L 33/135* | (2016.01) |
| *A61K 35/745* | (2015.01) |
| *A61K 35/747* | (2015.01) |
| *A61K 35/76* | (2015.01) |
| *A61K 39/00* | (2006.01) |

(52) U.S. Cl.
CPC .............. *A01N 63/40* (2020.01); *A23B 2/783* (2025.01); *A23B 4/22* (2013.01); *A23L 33/135* (2016.08); *A61K 35/745* (2013.01); *A61K 35/747* (2013.01); *A61K 35/76* (2013.01); *A61K 39/00* (2013.01)

(58) Field of Classification Search
CPC .......... A01N 63/40; A23B 4/22; A23B 7/155; A23L 3/3571; A23L 33/135; A23L 3/3418; A61K 35/745; A61K 35/747; A61K 35/76; A61K 39/00; A61K 35/742; A61K 35/744; A61K 36/064; A61K 2300/00; G01N 2333/205; C12N 2795/00021; C12N 2795/00034; C12N 7/00; C12Q 1/04

See application file for complete search history.

(56) References Cited

U.S. PATENT DOCUMENTS

2015/0297648 A1* 10/2015 Deaton ................ A61K 35/745
424/93.4

FOREIGN PATENT DOCUMENTS

WO WO-2014070225 A1 * 5/2014 ........... A61K 35/742

OTHER PUBLICATIONS

El-Shibiny A, Scott A, Timms A, Metawea Y, Connerton P, Connerton I. Application of a group II Campylobacter bacteriophage to reduce strains of Campylobacter jejuni and Campylobacter coli colonizing broiler chickens. J Food Prot. Apr. 2009;72(4):733-40. doi: 10.4315/0362-028x-72.4.733. PMID: 19435220. (Year: 2008).*
Fischer et al., PLoS ONE, 8(10):e78543 (2013) (Year: 2013).*
Sorensen et al., PLoS ONE, 10(1):e0116287 (2015) (Year: 2015).*
Campylobacter phage CP20, complete genome (Year: 2019).*
Summers, "Bacteriophage discovered. Felix d'Herelle and the origins of molecular biology", New Haven, CT: Yale University Press; 1999, p. 47-59.
Suttle, "Marine viruses—major players in the global ecosystem", Nat Rev Microbiol., 2007;5(10):801-812.
Hatfull, "Bacteriophage genomics", Curr Opin Microbiol., 2008;11(5):447-453.
Adams, "Enumeration of bacteriophage particles", Bacteriophages London: Interscience Publishers, Ltd.; 1959, p. 27-34.
Tack et al., "Preliminary incidence and trends of infections with pathogens transmitted commonly through food—Foodborne Diseases Active Surveillance Network, 10 U.S. sites, 2015-2018", MMWR Morb Mortal Wkly Rep., 2019;68(16):369-372.
Hoffmann et al., "Annual cost of illness and quality-adjusted life year losses in the United States due to 14 foodborne pathogens", J Food Prot., 2012;75(7):1292-1302.
Kaakoush et al., "Global epidemiology of Campylobacter infection", Clin Microbiol Rev., 2015;28(3):687-720.
Halpin et al., "Post-Campylobacter Guillain Barre Syndrome in the USA: secondary analysis of surveillance data collected during the 2009-2010 novel Influenza A (H1N1) vaccination campaign", Epidemiology and infection, 2018;146(13):1740-1745.
Dewey-Mattia et al., "Surveillance for Foodborne Disease Outbreaks—United States, 2009-2015", MMWR Surveill Summ., 2018;67(No. SS-10):1-11.
Pogreba-Brown et al., "Assessing risk factors of sporadic Campylobacter infection: a case-control study in Arizona", Epidemiol Infection, 2016;144(4):829-839.
Tenover et al., "Interpreting chromosomal DNA restriction patterns produced by pulsed-field gel electrophoresis: criteria for bacterial strain typing", J Clin Microbiol, 1995;33(9):2233-2239.
Jain et al., "High throughput ANI analysis of 90K prokaryotic genomes reveals clear species boundaries", Nature Communications, 2018;9(1):5114.
Wick et al., "Unicycler: Resolving bacterial genome assemblies from short and long sequencing reads", PLOS Computational Biology, 2017;13(6):e1005595.
Afgan et al., "The Galaxy platform for accessible, reproducible and collaborative biomedical analyses: 2018 update", Nucleic Acids Research, 2018;46(W1):W537-W544.
Parks et al., "CheckM: assessing the quality of microbial genomes recovered from isolates, single cells, and metagenomes", Genome Research, 2015;25(7):1043-1055.

(Continued)

*Primary Examiner* — David W Berke-Schlessel
(74) *Attorney, Agent, or Firm* — ArentFox Schiff LLP

(57) ABSTRACT

The present invention is directed to isolated bacteriophages having specificity and lytic activity against strains of *Campylobacter* species, methods of using the bacteriophages, progeny and derivatives derived therefrom, to control the growth of *Campylobacter* species in various settings (e.g., food safety, sanitation, modulating microbiome, prebiotics, probiotics).

25 Claims, 293 Drawing Sheets

Specification includes a Sequence Listing.

(56) References Cited

OTHER PUBLICATIONS

Brunak et al., "Nucleotide sequence database policies", Science, 2002;298(5597):1333.
On, "Taxonomy of Campylobacter, Arcobacter, Helicobacter and related bacteria: current status, future prospects and Immediate concerns", Symp Ser Soc Appl Microbiol., 2001(30):1S-15S.
Merril et al., "Long-circulating bacteriophage as antibacterial agents", Proc Natl Acad Sci U S A., 1996,93(8):3188-92.
Adams, "Methods of study bacterial viruses", Bacteriophages, London: Interscience Publishers, Ltd., 1959, p. 443-519.
Sulakvelidze et al., "Bacteriophage therapy in humans", In: Kutter E, Sulakvelidze A, editors., Bacteriophages: Biology and Application, Boca Raton, FL: CRC Press; 2005, p. 381-436.
Sulakvelidze et al., "Phage therapy in animals and agribusiness", In: Kutter E, Sulakvelidze A, editors., Bacteriophages: Biology and Applications, Boca Raton, FL: CRC Press; 2005, p. 335-380.
Alisky et al., "Bacteriophages show promise as antimicrobial agents", J Infect., 1998;36(1):5-15.
Summers, "Bacteriophage therapy", Annu Rev Microbiol., 2001;55:437-451.
Van Der Mee-Marquet et al., "Evaluation of seven experimental phages for inclusion in the international phage set for the epidemiological typing of Listeria monocytogenes", Appl Environ Microbiol., 1997;63(9):3374-3377.
Melamed et al., "A vaccine against avian colibacillosis based on ultrasonic inactivation of *Escherichia coli*.", Avian Dis., 1991;35(1):17-22.
Lauvau et al., "Priming of memory but not effector CD8 T cells by a killed bacterial vaccine", Science, 2001;294(5547):1735-1739.
Johnson-Boaz et al., "A dominant mutation in the bacteriophage lambda S gene causes premature lysis and an absolute defective plating phenotype", Mol Microbiol., 1994;13(3):495-504.
Wang et al., "Holins: the protein clocks of bacteriophage infections", Annu Rev Microbiol., 2000;54:799-825.
Varghese et al., "Microbial species delineation using whole genome sequences", Nucleic Acids Res., 2015;43(14):6761-6771.
Panthel et al., "Generation of Helicobacter pylori ghosts by PhiX protein E-mediated inactivation and their evaluation as vaccine candidates", Infect Immun., 2003;71(1):109-116.
Vinogradov, "Colloidal microgels in drug delivery applications", Curr Pharm Des, 2006, 12(36): p. 4703-4712.
Tae et al., "β-Glucan hybridized poly(ethylene glycol) microgels for macrophage-targeted protein delivery", Journal of Industrial and Engineering Chemistry, 2019, 75: p. 69-76.

\* cited by examiner

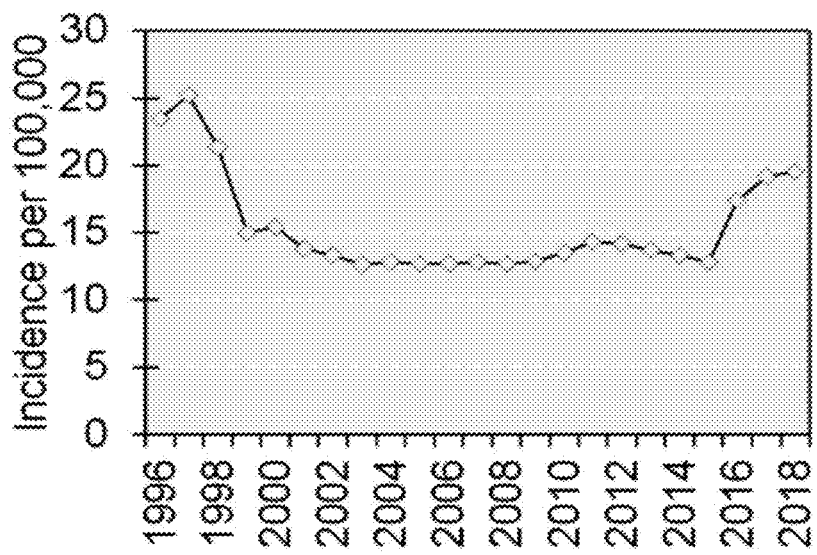
FIG. 1. Campylobacter incidence rates during 1996 – 2018. The data were obtained from the FoodNet annual reports and plotted against corresponding year.
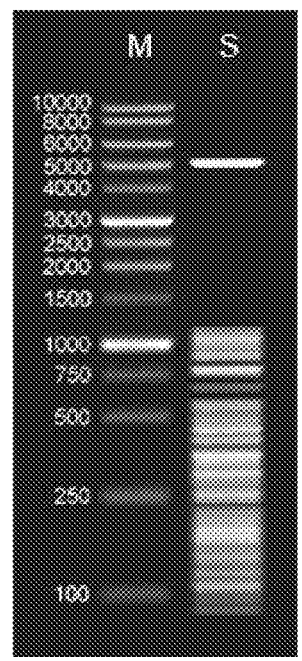
FIG. 2. RFLP pattern of bacteriophage CJLB-4. Sequence was virtually digested with the enzyme *Hha*I

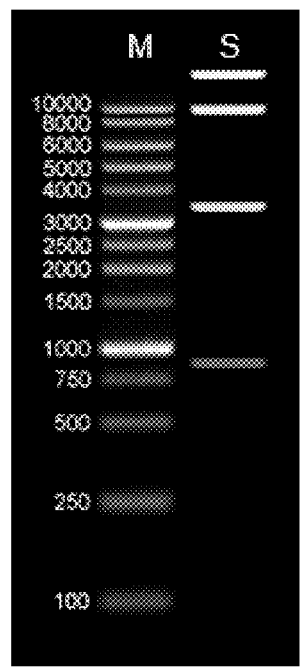
FIG. 3. RFLP pattern of bacteriophage CJLB-7. Sequence was virtually digested with the enzyme *Hha*I
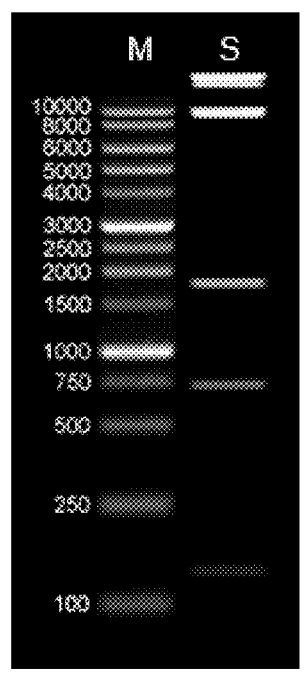
FIG. 4. RFLP pattern of bacteriophage CJLB-10. Sequence was virtually digested with the enzyme *Hha*I

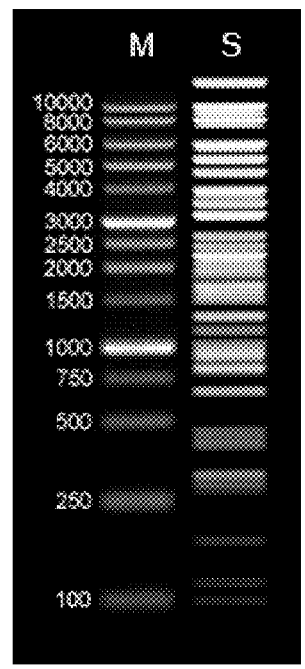
FIG. 5. RFLP pattern for bacteriophage CJLB-12. Sequence was virtually digested with the enzyme *Hha*I
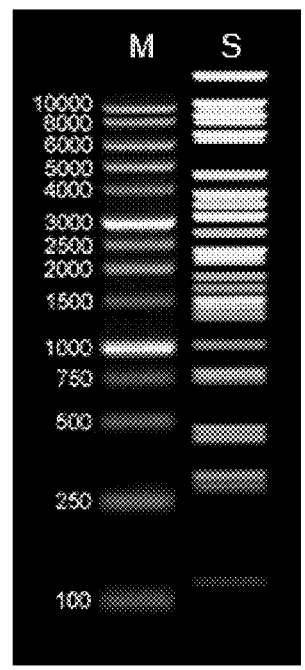
FIG. 6. RFLP pattern for bacteriophage CJLB-14. Sequence was virtually digested with the enzyme *Hha*I

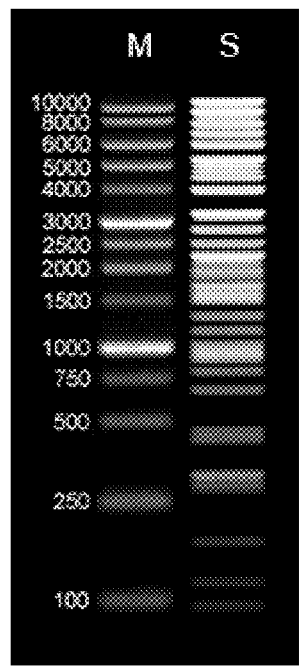
FIG. 7. RFLP pattern of bacteriophage CJLB-15. Sequence was virtually digested with the enzyme *Hha*I
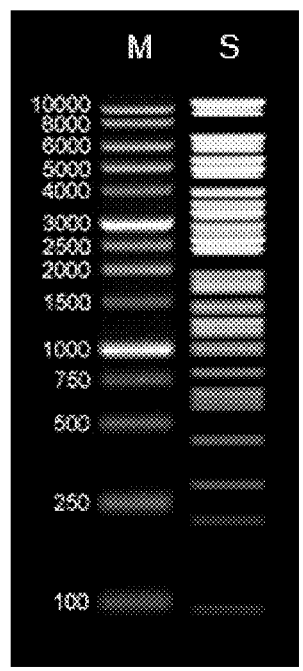
FIG. 8. RFLP pattern for bacteriophage CJLB-5. Reference-guided assembly sequence was virtually digested with the enzyme *Hha*I

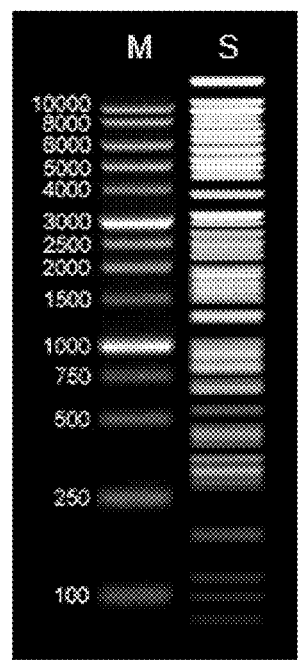
FIG. 9. RFLP pattern for bacteriophage CJLB-13. Reference-guided assembly sequence was virtually digested with the enzyme *Hha*I

FIG. 10A. (CJLB-4 [organism=Campylobacter phage CJLB-4] partial genome)

```
ATGTTTTTATTTAAAATACCCTCTGAAAAGAAAGGAAACGACAGGTGCTGAAAGCGAGCTTTTTGGCCTC
TGTCGTTTCCTTTCTCTGTTTTTGTCCGTGGAATGAACAATGGAAGTCAACAAAAAGCAGCTGGCTGACA
TTTTCGGTGCGAGTATCCGTACCATTCAGAACTGGCAGGAACAGGGAATGCCCGTTCTGCGAGGCGGTGG
CAAGGGTAATGAGGTGCTTTATGACTCTGCCGCCGTCATAAAATGGTATGCCGAAAGGGATGCTGAAATT
GAGAACGAAAAGCTGCGCCGGGAGGTTGAAGAACTGCGGCAGGCCAGCGAGGCAGATCTCCAGCCAGGAA
CTATTGAGTACGAACGCCATCGACTTACGCGTGCGCAGGCCGACGCACAGGAACTGAAGAATGCCAGAGA
CTCCGCTGAAGTGGTGGAAACCGCATTCTGTACTTTCGTGCTGTCGCGGATCGCAGGTGAAATTGCCAGT
ATTCTCGACGGGCTCCCCCTGTCGGTGCAGCGGCGTTTTCCGGAACTGGAAAACCGACATGTTGATTTCC
TGAAACGGGATATCATCAAAGCCATGACAAAGCAGCCGCGCTGGATGAACTGATACCGGGGTTGCTGAG
TGAATATATCGAACAGTCAGGTTAACAGGCTGCGGCATTTTGTCCGCGCCGGGCTTCGCTCACTGTTCAG
GCCGGAGCCACAGACCGCCGTTGAATGGGCGGATGCTAATTACTATCTCCCGAAAGAATCCGCATACCAG
GAAGGGCGCTGGGAAACACTGCCCTTTCAGCGGGCCATCATGAATGCGATGGGCAGCGACTACATCCGTG
AGGTGAATGTGGTGAAGTCTGCCCGTGTCGGTTATTCCAAAATGCTGCTGGGTGTTTATGCCTACTTTAT
AGAGCATAAGCAGCGCAACACCCTTATCTGGTTGCCGACGGATGGTGATGCCGAGAACTTTATGAAAACC
CACGTTGAGCCGACTATTCGTGATATTCCGTCGCTGCTGGCGCTGGCCCCGTGGTATGGCAAAAAGCACC
GGGATAACACGCTCACCATGAAGCGTTTCACTAATGGGCGTGGCTTCTGGTGCCTGGGCGGTAAAGCGGC
AAAAAAACTACCGTGAAAAGTCGGTGGATGTGGCGGGTTATGATGAACTTGCTGCTTTTGATGATGATATT
GAACAGGAAGGCTCTCCGACGTTCCTGGGTGACAAGCGTATTGAAGGCTCGGTCTGGCCAAAGTCCATCC
GTGGCTCCACGCCAAAAGTGAGAGGCACCTGTCAGATTGAGCGTGCAGCCAGTGAATCCCCGCATTTTAT
GCGTTTTCATGTTGCCTGCCCGCATTGCGGGGAGGAGCAGTATCTTAAATTTGGCGACAAAGAGACGCCG
TTTGGCCTCAAATGGACGCCGGATGACCCCTCCAGCGTGTTTTATCTCTGCGAGCATAATGCCTGCGTCA
TCCGCCAGCAGGAGCTGGACTTTACTGATGCCCGTTATATCTGCGAAAAGACCGGGATCTGGACCCGTGA
TGGCATTCTCTGGTTTTCGTCATCCGGTGAAGAGATTGAGCCACCTGACAGTGTGACCTTTCACATCTGG
ACAGCGTACAGCCCGTTCACCACCTGGGTGCAGATTGTCAAAGATGGATGAAAACGAAAGGGGATACGG
GAAAACGTAAAACCTTCGTAAACACCACGCTCGGTGAGACGTGGGAGGCGAAAATTGGCGAACGTCCGGA
TGCTGAAGTGATGGCAGAGCGGAAAGAGCATTATTCAGCGCCCGTTCCTGACCGTGTGGCTTACCTGACC
GCCGGTATCGACTCCCAGCTGGACCGCTACGAAATGCGCGTATGGGGATGGGGGCCGGGTGAGGAAAGCT
GGCTGATTGACCGGCAGATTATTATGGGCCGCCACGACGATGAACAGACGCTGCTGCGTGTGGATGAGGC
CATCAATAAAACCTATACCCGCCGGAATGGTGCAGAAATGTCGATATCCCGTATCTGCTGGGATACTGGC
GGGATTGACCCGACCATTGTGTATGAACGCTCGAAAAAACATGGGCTGTTCCGGGTGATCCCCATTAAAG
GGGCATCCGTCTACGGAAAAGCCGGTGGCCAGCATGCCACGTAAGCGAAACAAAAACGGGGTTTACCTTAC
CGAAATCGGTACGGATACCGCGAAAGAGCAGATTTATAACCGCTTCACACTGACGCCGGAAGGGGATGAA
CCGCTTCCCGGTGCCGTTCACTTCCCGAATAACCCGGATATTTTTGATCTGACCGAAGCGCAGCAGCTGA
CTGCTGAAGAGCAGGTCGAAAATGGGTGGATGGCAGGAAAAAAATACTGTGGGACAGCAAAAAGCGACG
CAATGAGGCACTCGACTGCTTCGTTTATGCGCTGGCGGCGCTGCGCATCAGTATTTCCCGCTGGCAGCTG
GATCTCAGTGCGCTGCTGGCGAGCCTGCAGGAAGAGGATGGTGCAGCAACCAACAAGAAAACACTGGCAG
ATTACGCCCGTGCCTTATCCGGAGAGGATGAATGACGCGACAGGAAGAACTTGCCGCTGCCCGTGCGGCA
CTGCATGACCTGATGACAGGTAAACGGGTGGCAACAGTACAGAAGACGGACGAAGGGTGGAGTTTACGG
CCACTTCCGTGTCTGACCTGAAAAAATATATTGCAGAGCTGGAAGTGCAGACCGGCATGACACAGCGACG
CAGGGGACCTGCAGGATTTTATGTATGAAAACGCCCACCATTCCCACCCTTCTGGGGCCGGACGGCATGA
CATCGCTGCGCGAATATGCCGGTTATCACGGCGGTGGCAGCGGATTTGGAGGGCAGTTGCGGTCGTGGAA
CCCACCGAGTGAAAGTGTGGATGCAGCCCTGTTGCCCAACTTTACCCGTGGCAATGCCCGCGCAGACGAT
CTGGTACGCAATAACGGCTATGCCGCCAACGCCATCCAGCTGCATCAGGATCATATCGTCGGGTCTTTTT
TCCGGCTCAGTCATCGCCCAAGCTGGCGCTATCTGGGCATCGGGGAGGAAGAAGCCCGTGCCTTTTCCCG
CGAGGTTGAAGCGGCATGGAAAGAGTTTGCCGGATGACTGCTGCTGCATTGACGTTGAGCGAAAACGC
ACGTTTACCATGATGATTCGGGAAGGTGTGGCCATGCACGCCTTTAACGGTGAACTGTTCGTTCAGGCCA
CCTGGGATACCAGTTCGTCGCGGCTTTTCCGGACACAGTTCCGGATGGTCAGCCCGAAGCGCATCAGCAA
CCCGAACAATACCGGCGACAGCCGGAACTGCCGTGCCGGTGTGCAGATTAATGACAGCGGTGCGGCGCTG
GGATATTACGTCAGCGAGGACGGGTATCCTGGCTGGATGCCGCAGAAATGGACATGGATACCCCGTGAGT
TACCCGGCGGGCGCGCCTCGTTCATTCACGTTTTTGAACCCGTGGAGGACGGGCAGACTCGCGGTGCAAA
TGTGTTTTACAGCGTGATGGAGCAGATGAAGATGCTCGACACGCTGCAGAACACGCAGCTGCAGAGCGCC
ATTGTGAAGGCGATGTATGCCGCCACCATTGAGAGTGAGCTGGATACGCAGTCAGCGATGGATTTTATTC
TGGGCGCGAACAGTCAGGAGCAGCGGGAAAGGCTGACCGGCTGGATTGGTGAAATTGCCGCGTATTACGC
CGCAGCGCCGGTCCGGCTGGGAGGCGCAAAAGTACCGCACCTGATGCCGGGTGACTCACTGAACCTGCAG
ACGGCTCAGGATACGGATAACGGCTACTCCGTGTTTGAGCAGTCACTGCTGCGGTATATCGCTGCCGGGC
TGGGTGTCTCGTATGAGCAGCTTTCCCGGAATTACGCCCAGATGAGCTACTCCACGGCACGGGCCAGTGC
GAACGAGTCGTGGGCGTACTTATGGGCGGCGAAAATTCGTCGCATCCCGTCAGGCGAGCCAGATGTTT
CTGTGCTGGCTGGAAGAGGCCATCGTTCGCCGCGTGGTGACGTTACCTTCAAAAGCGCGCTTCAGTTTTC
AGGAAGCCCGCAGTGCCTGGGGGAACTGCGACTGGATAGGCTCCGGTCGTATGGCCATCGATGGTCTGAA
AGAAGTTCAGGAAGCGGCATGGAAAGGTGATGCTGATAGAAGCCGGACTGAGTACCTACGAGAAAGAGTGCGCAAAACGC
GGTGACGACTATCAGGAAATTTTTGCCCAGCAGGTCCGTGAAACGATGGAGCGCCGTGCAGCCGGTCTTA
AACCGCCCGCCTGGGCGGCTGCAGCATTTGAATCCGGGCTGCGACAATCAACAGAGGAGGAGAAGAGTGA
CAGCAGAGCTGCGTAATCTCCCGCATATTGCCAGCATGGCCTTTAATGAGCGCTGATGCTTGAACCCGC
CTATGCGCGGGTTTTCTTTTGTGCGCTTGCAGGCCAGCTTGGGATCAGCAGCCTGACGGATGCGGTGTCC
GGCGACAGCCTGACTGCCCAGGAGGCACTCGCGACGCTGGCATTATCCGGTGATGATGACGGACCACGAC
AGGCCCGCAGTTATCAGGTCATGAACGGCATCGCCGTGCTGCCGGTGTCCGGCACGCTGGTCAGCCGGAC
GCGGGCGCTGCAGCCGTACTCGGGGATGACCGGTTACAACGGCATTATCGCCCGTCTGCAACAGGCTGCC
```

FIG. 10B. Continuation of (CJLB-4 [organism=Campylobacter phage CJLB-4] partial genome)

```
AGCGATCCGATGGTGGACGGCATTCTGCTCGATATGGACACGCCCGGCGGGATGGTGGCGGGGGCATTTG
ACTGCGCTGACATCATCGCCCGTGTGCGTGACATAAAACCGGTATGGGCGCTTGCCAACGACATGAACTG
CAGTGCAGGTCAGTTGCTTGCCAGTGCCGCCTCCCGGCGTCTGGTCACGCAGACCGCCCGGACAGGCTCC
ATCGGCGTCATGATGGCTCACAGTAATTACGGTGCTGCGCTGGAGAAACAGGGTGTGGAAATCACGCTGA
TTTACAGCGGCAGCCATAAGGTGGATGGCAACCCCTACAGCCATCTTCCGGATGACGTCCGGGAGACACT
GCAGTCCCGGATGGACGCAACCCGCCAGATGTTTGCGCAGAAGGTGTCGGCATATACCGGCCTGTCCGTG
CAGGTTGTGCTGGATACCGAGGCTGCAGTGTACAGCGGTCAGGAGGCCATTGATGCCGGACTGGCTGATG
AACTTGTTAACAGCACCGATGCGATCACCGTCATGCGTGATGCACTGGATGCACGTAAATCCCGTCTCTC
AGGAGGGCGAATGACCAAAGAGACTCAATCAACAACTGTTTCAGCCACTGCTTCGCAGGCTGACGTTACT
GACGTGGTGCCAGCGACGGAGGGCGAGAACGCCAGCGCGGCGCAGCCGGACGTGAACGCCAGATCACCG
CAGCGGTTGCGGCAGAAAACAGCCGCATTATGGGGATCCTCAACTGTGAGGAGGCTCACGGACGCGAAGA
ACAGGCACGCGTGCTGGCAGAAACCCCCGGTATGACCGTGAAAACGGCCCGCCGCATTCTGGCCGCAGCA
CCACAGAGTGCACAGGCGCGCAGTGACACTGCGCTGGATCGTCTGATCAGGGGGCACCGGCACCGCTGG
CTGCAGGTAACCCGGCATCTGATGCCGTTAACGATTTGCTGAACACACCAGTGTAAGGGATGTTTATGAC
GAGCAAAGAAACCTTTACCCATTACCAGCCGCAGGGCAACAGTGACCCGGCTCATACCGCAACCGCGCCC
GGCGGATTGAGTGCGAAAGCGCCTGCAATGACCCCGCTGATGCTGGACACCTCCAGCCGTAAGCTGGTTG
CGTGGGATGGCACCACCGACGGTGCTGCCGTTGGCATTCTTGCGGTTGCTGCTGACCAGACCAGCACCAC
GCTGACGTTCTACAAGTCCGGCACGTTCCGTTATGAGGATGTGCTCTGGCCGGAGGCTGCCAGCGACGAG
ACGAAAAAACGGACCGCGTTTGCCGGAACGGCAATCAGCATCGTTTAACTTTACCCTTCATCACTAAAGG
CCGCCTGTGCGGCTTTTTTACGGGATTTTTTTATGTCGATGTACACAACCGCCCAACTGCTGGCGGCAA
ATGAGCAGAAATTTAAGTTTGATCCGCTGTTTCTGCGTCTCTTTTTCCGTGAGAGCTATCCCTTCACCAC
GGAGAAAGTCTATCTCTCACAAATTCCGGGACTGGTAAACATGGCGCTGACTGCTGCCGATTGTTTCC
GGTGAGGTTATCCGTTCCCGTGGCGGCTCCACCTCTGAATTTACGCCGGGATATGTCAAGCCGAAGCATG
AAGTGAATCCGCAGATGACCCTGCGTCGCCTGCCGGATGAAGATCCGCAGAATCTGGCGGACCCCGGCTTA
CCGCCGCCGTCGCATCATCATGCAGAACATGCGTGACGAAGAGCTGGCCATTGCTCACGTCGAAGAGATG
CAGGCAGTTTCTGCCGTGCTTAAGGGCAAATACACCATGACCGGTGAAGCCTTCGATCCGGTTGAGGTGG
ATATGGGCCGCAGTGAGGAGAATAACATCACGCAGTCCGGCGGCACGGAGTGGGAGCAAGCGTGACAAGTC
CACGTATGACCCGACCGACGATATCGAAGCCTACGCGTCGAACGCCCAGCGGTGTGGTGAATATCATCGTG
TTCGATCCGAAAGGCTGGGCGCTGTTCCGTTCCTTCAAAGCCGTCAAGGAGAAGCTGGATACCCGTCGTG
GCTCTAATTCCGAGCTGGAGACAGCGGTGAAAGACCTGGGCAAAGCGGTGTCCTATAAGGGGATGTATGG
CGATGTGGCCATCGTCGTGTATTCCGGACAGTACGTGGAAAACGGCGTCAAAAAGAACTTCCTGCCGGAC
AACACGATGGTGCTGGGGAACACTCAGGCACGCGGTCTGCGCACCTATGGCTGCATTCAGGATGCGGACG
CACAGCGCGAAGGCATTAACGCCTCTGCCCGTTACCCGAAAAACTGGGTGACCACCGGCGATCCGGCGCG
TGAGTTCACCATGATTCAGTCAGCACCGCTGATGCTGCTGGCTGACCCTGATGAGTTCGTGTCCGTACAA
CTGGCGTAATCATGGCCCTTCGGGGCCATTGTTTCTCTGTGGAGGAGTCCATGACGAAAGATGAACTGAT
TGCCCGTCTCCGCTCGCTGGGTGAACAACTGAACCGTGATGTCAGCCTGACGGGGACGAAAGAAGAACTG
GCGCTCCGTGTGGCAGAGCTGAAAGAGGAGCTTGATGACACGGATGAAACTGCCGGTCAGGACACCCCTC
TCAGCCGGGAAAATGTGCTGACCGGACATGAAAATGAGGTGGGATCAGCGCAGCCGGATACCGTGATTCT
GGATACGTCTGAACTGGTCACGGTCGTGGCACTGGTGAAGGTGCATACTGATGCACTTCACGCCACGCGG
GATGAACCTGTGGCATTTGTGCTGCCGGGAACGGCGTTTCGTGTCTCTGCCGGTGTGGCAGCCGAAATGA
CAGAGCGCGGCCTGGCCAGAATGCAATAACGGGAGGCGCTGTGGCTGATTTCGATAACCTGTTCGATGCT
GCCATTGCCCGCGCCGATGAAACGATACGCGGGTACATGGGAACGTCAGCCACCATTACATCCGGTGAGC
AGTCAGGTGCGGTGATACGTGGTGTTTTGATGACCCTGAAAATATCAGCTATGCCGGACAGGGCGTGCG
CGTTGAAGGCTCCAGCCCGTCCCTGTTTGTCCGGACTGATGAGGTGCGGCAGCTGCGGCGTGGAGACACG
CTGACCATCGGTGAGGAAAATTTCTGGGTAGATCGGGTTTCGCCGGATGATGGCGGAAGTTGTCATCTCT
GGCTTGGACGGGGCGTACCGCCTGCCGTTAACCGTCGCCGCTGAAAGGGGATGTATGGCCATAAAAGGT
CTTGAGCAGGCCGTTGAAAACCTCAGCCGTATCAGCAAAACGGCGGTGCCTGGTGCCGCCGCAATGGCCA
TTAACCGCGTTGCTTCATCCGCGATATCGCAGTCGGCGTCACAGGTTGCCCGTGAGACAAAGGTACGCCG
GAAACTGGTAAAGGAAAGGGCCAGGCTGAAAAGGGCCACGGTCAAAAATCCGCAGGCCAGAATCAAAGTT
AACCGGGGGATTTGCCCGTAATCAAGCTGGGTAATGCGGGGTTGTCCTTTCGCGCCGCAGGCGTCGTA
AAAAGGGGCAGCGTTCATCCCTGAAAGGTGGCGGCAGCGTGCTTGTGGTGGGTAACCTCGTATTCCCGG
CGCGTTTATTCAGCAACTGAAAAATGGCCGGTGGCATGTCATGCAGCGTGTGGCTGGGAAAAACCGTTAC
CCCATTGATGTGGTGAAAATCCCGATGGCGGTGCCGCTGACCACGGCGTTAAACAAAATATTGAGCGGA
TACGGCGTGAACGTCTTCCGAAAGAGCTGGGCTATGCGCTGCAGCATCAACTGAGGATGGTAATAAAGCG
ATGAAACATACTGAACTCCGTGCAGCCGTACTGGATGCACTGGAGAAGCATGACACCGGGCGACGTTTT
TTGATGGTCGCCCCGCTGTTTTTGATGAGGCGGATTTTCGGCAGTTGCCGTTTATCTCACCGGCGCTGA
ATACACGGCGAAGAGCTGGACAGCGATACCTGGCAGGCGGAGCTGCATATCGAAGTTTTCCTGCCCTGCT
CAGGTGCCGGATTCAGAGCTGGATGCGTGGATGGAGTCCCGGATTTATCCGGTGATGAGCGATATCCCGG
CACTGTCAGATTTGATCACCAGTATGGTGGCCAGCGGCTATGACTACCGGCGCGACGATGATGCGGGCTT
GTGGAGTTCAGCCGATCTGACTTATGTCATTACCTATGAAATGTGAGGACGCTATGCCTGTACCAAATCC
TACAATGCCGGTGAAAGGTGCCGGGACCACCCTGTGGGTTTATAAGGGGAGCGGTGACCCTTACGCGAAT
CCGCTTTCAGACGTTGACTGGTCGCGTCTGGCAAAAGTTAAAGACCTGACCGCCCGCGAACTGACCGCTG
AGTCCTATGACGACAGCTATCTCGATGATGAAGATGCAGACTGGACCTGCGACCGGGCAGGGGCAGAAATC
TGCCGGAGATACCAGCTTCACGCTGCGTGGATGCCCGGAGAGCAGGGGCAGCAGGCGCTGCTGGCGGTGG
TTTAATGAAGGCGATACCCGTGCCTATAAAATCCGCTTCCCGAACGGCACGGTCGATGTGTTCCGTGGCT
GGGTCAGCAGTATCGGTAAGGCGGTGACGGCGAAGGAAGTGATCACCCGCACGGTGAAAGTCACCAATGT
```

FIG. 10C. Continuation of (CJLB-4 [organism=Campylobacter phage CJLB-4] partial genome)

```
GGGACGTCCGTCGATGGCAGAAGATCGCAGCACGGTAACAGCGGCAACCGGCATGACCGTGACGCCTGCC
AGCACCTCGGTGGTGAAAGGGCAGAGCACCACGCTGACCGTGGCCTTCCAGCCGGAGGGCGTAACCGACA
AGAGCTTTCGTGCGGTGTCTGCGGATAAAACAAAAGCCACCGTGTCGGTCAGTGGTATGACCATCACCGT
GAACGGCGTTGCTGCAGGCAAGGTCAACATTCCGGTTGTATCCGGTAATGGTGAGTTTGCTGCGGTTGCA
GAAATTACCGTCACCGCCAGTTAATCCGGAGAGTCAGCGATGTTCCTGAAAACCGAATCATTTGAACATA
ACGGTGTGACCGTCACGCTTTCTGAACTGTCAGCCCTGCAGCGCATTGAGCATCTCGCCCTGATGAAACG
GCAGGCAGAACAGGCGGAGTCAGACAGCAACCGGAAGTTTACTGTGGAAGACGCCATCAGAACCGGCGCG
TTTCTGGTGGCGATGTCCCTGTGGCATAACCATCCGCAGAAGACGCAGATGCCGTCCATGAATGAAGCCG
TTAAACAGATTGAGCAGGAAGTGCTTACCACCTGGCCCACGGAGGCAATTTCTCATGCTGAAAACGTGGT
GTACCGGCTGTCTGGTATGTATGAGTTTGTGGTGAATAATGCCCCTGAACAGACAGAGGACGCCGGGCCC
GCAGAGCCTGTTTCTGCGGGAAAGTGTTCGACGGTGAGCTGAGTTTTGCCCTGAAACTGGCGCGTGAGAT
GGGGCGACCCGACTGGCGTGCCATGCTTGCCGGGATGTCATCCACGGAGTATGCCGACTGGCACCGCTTT
TACAGTACCCATTATTTTCATGATGTTCTGCTGGATATGCACTTTTCCGGGCTGACGTACACCGTGCTCA
GCCTGTTTTTCAGCGATCCGGATATGCATCCGCTGGATTTCAGTCTGCTGAACCGGCGCGAGGCTGACGA
AGAGCCTGAAGATGATGTGCTGATGCAGAAAGCGGCAGGGCTTGCCGGAGGTGTCCGCTTTGGCCCGGAC
GGGAATGAAGTTATCCCCGCTTCCCCGGATGTGGCGGACATGACGGAGGATGACGTAATGCTGATGACAG
TATCAGAAGGGATCGCAGGAGGAGTCCGGTATGGCTGAACCGGTAGGCGATCTGGTCGTTGATTTGAGTC
TGGATGCGGCCAGATTTGACGAGCAGATGGCCAGAGTCAGGCGTCATTTTTCTGGTACGGAAAGTGATGC
GAAAAAAACAGCGGCAGTCGTTGAACAGTCGCTGAGCCGACAGGCGCTGGCTGCACAGAAAGCGGGGATT
TCCGTCGGGCAGTATAAAGCCGCCATGCGTATGCTGCCTGCACAGTTCACCGACGTGGCCACGCAGCTTG
CAGGCGGGCAAAGTCCGTGGCTGATCCTGCTGCAACAGGGGGGCAGGTGAAGGACTCCTTCGGCGGGAT
GATCCCCATGTTCAGGGGCTTGCCGGTGCGATCACCCTGCCGATGCGTGGGGGCCCACCTCGCTGCCGGTG
GCGACCGGTGCGCTGGCGTATGCCTGGTATCAGGGCAACTCAACCCTGTCCGATTTCAACAAAACGCTGG
TCCTTTCCGGCAATCAGGCGGGACTGACGGCAGATCGTATGCTGGTCCTGTCCAGAGCCGGGCAGGCGGC
AGGGCTGACGTTTAACCAGACCAGCGAGTCACTCAGCGCACTGGTTAAGGCGGGGGTAAGCGGTGAGGCT
CAGATTGCGTCCATCAGCCAGAGTGTGGCGCGTTTCTCCTCTGCATCCGGCGTGGAGGTGGACAAGGTCG
CTGAAGCCTTCGGGAAGCTGACCACAGACCCGACGTCGGGGCTGACGGCGATGGCTCGCCAGTTCCATAA
CGTGTCGGCCGGAGCAGATTGCGTATGTTGCTCAGTTGCACGCGTTCCGGCGATGAAGCCGGGGCATTGCAG
GCGGCGAACGAGGCCGCAACGAAAGGGTTTGATGACCAGACCCGCCGCCTGAAAGAGAACATGGGCACGC
TGGAGACCTGGGCAGACAGGACTGCCGGGCATTCAAATCCATGTGGGATGCGGTGCTGGATATTGGTCG
TCCTGATACCGCGCAGGAGATGCTGATTAAGGCAGAGGCTGCGTATAAGAAAGCAGACGACATCTGGAAT
CTGCGCAAGGATGATTATTTTGTTAACGATGAAGCGCGGGCGCGTTACTGGGATGATCGTGAAAAGGCCC
GTCTTGCGCTTGAAGCCGCCGAAAGAAGGCTGAGCAGCCAGACTCAACAGGCACAAAATGCGCAGCAGCA
GAGCGATACCGAAGCGTCACGGCTGAAATATACCGAAGAGGCGCAGAAGGCTTACGAACGGCTGCAGACG
CCGCTGGAGAAATATACCGCCCGTCAGGAAGAACTGAACAAGGCACTGAAAGACGGGAAAATCCTGCAGG
CGGATTACAACACGCTGATGGCGCCGGCGAAAAAGGATTATGAAGCGACGCTGAAAAAGCCGAAACAGTC
CAGCGTGAAGGTGTCTGCGGGCGATCGTCAGGAAGACAGTGCTCATGCTGCCCTGCTGACGCTTCAGGCA
GAACTCCGGACGCTGGAGAAGCATGCCGGAGCAAATGAGAAAATCAGCCAGCAGCGCCGGGATTTGTGGA
AGGCGGAGAGTCAGTTCGCGGTACTGGAGGAGGCGCGCCAACGTCGCCAGCGCTCAACAGGAGAAATC
CCTGCTGGCGCATAAAGATGAGACGCTGGAGTACAAACGCCAGCTGGCTGCACTTGGCGACAAGGTTACG
TATCAGGAGCGCCTGAACGCGCTGGCGCAGCAGGCGGATAAATTCGCACAGCAGCAACGGGCAAAACGGG
CCGCCATTGATGCGAAAAGCCGGGGGCTGACTGACCGGCAGGCAGAACGGGAAGCCACGGAACAGCGCCT
GAAGGAACAGTATGGCGATAATCCGCTGGCGCTGAATAACGTCATGTCAGAGCAGAAAAGACCTGGGCG
GCTGAAGACCAGCTTCGCGGGAACTGGATGGCAGGCCTGAGTCCGGCTGGAGTGAGTGGGAAGAGAGCG
CCACGAGACAGTATGTCGCAGGTAAAAAGTGCAGCCACGCAGACCTTTGATGGTATTGCACAGAATATGCC
GGCGATGCTGACCGGCAGTGAGCAGAACTGGCGCAGCTTCACCCGTTCCGTGCTGTCCATGATGACAGAA
ATTCTGCTTAAGCAGGCAATGGTGGGGATTGTCGGGAGTATCGGCAGCGCCATTGGCGGGGCTGTTGGTG
GCGGCGCATCCGCGTCAGGCGGTACAGCCATTCAGGCCGCTGCGGCGAAATTCCATTTTGCAACCGGAGG
ATTTACGGGAACCGGCGGCAAATATGAGCCAGCGGGGATTGTTCACCGTGGTGAGTTTGTCTTCACGAAG
GAGGCAACCAGCCGGATTGGCGTGGGGAATCTTTACCGGCTGATGCGCGGCTATGCCACCGGCGGTTATG
TCGGTACACCGGGCAGCATGCAGACAGCCGGTCGCAGGCGTCGCGGGACGTTTGAGCAGAATAACCATGT
GGTGATTAACAACGACGGCACGAACGGGCAGATAGGTCCGGCTGCTCTGAAGGCGGTGTATGACATGGCC
CGCAAGGGTGCCCGTGATGAAATTCAGACACAGATGCGTGATGGTGGCCTGTTCTCCGGAGGTGGACGAT
GAAGACCTTCCGCTGGAAAGTGAAACCCGGTATGGATGTGGCTTCGGTCCCTTCTGTAAGAAAGGTGCGC
TTTGGTGATGGCTATTCTCAGCGAGCGCCTGCCGGGCTGAATGCCAACCTGAAAACGTACAGCGTGACGC
TTTCTGTCCCCCGTGAGGAGGCCACGGTACTGGAGTCGTTTCTGGAAGAGCACGGGGCTGGAAATCCTT
TCTGTGGACGCCGCCTTATGAGTGGCGGCAGATAAAGGTGACCTGCCGCAAAATGGTCGTCGCGGGTCAGT
ATGCTGCGTGTTGAGTTCAGCGCAGAGTTTGAACAGGTGGTGAACTGATGCAGGATATCCGGCAGGAAAC
ACTGAATGAATGCACCCGTGCGGAGCAGTCGGCCAGCGTGGTGCTCTGGGAAATCGACCTGACAGAGGTC
GGTGGAGAACGTTATTTTTTCTGTAATGAGCAGAACGAAAAAGGTGAGCCGGTCACCTGGCAGGGGCGAC
AGTATCAGCCGTATCCCATTCAGGGGAGGCGGTTTTGAACTGAATGGCAAAAGGCACCACGTACGCGCCCCAC
GCTGACGGTTTCTAACCTGTACGGTATGGTCACCGGGATGGCGAAGATATGCAGAGTCTGGTCGGCGGA
ACGGTGGTCCGGCGTAAGGTTTACGCCCGTTTTCTGGATGCGGTGAACTTCGTCAACGGAAACAGTTACG
CCGATCCGGAGCAGGAGGTGATCAGCCGCTGGCGCATTGAGCAGTGCAGCGAACTGAGCGCGGTGAGTGC
CTCCTTTGTACTGTCCACGCCGACGGAAACGGATGGCGCTGTTTTTCCGGGACGTATCATGCTGGCCAAC
ACCTGCACCTGGACCTATCGCGGTGACGAGTGCGGTTATAGCGGTCCGGCTGTCGCGGATGAATATGACC
```

FIG. 10D. Continuation of (CJLB-4 [organism=Campylobacter phage CJLB-4] partial genome)

```
AGCCAACGTCCGATATCACGAAGGATAAATGCAGCAAATGCCTGAGCGGTTGTAAGTTCCGCAATAACGT
CGGCAACTTTGGCGGCTTCCTTTCCATTAACAAACTTTCGCAGTAAATCCCATGACACAGACAGAATCAG
CGATTCTGGCGCACGCCCGGCGATGTGCGCCAGCGGAGTCGTGCGGCTTCGTGGTAAGCACGCCGGAGGG
GGAAAGATATTTCCCCTGCGTGAATATCTCCGGTGAGCCGGAGGCGTATTTCCGTATGTCGCCGGAAGAC
TGGCTGCAGGCAGAAATGCAGGGTGAGATTGTGGCGCTGGTCCACAGCCACCCCGGTGGTCTGCCCTGGC
TGAGTGAGGCCGACCGGCGGCTGCAGGTGCAGAGTGATTTGCCGTGGTGGCTGGTCTGCCGGGGGACGAT
TCATAAGTTCCGCTGTGTGCCGCATCTCACCGGGCGGCGCTTTGAGCACGGTGTGACGGACTGTTACACA
CTGTTCCGGGATGCTTATCATCTGGCGGGGATTGAGATGCCGGACTTTCATCGTGAGGATGACTGGTGGC
GTAACGGCCAGAATCTCTATCTGGATAATCTGGAGGCGACGGGGCTGTATCAGGTGCCGTTGTCAGCGGC
ACAGCCGGGCGATGTGCTGCTGTGCTGTTTTGGTTCATCAGTGCCGAATCACGCCGCAATTTACTGCGGC
GACGGCGAGCTGCTGCACCATATTCCTGAACAACTGAGCAAACGAGAGAGGTACACCGACAAATGGCAGC
GACGCACACACTCCCTCTGGCGTCACCGGGCATGGCGCGCATCTGCCTTTACGGGGATTTACAACGATTT
GGTCGCCGCATCGACCTTCGTGTGAAAACGGGGGCTGAAGCCATCCGGGCACTGGCCACACAGCTCCCGG
CGTTTCGTCAGAAACTGAGCGACGGCTGGTATCAGGTACGGATTGCCGGGCGGGACGTCAGCACGTCCGG
GTTAACGGCGCAGTTACATGAGACTCTGCCTGATGGCGCTGTAATTCATATTGTTCCCAGAGTCGCCGGG
GCCAAGTCAGGTGGCGTATTCCAGATTGTCCTGGGGGCTGCCGCCCATTGCCGGATCATTCTTTACCGCCG
GAGCCACCCTTGCAGCATGGGGGGCAGCCATTGGGGCCGGTGGTATGACCGGCATCCTGTTTTCTCTCGG
TGCCAGTATGGTGCTCGGTGGTGTGGCGCAGATGCTGGCACCGAAAGCCAGAACTCCCCGTATACAGACA
ACGGATAACGGTAAGCAGAACACCTATTTCTCCTCACTGGATAACATGGTTGCCCAGGGCAATGTTCTGC
CTGTTCTGTACGGGGAAATGCGCGTGGGGTCACGCGTGGTTTCTCAGGAGATCAGCACGGCAGACGAAGG
GGACGGTGGTCAGGTTGTGGTGATTGGTCGCTGATGCAAAATGTTTTATGTGAAACCGCCTGCGGGCGGT
TTTGTCATTTATGGAGCGTGAGGAATGGGTAAAGGAAGCAGTAAGGGGCATACCCCGCGCGAAGCGAAGG
ACAACCTGAAGTCCACGCAGTTGCTGAGTGTGATCGATGCCATCAGCGAAGGGCCGATTGAAGGTCCGGT
GGATGGCTTAAAAAGCGTGCTGCTGAACAGTACGCCGGTGCTGGACACTGAGGGGAATACCAACATATCC
GGTGTCACGGTGGTGTTCCGGGCTGGTGAGCAGGAGCAGACTCCGCCGGAGGGATTTGAATCCTCCGGCT
CCGAGACGGTGCTGGGGTACGGAAGTGAAATATGACACGCCGATCACCCGCACCATTACGTCTGCAAACAT
CGACCGTCTGCGCTTTACCTTCGGTGTACAGGCACTGGTGGAAACCACCTCAAAGGGTGACAGGAATCCG
TCCGAAGTCCGCCTGCTGGTTCAGATACAACGTAACGGTGGCTGGGTGGGTGACGGAAAAAGACATCACCATTA
AGGGCAAAACCACCTCGCAGTATCTGGCCTCGGTGGTGATGGGTAACCTGCCGCCGCGCCCGTTTAATAT
CCGGATGCGCAGGATGACGCCGGACAGCACCACAGACCAGCTGCAGAACAAAACGCTCTGGTCGTCATAC
ACTGAAATCATCGATGTGAAACAGTGCTACCCGAACACGGCACTGGTCGGCGTGCAGGTGGACTCGGAGC
AGTTCGGCAGCCAGCAGGTGAGCCGTAATTATCATCTGCGCGGGCGTATTCTGCAGGTGCCGTCGAACTA
TAACCCGCAGACGCGGCAATACAGCGGTATCTGGGACGGAACGTTTAAACCGGCATACAGCAACAACATG
GCCTGGTGTCTGTGGGATATGCTGACCCATCCGCGCTACGGCATGGGGAAACGTCTTGGTGCGGCGGATG
TGGATAAATGGGCGCTGTATGTCATCGGCCAGTACTGCGACCAGTCAGTGCCGGACGGCTTTGGCGGCAC
GGAGCCGCGCATCACCTGTAATGCGTACCTGACCACACAGCGTAAGGCGTGGGATGTGCTCAGCGATTTC
TGCTCGGCGATGCGCTGTATGCCGGTATGGAACGGGCAGACGCTGACGTTCGTGCAGGACCGACCGTCGG
ATAAGACGTGGACCTATAACCGCAGTAATGTGGTGATGCCGGATGATGGCGCGCCGTTCCGCTACAGCTT
CAGCGCCCTGAAGGACCGCCATAATGCCGTTGAGGTGAACTGGATTGACCCGAACAACGGCTGGGAGACG
GCGACAGAGCTTGTTGAAGATACGCAGGCCATTGCCCGTTACGGTCGTAATGTTACGAAGATGGATGCCT
TTGGCTGTACCAGCCGGGGGCAGGCACACCGCGCCGGGCTGTGGCTGATTAAAACAGAACTGCTGGAAAC
GCAGACCGTGGATTTCAGCGTCGGCGCAGAAGGGCTTCGCCATGTACCGGGCGATGTTATTGAAATCTGC
GATGATGACTATGCCGGTATCAGCACCGGTGGTCGTGTGCTGGCGGTGAACAGCCAGACCCGGACGCTGA
CGCTCGACGTGAAATCACGCTGCCATCCTCCGGTACCGCGCTGATAAGCCTGGTTGACGGAAGTGGCAA
TCCGGTCAGCGTGGAGGTTCAGTCCGTCACCGACGGCGTGAAGGTAAAAGTGAGCCGTGTTCCTGACGGT
GTTGCTGAATACAGCGTATGGGAGCTGAAGCTGCCGACGCTGCGCCAGCGACTGTTCCGCTGCGTGAGTA
TCCGTGAGAACGACGACGGCACGTATGCCATCACCGCCGTGCAGCATGTGCCGGAAAAAGAGGCCATCGT
GGATAACGGGGCGCACTTTGACGGCGAACAGAGTGGCACGGTGAATGGTGTCACGCCGCCAGCGGTGCAG
CACCTGACCGCAGAAGTCACTGCAGACAGCGGGGAATATCAGGTGCTGGCGCGATGGGACACACCGAAGG
TGGTGAAGGGCGTGAGTTTCCTGCTCCGTCTGACCGTAACGCGGACGGCAGTGAGCGGCTGGTCAG
CACGGCCCGGACGACGGAAACCACATACCGCTTCACGCAACTGGCGCTGGGGAACTACAGGCTGACAGTC
CGGGCGGTAAATGCGTGGGGGCAGCAGGGCGATCCGGCGTCGGTATCGTTCCGGATTGCCGCACCGGCAG
CACCGTCGAGGATTGAGCTGACGCCGGGCTATTTTCAGATAACCGCCACGCCGCATCTTGCCGTTTATGA
CCCGACGGTACAGTTTGAGTTCTGGTTCTCGGAAAAGCAGATTCGGATATCAGACAGGTTGAAACCAGC
ACGCGTTATCTTGGTACGGCGCTGTACTGGATAGCCGCCAGTATCAATATCAAACCGGGCCATGATTATT
ACTTTTATATCGCCAGTGTGAACACCGTTGGCAAATCGGCATTCGTGGAGGCCGTCGGTCGGGCGAGCGA
TGATGCGGAAGGTTACCTGGATTTTTTCAAAGGCAAGATAACCGAATCCCATCTCGGCAAGGAGCTGCTG
GAAAAAGTCGAGCTGACGGAGGATAACGCCAGCAGACTGGAGGAGTTTTCGAAAGAGTGGAAGGATGCCA
GTGATAAGTGGAATGCCATGTGGGCTGTCAAAATTGAGCAGACCAAAGACGGCAAACATTATGTCGCGGG
TATTGGCCTCAGCATGGAGGACACGGAGGAAGGCAAACTGAGCCAGTTTCTGGTTGCCGCCAATCGTATC
GCATTTATTGACCCGGCAAACGGGAATGAAACGCCGATGTTTGTGGGCGCAGGGCAACCAGATATTCATGA
ACGACGTGTTCCTGAAGCGCCTGACCGCCCCCACCATTACCAGCGGCGGCAATCCTCCGGCCTTTTCCCT
GACACGGACGGAAAGCTGACCGCTAAAAATGCGGATATCAGTGGCAGTGTGAATGCGAACTCCGGGACG
CTCAGTAATGTGACGATAGCTGAAAACTGTACGATAAACGGTACGCTGAGGGCGGAAAAAATCGTCGGGG
ACATTGTAAAGGCGGCGAGCGCGGCTTTTCCGCGCCAGCGTGAAAGCAGTGTGGACTGGCCGTCAGGTAC
CCGTACTGTCACCGTGACCGATGACCATCCTTTTGATCGCCAGATAGTGGTGCTTCCGCTGACGTTTCGC
```

FIG. 10E. Continuation of (CJLB-4 [organism=Campylobacter phage CJLB-4] partial genome)

```
GGAAGTAAGCGTACTGTCAGCGGCAGGACAACGTATTCGATGTGTTATCTGAAAGTACTGATGAACGGTG
CGGTGATTTATGATGGCGCGGCGAACGAGGCGGTACAGGTGTTCTCCCGTATTGTTGACATGCCAGCGGG
TCGGGGAAACGTGATCCTGACGTTCACGCTTACGTCCACACGGCATTCGGCAGATATTCCGCCGTATACG
TTTGCCAGCGATGTGCAGGTTATGGTGATTAAGAAACAGGCGCTGGGCATCAGCGTGGTCTGAGTGTGTT
ACAGAGGTTCGTCCGGGAACGGGCGTTTTATTATAAAACAGTGAGAGGTGAACGATGCGTAATGTGTGTA
TTGCCGTTGCTGTCTTTGCCGCACTTGCGGTGACAGTCACTCCGGCCCGTGCGGAAGGTGGACATGGTAC
GTTTACGGTGGGCTATTTTCAAGTGAAACCGGGTACATTGCCGTCGTTGTCGGGCGGGATACCGGTGTG
AGTCATCTGAAAGGGATTAACGTGAAGTACCGTTATGAGCTGACGGACAGTGTGGGGGTGATGGCTTCCC
TGGGGTTCGCCGCGTCGAAAAAGAGCAGCACAGTGATGACCGGGGAGGATACGTTTCACTATGAGAGCCT
GCGTGGACGTTATGTGAGCGTGATGGCCGGACCGGTTTTACAAATCAGTAAGCAGGTCAGTGCGTACGCC
ATGGCCGGAGTGGCTCACAGTCGGTGGTCCGGCAGTACAATGGATTACCGTAAGACGGCAAATCACTCCCG
GGTATATGAAAGAGACGACCACTGCCAGGGACGAAAGTGCAATGCGGCATACCTCAGTGGCGTGGAGTGC
AGGTATACAGATTAATCCGGCAGCGTCCGTCGTTGTTGATATTGCTTATGAAGGCTCCGGCAGTGGCGAC
TGGCGTACTGACGGATTCATCGTTGGGGTCGGTTATAAATTCTGATTAGCCAGGTAACACAGTGTTATGA
CAGCCCGCCGGAACCGGTGGGCTTTTTTGTGGGGTGAATATGGCAGTAAAGATTTCAGGAGTCCTGAAAG
ACGGCACAGGGAAAACCGGTACAGAACTGCACCATTCAGCTGAAAGCCACAGACGTAACAGCACCACGGTGGT
GGTGAACACGGTGGGCTCAGAGAATCCGGATGAAGCCGGGCGTTACAGCATGGATGTGGAGTACGGTCAG
TACAGTGTCATCCTGCAGGTTGACGGTTTTCCACCATCGCACGCCGGGACCATCACCGTGTATGAAGATT
CACAACCGGGGACGCTGAATGATTTTCTCTGTGCCATGACGGAGGATGATGCCCGGCCGGAGGTGCTGCG
TCGTCTTGAACTGATGGTGGAAGAGGTGGCGCGTAACGCGTCCGTGGTGGCACAGAGTACGGCAGACGCG
AAGAAATCAGCCGGCGATGCCAGTGCATCAGCTGCTCAGGTCGCGGCCCTTGTGACTGATGCAACTGACT
CAGCACGCGCCGCCAGCACGTCCGCCGGACAGGCTGCATCGTCAGCTCAGGAAGCGTCCTCCGGCGCAGA
AGCGGCATCAGCAAAGGCCACTGAAGCGGAAAAAAGTGCCGCAGCCGCAGAGTCCTCAAAAAACGCGGCG
GCCACCAGTGCCGGTGCGGCGAAAACGTCAGAAACGAATGCTGCAGCGTCACAACAATCAGCCGCCACGT
CTGCCTCCACCGCGGCCACGAAAGCGTCAGAGGCCGCCACTTCAGCACGAGATGCGGTGGCCTCAAAAGA
GGCAGCAAAATCATCAGAAACGAACGCATCATCAAGTGCCGGTCGTGCAGCTTCCTCGGCAACGCGGCA
GAAAATTCTGCCAGGGCGGCAAAAACGTCCGAGACGAATGCCAGGTCATCTGAAACAGCAGCGGAACGGA
GCGCCTCTGCCGCGGCAGACGCAAAAACAGCGGCGCGGGGAGTGCGTCAACGGCATCCACGAAGGCGAC
AGAGGCTGCGGGAAGTGCGGTATCAGCATCGCAGAGCAAAAGTGCGGCAGAAGCGGCGGCAATACGTGCA
AAAAATTCGGCAAAACGTGCAGAAGATATAGCTTCAGCTGTCGCGCTTGAGGATGCGGACACAACGAGAA
AGGGGATAGTGCAGCTCAGCAGTGCAACCAACAGCACGTCTGAAACGCTTGCTGCAACGCCAAAGGCGGT
TAAGGTGGTAATGGATGAAACGAACAGAAAAGCCCACTGGACAGTCCGGCACTGACCGGAACGCCAACAG
CACCAACCGCGCTCAGGGGAACAAACAATACCCAGATTGCGAACACCGCTTTTGTACTGGCCGCGATTGC
AGATGTTATCGACGCGTCACCTGACGCACTGAATACGCTGAATGAACTGGCCGCAGCGCTCGGGAATGAT
CCAGATTTTGCTACCACCATGACTAACGCGCTTGCGGGTAAACAACCGAAGAATGCGACACTGACGGCGC
TGGCAGGGCTTTCCACGGCGAAAAATAAATTACCGTATTTTGCGGAAAATGATGCCGCCAGCCTGACTGA
ACTGACTCAGGTTGGCCAGGGATATTCTGGCAAAAAATTCCGTTGCAGATGTTCTTGAATACCTTGGGGCC
GGTGAGAATTCGGCCTTTCCGGCAGGTGCGCCGATCCCGTGGCCATCAGATATCGTTCCGTCTGGCTACG
TCCTGATGCAGGGGCAGGCGTTTGACAAATCAGCCTACCCAAAACTTGCTGTCGCGTATCCATCGGGTGT
GCTTCCTGATATGCGAGGCTGGACAATCAAGGGGAAACCGCCAGCGGTCGTGCTGTATTGTCTCAGGAA
CAGGATGGAATTAAGTCGCACACCCACAGTGCCAGTGCATCCGGTACGGATTTGGGGACGAAAACCACAT
CGTCGTTTGATTACGGGACGAAAACAACAGGCAGTTTCGATTACGGCACCAAATCGACGAATAACACGGG
GGCTCATGCTCACAGTCTGAGCGGTTCAACAGGGGCCGCGGGTGCTCATGCCCACACAAGTGGTTTAAGG
ATGAACAGTTCTGGCTGGAGTCAGTATGGAACAGCAACCATTACAGGAAGTTTATCCACAGTTAAAGGAA
CCAGCACACAGGGTATTGCTTATTTATCGAAAACGGACAGTCAGGGCAGCCACAGTCACTCATTGTCCGG
TACAGCCGTGAGTGCCGGTGCACATGCGCATACAGTTGGTATTGGTGCGCACCAGCATCCGGTTGTTATC
GGTGCTCATGCCCATTCTTTCAGTATTGGTTCACACGGACACACCATCACCGTTAACGCTGCGGGTAACG
CGGAAAACACCGTCAAAAACATTGCATTTAACTATATTGTGAGGCTTGCATAATGGCATTCAGAATGAGT
GAACAACCACGGACCATAAAAATTTATAATCTGCTGGCCGGAACTAATGAATTTATTGGTGAAGGTGACG
CATATATTCCGCCTCATACCGGTCTGCCTGCAAACAGTATGCACCGCCAGATATTCCGGCTGG
CTTTGTGGCTGTTTTCAACAGTGATGAGGCATCGTGGCATCTCGTTGAAGACCATCGGGGTAAAACCGTC
TATGACGTGGCTTCCGGCGACGCGTTATTTATTTCTGAACTCGGTCCGTTACCGGAAAATTTTACCTGGT
TATCGCCGGGAGGGAATATCAGAAGTGGAACGGCACAGCCTGGGTGAAGGATACGGAAGCAGAAAAACT
GTTCCGGATCCGGGAGGCGGAAGAAACAAAAAAAGCCTGATGCAGGTAGCCAGTGAGCATATTGCGCCG
CTTCAGGATGCTGCAGATCTGGAAATTGCAACGAAGGAAGAAACCTCGTTGCTGGAAGCCTGGAAGAAGT
ATCGGGTGTTGCTGAACCGTGTTGATCACTCAACTGCACTCGATATTGAGTGGCCTGCTGTCCCTGTTAT
GGAGTAATCGTTTTGTGATATGCCGCAGAAACGTTGTATGAAATAACGTTCTGCGGTTAGTTAGTATATT
GTAAAGCTGAGTATTGGTTTATTTGGCGATTATTATCTTCAGGAGAATAATGGAAGTTCTATGACTCAAT
TGTTCATAGTGTTTACATCACCGCCAATTGCTTTTAAGACTGAACGCATGAAATATGGTTTTTCGTCATG
TTTTGAGTCTGCTGTTGATATTTCTAAAGTCGGTTTTTTTCTTCGTTTTCTCTAACTATTTTCCATGAA
ATACATTTTTGATTATTATTTGAATCAATTCCAATTACCTGAAGTCTTTCATCTATAATTGGCATTGTAT
GTATTGGTTTATTGGAGTAGATGCTTGCTTTTCTGAGCCATAGCCTCTGATATCCAAATGAAGCCATAGGC
ATTTGTTATTTTGGCTCTGTCAGCTGCATAACGCCAAAAATATATTTATCTGCTTGATCTTCAAATGTT
GTATTGATTAAATCAATTGGATGGAATTGTTTATCATAAAAAATTAATGTTTGAATGTGATAACCGTCCT
TTAAAAAAGTCGTTTCTGCAAGCTTGGCTGTATAGTCAACTAACTCTTCGTCGAAGTGATATTTTTAGG
CTTATCTACCAGTTTTAGACGCTCTTTAATATCTTCAGGAATTATTTTATTGTCATATTGTATCATGCTA
```

FIG. 10F. Continuation of (CJLB-4 [organism=Campylobacter phage CJLB-4] partial genome)

```
AATGACAATTTGCTTATGGAGTAATCTTTTAATTTTAAATAAGTTATTCTCCTGGCTTCATCAAATAAAG
AGTCGAATGATGTTGGCGAAATCACATCGTCACCCATTGGATTGTTTATTTGTATGCCAAGAGAGTTACA
GCAGTTATACATTCTGCCATAGATTATAGCTAAGGCATGTAATAATTCGTAATCTTTTAGCGTATTAGCG
ACCCATCGTCTTTCTGATTTAATAATAGATGATTCAGTTAAATATGAAGGTAATTTCTTTTGTGCAAGTC
TGACTAACTTTTTTATACCAATGTTTAACATACTTTCATTTGTAATAAACTCAATGTCATTTTCTTCAAT
GTAAGATGAAATAAGAGTAGCCTTTGCCTCGCTATACATTTCTAAATCGCCTTGTTTTTCTATCGTATTG
CGAGAATTTTTAGCCCAAGCCATTAATGGATCATTTTTCCATTTTTCAATAACATTATTGTTATACCAAA
TGTCATATCCTATAATCTGGTTTTTGTTTTTTGAATAATAAATGTTACTGTTCTTGCGGTTTGGAGGAA
TTGATTCAAATTCAAGCGAAATAATTCAGGGTCAAAATATGTATCAATGCAGCATTTGAGCAAGTGCGAT
AAATCTTTAAGTCTTCTTTCCCATGGTTTTTTAGTCATAAAACTCTCCATTTTGATAGGTTGCATGCTAG
ATGCTGATATATTTTAGAGGTGATAAAATTAACTGCTTAACTGTCAATGTAATACAAGTTGTTTGATCTT
TGCAATGATTCTTATCAGAAACCATATAGTAAATTAGTTACACAGGAAATTTTAATATTATTATTATCA
TTCATTATGTATTAAAATTAGAGTTGTGGCTTGGCTCTGCTAACACGTTGCTCATAGGAGATATGGTAGA
GCCGCAGACACGTCGTATGCAGGAACGTGCTGCGGCTGGCTGGTGAACTTCCGATAGTGCGGGTGTTGAA
TGATTTCCAGTTGCTACCGATTTACATATTTTTGCATGAGAGAATTTGTACCACCTCCCACCGACCAT
CTATGACTGTACGCCACTGTCCCTAGGACTGCTATGTGCCGGAGCGGACATTACAAACGTCCTTCTCGGT
GCATGCCACTGTTGCCAATGACCTGCCTAGGAATTGGTTAGCAAGTTACTACCGGATTTTGTAAAAACAG
CCCTCCTCATATAAAAGTATTCGTTCACTTCCGATAAGCGTCGTAATTTTCTATCTTTCATCATATTCT
AGATCCCTCTGAAAAAATCTTCCGAGTTTGCTAGGCACTGATACATAACTCTTTTCCAATAATTGGGGAA
GTCATTCAAATCTATAATAGGTTTCAGATTTGCTTCAATAAATTCTGACTGTAGCTGCTGAAACGTTGCG
GTTGAACTATATTTCCTTATAACTTTTACGAAAGAGTTTCTTTGAGTAATCACTTCACTGCAAGTGCTTCC
CTGCCTCCAAACGATACCTGTTAGCAATATTTAATAGCTTGAAATGATGAAGAGCTCTGTGTTTGTCTTC
CTGCCTCCAGTTCGCCGGGCATTCAACATAAAAACTGATAGCACCCGGAGTTCCGGAAACGAAATTTGCA
TATACCCATTGCTCACGAAAAAAATGTCCTTGTCGATATAGGGATGAATCGCTTGGTGTACCTCATCTA
CTGCGAAAACTTGACCTTTCTCTCCCATATTGCAGTCGCGGCACGATGGAACTAAATTAATAGGCATCAC
CGAAAATTCAGGATAATGTGCAATAGGAAGAAAATGATCTATATTTTTGTCTGTCCTATATCACCACAA
AATGGACATTTTTCACCTGATGAAACAAGCATGTCATCGTAATATGTTCTAGCGGGTTTGTTTTTATCTC
GGAGATTATTTTCATAAAGCTTTTCTAATTTAACCTTTGTCAGGTTACCAACTACTAAGGTTGTAGGCTC
AAGAGGGTGTGTCCTGTCGTAGGTAAATAACTGACCTGTCGAGCTTAATATTCTATATTGTTGTTCTTTC
TGCAAAAAGTGGGGAAGTGAGTAATGAAATTATTTCTAACATTTATCTGCATCATACCTTCCGAGCATT
TATTAAGCATTTCGCTATAAGTTCTCGCTGGAAGAGGTAGTTTTTTCATTGTACTTTACCTTCATCTCTG
TTCATTATCATCGCTTTTAAAACGGTTCGACCTTCTAATCCTATCTGACCATTATAATTTTTTAGAATGG
TTTCATAAGAAAGCTCTGAATCAACGGACTGCGATAATAAGTGGTGGTATCCAGAATTTGTCACTTCAAG
TAAAAACACCTCACGAGTTAAAACACCCTAAGTTCTCACCGAATGTCTCAATATCCGGACGGATAATATTT
ATTGCTTCTCTTGACCGTAGGACTTTCCACATGCAGGATTTTGGAACCTCTTGCAGTACTACTGGGGAAT
GAGTTGCAATTATTGCTACACCATTGCGTGCATCGAGTAAGTCGCTTAATGTTCGTAAAAAAGCAGAGAG
CAAAGGTGGATGCAGATGAACCTCTGGTTCATCGAATAAAACTAATGACTTTTCGCCAACGACATCTACT
AATCTTGTGATAGTAAATAAAACAATTGCATGTCCAGAGCTCATTCGAAGCAGATATTTCTGGATATTGT
CATAAAACAATTTAGTGAATTTATCATCGTCCACTTGAATCTGTGGTTCATTACGTCTTAACTCTTCATA
TTTAGAAATGAGGCTGATGAGTTCCATATTTGAAAAGTTTTCATCACTACTTAGTTTTTTGATAGCTTCA
AGCCAGAGTTGTCTTTTCTATCTACTCTCATACAACCAATAAATGCTGAAATGAATTCTAAGCGGAGAT
CGCCTAGTGATTTAAACTATTGCTGGCAGCATTCTTGAGTCCAATATAAAGTATTGTGTACCTTTTGC
TGGGTCAGGTTGTTCTTTAGGAGGAGTAAAAGGATCAAATGCACTAAACGAAACTGAAACAAGCGATCGA
AAATATCCCTTTGGGATTCTTGACTCGATAAGTCTATTATTTTCAGAGAAAAAATATTCATTGTTTCTG
GGTTGGTGATTGCACCAATCATTCCATTCAAAATTGTTGTTTTACCACACCCATTCCGCCCGATAAAAGC
ATGAATGTTCGTGCTGGGCATAGAATTAACCGTCACCTCAAAAGGTATAGTTAAATCACTGAATCCGGGA
GCACTTTTTCTATTAAATGAAAAGTGGAAATCTGACAATTCTGGCAAACCATTTAACACACGTGCGAACT
GTCCATGAATTTCTGAAAGAGTTACCCCTCTAAGTAATGAGGTGTTAAGGACGCTTTCATTTTCAATGTC
GGCTAATCGATTTGGCCATACTACTAAATCCTGAATAGCTTTAAGAAGGTTATGTTAAAACCATCGCTT
AATTTGCTGAGATTAACATAGTAGTCAATGCTTTCACCTAAGGAAAAAAACATTTCAGGGAGTTGACTGA
ATTTTTTATCTATTAATGAATAAGTGCTTACTTCTTCTTTTTGACCTACAAAACCAATTTTAACATTTCC
GATATCGCATTTTTCACCATGCTCATCAAAGACAGTAAGATAAAACATTGTAACAAAGGAATAGTCATTC
CAACCATCTGCTCGTAGGAATGCCTTATTTTTTCTACTGCAGGAATATACCCGCCTCTTTCAATAACAC
TAAACTCCAACATATAGTAACCCTTAATTTTATTAAAATAACCGCAATTTATTTGGCGGCAACACAGGAT
CTCTCTTTTAAGTTACTCTCTATTACATACGTTTTCCATCTAAAATTAGTAGTATTGAACTTAACGGGG
CATCGTATTGTAGTTTTCCATATTTAGCTTTCTGCTTCCTTTTGGATAACCCACTGTTTATTCATGTTGCA
TGGTGCACTGTTTATACCAACGATATAGTCTATTAATGCATATATAGTAGTCGCCGAACGATTAGCTCTTC
AGGCTTCTGAAGAAGCGTTTCAAGTACTAATAAGCCGATAGATAGCCACGGACTTCGTAGCCATTTTTCA
TAAGTGTTAACTTCCGCTCCTCGCTCATAACAGACATTCACTACAGTTATGGCGGAAAGGTATGCATGCT
GGGTGTGGGGAAGTCGTGAAAGAAAAGAAGTCAGCTGCGTCGTTTGACATCACTGCTATCTTCTTACTGG
TTATGCAGGTCGTAGTGGGTGGCACACAAAGCTTTGCACTGGATTGCGAGGCTTTGTGCTTCTCTGGAGT
GCGACAGGTTTGATGACAAAAAATTAGCGCAAGAAGACAAAATCACCTTGCGCTAATGCTCTGTTACAG
GTCACTAATACCATCTAAGTAGTTGATTCATAGTGACTGCATATGTTGTGTTTTACAGTATTATGTAGTC
TGTTTTTTATGCAAAATCTAATTTAATATATTGATATTTATATCATTTTACGTTCTCGTTCAGCTTTTT
TATACTAAGTTGGCATTATAAAAAGCATTGCTTATCAATTTGTTGCAACGAACAGGTCACTATCAGTCA
AAATAAAATCATTATTTGATTTCAATTTTGTCCCACTCCCTGCCTCTGTCATCACGATACTGTGATGCCA
```

FIG. 10G. Continuation of (CJLB-4 [organism=Campylobacter phage CJLB-4] partial genome)

```
TGGTGTCCGACTTATGCCCGAGAAGATGTTGAGCAAACTTATCGCTTATCTGCTTCTCATAGAGTCTTGC
AGACAAACTGCGCAACTCGTGAAAGGTAGGCGGATCCCCTTCGAAGGAAAGACCTGATGCTTTTCGTGCG
CGCATAAAATACCTTGATACTGTGCCGGATGAAAGCGGTTCGCGACGAGTAGATGCAATTATGGTTTCTC
CGCCAAGAATCTCTTTGCATTTATCAAGTGTTTCCTTCATTGATATTCCGAGAGCATCAATATGCAATGC
TGTTGGGATGGCAATTTTTACGCCTGTTTTGCTTTGCTGACATAAAGATATCCATCTACGATATCAGAC
CACTTCATTTCGCATAAATCACCAACTCGTTGCCCGGTAACAACAGCCAGTTCCATTGCAAGTCTGAGCG
AACATGGTGATGATTCTGCTGCTTGATAAATTTTCAGGTATTCGTCAGCCGTAAGTCTTGATCTCCTTAC
CTCTGATTTTGCTGCGCGAGTGGCAGCGACATGGTTTGTTGTTATATGGCCTTCAGCTATTGCCTCTCGG
AATGCATCGCTCAGTGTTGATCTGATTAACTTGGCTGACGCCGCCTTGCCCTCGTCTATGTATCCATTGA
GCATTGCCGCAATTTCTTTTGTGGTGATGTCTTCAAGTGGAGCATCAGGCAGACCCCTCCTTATTGCTTT
AATTTTGCTCATGTAATTTATGAGTGTCTTCTGCTTGATTCCTCTGCTGGCCAGGATTTTTTCGTAGCGA
TCAAGCCATGAATGTAACGTAACGGAATTATCACTGTTGATTCTCGCTGTCAGAGGCTTGTGTTTGTGTC
CTGAAAATAACTCAATGTTGGCCTGTATAGCTTCAGTGATTGCGATTCGCCTGTCTCTGCCTAATCCAAA
CTCTTTACCCGTCCTTGGGTCCCTGTAGCAGTAATATCCATTGTTTCTTATATAAAGGTTAGGGGGTAAA
TCCCGGCGCTCATGACTTCGCCTTCTTCCCATTTCTGATCCTCTTCAAAAGGCCACCTGTTACTGGTCGA
TTTAAGTCAACCTTTACCGCTGATTCGTGGAACAGATACTCTCTTCATCCTTAACCGGAGGTGGGAATA
TCCTGCATTCCCGAACCCATCGACGAACTGTTTCAAGGCTTCTTGGACGTCGCTGGCGTGCGTTCCACTC
CTGAAGTGTCAAGTACATCGCAAAGTCTCCGCAATTACACGCAAGAAAAAACCGCCATCAGGCGGCTTGG
TGTTCTTTCAGTTCTTCAATTCGAATATTGGTTACGTCTGCATGTGCTATCTGCGCCCATATCATCCAGT
GGTCGTAGCAGTCGTTGATGTTCTCCGCTTCGATAACTCTGTTGAATGGCTCTCCATTCCATTCTCCTGT
GACTCGGAAGTGCATTTATCATCTCCATAAAACAAAACCCGCCGTAGCGAGTTCAGATAAAATAAATCCC
CGCGAGTGCGAGGATTGTTATGTAATATTGGGTTTAATCATCTATATGTTTTGTACAGAGAGGGCAAGTA
TCGTTTCCACCGTACTCGTGATAATAATTTTGCACGGTATCAGTCATTTCTCGCACATTGCAGAATGGGG
ATTTGTCTTCATTAGACTTATAAACCTTCATGGAATATTTGTATGCCGACTCTATATCTATACCTTCATC
TACATAAACACCTTCGTGATGTCTGCATGGAGACAAGACACCGGATCTGCACAACATTGATAACGCCCAA
TCTTTTTGCTCAGACTCTAACTCATTGATACTCATTTATAAACTCCTTGCAATGTATGTCGTTTCAGCTA
AACGGTATCAGCAATGTTTATGTAAAGAAACAGTAAGATAATACTCAACCCGATGTTTGAGTACGGTCAT
CATCTGACACTACAGACTCTGGCATCGCTGTGAAGACGACGCGAAATTCAGCATTTTCACAAGCGTTATC
TTTTACAAAACCGATCTCACTCTCCTTTGATGCGAATGCCAGCGTCAGACATCATATGCAGATACTCACC
TGCATCCTGAACCCATTGACCTCCAACCCCGTAATAGCGATGCGTAATGATGTCGATAGTTACTAACGGG
TCTTGTTCGATTAACTGCCGCAGAAACTCTTCCAGGTCACCAGTGCAGTGCTTGATAACAGGAGTCTTCC
CAGGATGGCGAACAACAAGAAACTGGTTTCCGTCTTCACGGACTTCGTTGCTTTCCAGTTTAGCAATACG
CTTACTCCCATCCGAGATAACACCTTCGTAATACTCACGCTGCTCGTAATTCTTCTATTTCTGATGCTGAATCAA
AGCTCAACACGCAGTTTCCCTACTGTTAGCGCAATATCCTCGTTCTCCTGGTCGCGGCGTTTGATGTATT
GCTGGTTTCTTTCCCGTTCATCCAGCAGTTCCAGCACAATCGATGGTGTTACCAATTCATGGAAAAGGTC
TGCGTCAAATCCCCAGTCGTCATGCATTGCCTGCTCTGCCGCTTCACGCAGTGCCTGAGAGTTAATTTCG
CTCACTTCGAACCTCTCTGTTTACTGATAAGTTCCAGATCCTCCTGGCAACTTGCACAAGTCCGACAACC
CTGAACGACCAGGCGTCTTCGTTCATCTATCGGATCGCCACACTCACAACAATGAGTGGCAGATATAGCC
TGGTGGTTCAGGCGGCGCATTTTTATTGCTGTGTTGCGCTGTAATTCTTCTATTTCTGATGCTGAATCAA
TGATGTCTGCCATCTTTCATTAATCCCTGAACTGTTGGTTAATACGCTTGAGGGTGAATGCGAATAATAA
AAAAGGAGCCTGTAGCTCCCTGATGATTTTGCTTTTCATGTTCATCGTTCCTTAAAGACGCCGTTTAACA
TGCCGATTGCCAGGCTTAAATGAGTCGGTGTGAATCCCATCAGCGTTACCGTTTCGCGGTGCTTCTTCAG
TACGCTACGGCAAATGTCATCGACGTTTTTATCCGGAAACTGCTGTCTGGCTTTTTTTGATTTCAGAATT
AGCCTGACGGGCAATGCTGCGAAGGGCGTTTTCCTGCTGAGGTGTCATTGAACAAGTCCCATGTCGGCAA
GCATAAGCACACAGAATATGAAGCCCGCTGCCAGAAAAATGCATTCCGTGGTTGTCATACCTGGTTTCTC
TCATCTGCTTCTGCTTTCGCCACCATCATTTCCAGCTTTTGTGAAAGGGATGCGGCTAACGTATGAAATT
CTTCGTCTGTTTCTACTGGTATTGGCACAAACCTGATTCAATTTGAGCAAGGCTATGTGCCATCTCGAT
ACTCGTTCTTAACTCAACAGAAGATGCTTTGTGCATACAGCCCCTCGTTTATTATTTATCTCCTCAGCCA
GCCGCTGTGCTTTCAGTGGATTTCGGATAACAGAAAGGCCGGGAAATACCCAGCCTCGCTTTGTAACGGA
GTAGACGAAAGTGATTGCGCCTACCCGGATATTATCGTGAGATGCGTCATCGCCATTGCTCCCCAAATA
CAAAACCAATTTCAGCCAGTGCCTCGTCCATTTTTTCGATGAACTCCGGCACGATCTCGTCAAAACTCGC
CATGTACTTTTCATCCCGCTCAATCACGACATAATGCAGGCCTTCACGCTTCATACGCGGGTCATAGTTG
GCAAAGTACCAGGCATTTTTTCGCGTCACCCACATGCTGTACTGCACCTGGGCCATGTAAGCTGACTTTA
TGGCCTCGAAACCACCGAGCCGGAACTTCATGAAATCCCGGGAGGTAAACGGGCATTTCAGTTCAAGGCC
GTTGCCGTCACTGCCATAAACCATCGGGAGAGCAGGCGGTACGCATACTTCGTCGCGATAGATGATCGGG
GATTCAGTAACATTCACGCCGGAAGTGAATTCAAACAGGGTTCTGCCGTCGTTCTCGTACTGTTTTCCCC
AGGCCAGTGCTTTAGCGTTAACTTCCGGAGCCACACCGGTGCAAACCTCAGCAAGCAGGGTGTGGAAGTA
GGACATTTTCATGTCAGGCCACTTCTTTCCGGAGCGGGGTTTTGCTATCACGTTGTGAACTTCTGAAGCG
GTGATGACGCCGAGCCGTAATTTGTGCCACGCATCATCCCCTGTTCGACAGCTCTCACATCGATCCCGG
TACGCTGCAGGATAATGTCCGGTGTCATGCTGCCACCTTCTGCTCTGCGGCTTTCTGTTTCAGGAATCCA
AGAGCTTTTACTGCTTCGGCCTGTGTCAGTTCTGACGATGCACGAATGTCGCGGCGAAATATCTGGGAAC
AGAGCGGCAATAAGTCGTCATCCCATGTTTTATCCAGGGCGATCAGCAGAGTGTTAATCTCCTGCATGGT
TTCATCGTTAACCGGAGTGATGTCGCGTTCCGGCTGACGTTCTGCAGTGTATGCAGTATTTTCGACAATG
CGCTCGGCTTCATCCTTGTCATAGATACCAGCAAATCCGAAGGCCAGACGGGCACACTGAATCATGGCTT
TATGACGTAACATCCGTTTGGGATGCGACTGCCACGGCCCCGTGATTTCTGCCTTCGCGAGTTTTGAA
TGGTTCGCGGCGGCATTCATCCATCCATTCGGTAACGCAGATCGGATGATTACGGTCCTTGCGGTAAATC
```

FIG. 10H. Continuation of (CJLB-4 [organism=Campylobacter phage CJLB-4] partial genome)

```
CGGCATGTACAGGATTCATTGTCCTGCTCAAAGTCCATGCCATCAAACTGCTGGTTTTCATTGATGATGC
GGGACCAGCCATCAACGCCCACCACCGGAACGATGCCATTCTGCTTATCAGGAAAGGCGTAAATTTCTTT
CGTCCACGGATTAAGGCCGTACTGGTTGGCAACGATCAGTAATGCGATGAACTGCGCATCGCTGGCATCA
CCTTTAAATGCCGTCTGGCGAAGAGTGGTGATCAGTTCCTGTGGGTCGACAGAATCCATGCCGACACGTT
CAGCCAGCTTCCCAGCCAGCGTTGCGAGTGCAGTACTCATTCGTTTTATACCTCTGAATCAATATCAACC
TGGTGGTGAGCAATGGTTTCAACCATGTACCGGATGTGTTCTGCCATGCGCTCCTGAAACTCAACATCGT
CATCAAACGCACGGGTAATGGATTTTTTGCTGGCCCCGTGGCGTTGCAAATGATCGATGCATAGCGATTC
AAACAGGTGCTGGGGCAGGCCTTTTTCCATGTCGTCTGCCAGTTCTGCCTCTTTCTCTTCACGGGCGAGC
TGCTGGTAGTGACGCGCCCAGCTCTGAGCCTCAAGACGATCCTGAATGTAATAAGCGTTCATGGCTGAAC
TCCTGAAATAGCTGTGAAAATATCGCCCGCGAAATGCCGGGCTGATTAGGAAAACAGGAAAGGGGGTTAG
TGAATGCTTTTGCTTGATCTCAGTTTCAGTATTAATATCCATTTTTTATAAGCGTCGACGGCTTCACGAA
ACATCTTTTCATCGCCAATAAAAGTGGCGATAGTGAATTTAGTCTGGATAGCCATAAGTGTTTGATCCAT
TCTTTGGGACTCCTGGCTGATTAAGTATGTCGATAAGGCGTTTCCATCCGTCACGTAATTTACGGGTGAT
TCGTTCAAGTAAAGATTCGGAAGGGCAGCCAGCAACAGGCCACCCTGCAATGGCATATTGCATGGTGTGC
TCCTTATTTATACATAACGAAAAACGCCTCGAGTGAAGCGTTATTGGTATGCGGTAAAACCGCACTCAGG
CGGCCTTGATAGTCATATCATCTGAATCAAATATTCCTGATGTATCGGTAATTCTTATTCCTTC
GCTACCATCCATTGGAGGCCATCCTTCCTGACCATTTCCATCATTCCAGTCGAACTCACACACAACACCA
TATGCATTTAAGTCGCTTGAAATTGCTATAAGCAGAGCATGTTGCGCCAGCATGATTAATACAGCATTTA
ATACAGAGCCGTGTTTATTGAGTCGGTATTCAGAGTCTGACCAGAAATTATTAATCTGGTGAAGTTTTTC
CTCTGTCATTACGTCATGGTCGATTTCAATTTCTATTGATGCTTTCCAGTCGTAATCAATGATGTATTTT
TTGATGTTTGACATCTGTTCATATCCTCACAGATAAAAAATCGCCCTCACACTGGAGGGCAAAGAAGATT
TCCAATAATCAGAACAAGTCGGCTCCTGTTTAGTTACGAGCGACATTGCTCCGTGTATTCACTCGTTGGA
ATGAATACACAGTGCAGTGTTTATTCTGTTATTTATGCCAAAAATAAAGGCCACTATCAGGCAGCTTTGT
TGTTCTGTTTACCAAGTTCTCTGGCAATCATTGCCGTCGTTCGTATTGCCCATTTATCGACATATTTCCC
ATCTTCCATTACAGGAAACATTTCTTCAGGCTTAACCATGCATTCCGATTGCAGCTTGCATCCATTGCAT
CGCTTGAATTGTCCACACCATTGATTTTTATCAATAGTCGTAGTCATACGGATAGTCCTGGTATTGTTCC
ATCACATCCTGAGGATGCTCTTCGAACTCTTCAAATTCTTCTTCCATATATCACCTTAAATAGTGGATTG
CGGTAGTAAAGATTGTGCCTGTCTTTTAACCACATCAGGCTGGTTCTCGTGTACCCCTACAGCGAG
AAATCGGATAAACTATTACAACCCCTACAGTTTGATGAGTATAGAAATGGATCCACTCGTTATTCTCGGA
CGAGTGTTCAGTAATGAACCTCTGGAGAGAACCATGTATATGATCGTTATCTGGGTTGGACTTCTGCTTT
TAAGCCCAGATAACTGGCCTGAATATGTTAATGAGAGAATCGGTATTCCTCATGTGTGGCATGTTTCGT
CTTTGCTCTTGCATTTTCGCTAGCAATTAATGTGCATCGATTATCAGCTATTGCCAGCGCCAGATATAAG
CGATTTAAGCTAAGAAAACGCATTAAGATGCAAAACGATAAAGTGCGATCAGTAATTCAAAACCTTACAG
AAGAGCAATCTATGGTTTTGTGCGCAGCCCTTAATGAAGGCAGGAAGTATGTGGTTACATCAAAACAATT
CCCATACATTAGTGAGTTGATTGAGCTTGGTGTGTTGAACAAAACTTTTTCCCGATGGAATGGAAAGCAT
ATATTATTCCCTATTGAGGCATATTTACTGGACTGAATTAGTTGCCAGCTATGATCCATATAATATTGAGA
TAAAGCCAAGGCCAATATCTAAGTAACTAGATAAGAGGAATCGATTTTCCCTTAATTTTCTGGCGTCCAC
TGCATGTTATGCCGCGTTCGCCAGGCTTGCTGTACCATGTGCGCTGATTCTTGCGCTCAATACGTTGCAG
GTTGCTTTCAATCTGTTTGTGGTATTCAGCCAGCACTGTAAGGTCTATCGGATTTAGTGCGCTTTCTACT
CGTGATTTCGGTTTGCGATTCAGCGAGAGAATAGGGCGGTTAACTGGTTTTGCGCTTACCCCAACCAACA
GGGGATTTGCTGCTTTCCATTGAGCCTGTTTCTCTGCGCGACGTTCGCGGCGGCGTGTTTGTGCATCCAT
CTGGATTCTCCTGTCAGTTAGCTTTGGTGGTGTGTGGCAGTTGTAGTCCTGAACGAAAACCCCCCGCGAT
TGGCACATTGGCAGCTAATCCGGAATCGCACTTACGGCCAATGCTTCGTTTCGTATCACACACCCCAAAG
CCTTCTGCTTTGAATGCTGCCCTTCTTCAGGGCGTTAATTTTTAAGAGCGTCACCTTCATGGTGGTCAGTG
CGTCCTGCTGATGTGCTCAGTATCACCGCCAGTGGTATTTATGTCAACACCGCCAGAGATAATTTATCAC
CGCAGATGGTTATCTGTATGTTTTTTATATGAATTTATTTTTTGCAGGGGGGCATTGTTTGGTAGGTGAG
AGATCTGAATTGCTATGTTTAGTGAGTTGTATCTATTTATTTTTTCAATAAATACAATTGGTTATGTGTTT
TGGGGGCGATCGTGAGGCAAAGAAAACCCGGCGCTGAGGCCGGGTTATTCTTGTTCTCTGGTCAAATTAT
ATAGTTGGAAAACAAGGATGCATATATGAATGAACGATGCAGAGGCAATGCCGATGGCGATAGTGGGTAT
CATGTAGCCGCTTATGCTGGAAAAGAAGCAATAACCGCAGAAAAACAAAGCTCCAAGCTCAACAAAACTA
AGGGCATAGACAATAACTACCGATGTCATATACCCATACTCTCTAATCTTGGCCAGTCGGCGCGTTCTGC
TTCCGATTAGAAACGTCAAGGCAGCAATCAGGATTGCAATCATGGTTCCTGCATATGATGACAATGTCGC
CCCAAGACCATCTCTATGAGCTGAAAAGAAACACCAGGAATGTAGTGGCGGAAAAGGAGATAGCAAATG
CTTACGATAACGTAAGGAATTATTACTATGTAAACACCAGGCATGATTCTGTTCCGCATAATTACTCCTG
ATAATTAATCCTTAACTTTGCCCACCTGCCTTTTAAAACATTCCAGTATATCACTTTTCATTCTTGCGTA
GCAATATGCCATCTCTTCAGCTATCTCAGCATTGGTGACCTTGTTCAGAGGCGCTGAGAGATGGCCTTTT
TCTGATAGATAATGTTCTGTTAAAATATCTCCGGCCTCATCTTTTGCCCGCAGGCTAATGTCTGAAAATT
GAGGTGACGGGTTAAAAATAATATCCTTGGCAACCTTTTTTATATCCCTTTTAAATTTTGGCTTAATGAC
TATATCCAATGAGTCAAAAAGCTCCCCTTCAATATCTGTTGCCCCTAAGACCTTTAATATATCGCCAAAT
ACAGGTAGCTTGGCTTCTACCTTCACCGTTGTTCGGCCGATGAAATGCATATGCATAACATCGTCTTTGG
TGGTTCCCCTCATCAGTGGCTCTATCTGAACGCGCTCTCCACTGCTTAATGACATTCCTTTCCCGATTAA
AAAATCTGTCAGATCGGATGTGGTCGGCCCGAAAACAGTTCTGGCAAAACCAATGGTGTCGCCTTCAACA
AACAAAAAGATGGGAATCCCAATGATTCGTCATCTGCGAGGCTGTTCTTAATATCTTCAACTGAAGCTT
TAGAGCGATTTATCTTCTGAACCAGACTCTTGTCATTTGTTTTGGTAAAGAGAAAAGTTTTTCCATCGAT
TTTATGAATATACAAATAATTGGAGCCAACCTGCAGGTGATGATTATCAGCCAGCAGAGAATTAAGGAAA
ACAGACAGGTTTATTGAGCGCTTATCTTTCCCTTTATTTTTGCTGCGGTAAGTCGCATAAAAACCATTCT
```

FIG. 10I. Continuation of (CJLB-4 [organism=Campylobacter phage CJLB-4] partial genome)

```
TCATAATTCAATCCATTTACTATGTTATGTTCTGAGGGGAGTGAAAATTCCCCTAATTCGATGAAGATTC
TTGCTCAATTGTTATCAGCTATGCGCCGACCAGAACACCTTGCCGATCAGCCAAACGTCTCTTCAGGCCA
CTGACTAGCGATAACTTTCCCCACAACGGAACAACTCTCATTGCATGGGATCATTGGGTACTGTGGGTTT
AGTGGTTGTAAAAACACCTGACCGCTATCCCTGATCAGTTTCTTGAAGGTAAACTCATCACCCCCAAGTC
TGGCTATGCAGAAATCACCTGGCTCAACAGCCTGCTCAGGGTCAACGAGAATTAACATTCCGTCAGGAAA
GCTTGGCTTGGAGCCTGTTGGTGCGGTCATGGAATTACCTTCAACCTCAAGCCAGAATGCAGAATCACTG
GCTTTTTTGGTTGTGCTTACCCATCTCTCCGCATCACCTTTGGTAAAGGTTCTAAGCTTAGGTGAGAACA
TCCCTGCCTGAACATGAGAAAAAACAGGGTACTCATACTCACTTCTAAGTGACGGCTGCATACTAACCGC
TTCATACATCTCGTAGATTTCTCTGGCGATTGAAGGGCTAAATTCTTCAACGCTAACTTTGAGAATTTTT
GTAAGCAATGCGGCGTTATAAGCATTTAATGCATTGATGCCATTAAATAAAGCACCAACGCCTGACTGCC
CCATCCCCATCTTGTCTGCGACAGATTCCTGGGATAAGCCAAGTTCATTTTTCTTTTTTTCATAAATTGC
TTTAAGGCGACGTGCGTCCTCAAGCTGCTCTTGTGTTAATGGTTTCTTTTTTGTGCTCATACGTTAAATC
TATCACCGCAAGGGATAAATATCTAACACCGTGCGTGTTGACTATTTTACCTCTGGCGGTGATAATGGTT
GCATGTACTAAGGAGGTTGTATGGAACAACGCATAACCCTGAAAGATTATGCAATGCGCTTTGGGCAAAC
CAAGACAGCTAAAGATCTCGGCGTATATCAAAGCGCGATCAACAAGGCCATTCATGCAGGCCGAAAGATT
TTTTTAACTATAAACGCTGATGGAAGCGTTTATGCGGAAGAGGTAAAGCCCTTCCCGAGTAACAAAAAAA
CAACAGCATAAATAACCCCGCTCTTACACATTCCAGCCCTGAAAAAGGGCATCAAATTAAACCACACCTA
TGGTGTATGCATTTATTTGCATACATTCAATCAATTGTTATCTAAGGAAATACTTACATATGGTTCGTGC
AAACAAACGCAACGAGGCTCTACGAATCGAGAGTGCGTTGCTTAACAAAATCGCAATGCTTGGAACTGAG
AAGACAGCGGAAGCTGTGGGCGTTGATAAGTCGCAGATCAGCAGGTGGAAGAGGGACTGGATTCCAAAGT
TCTCAATGCTGCTTGCTGTTCTTGAATGGGGGGTCGTTGACGACGACATGGCTCGATTGGCGCGACAAGT
TGCTGCGATTCTCACCAATAAAAAACGCCCGGCGGCAACCGAGCGTTCTGAACAAATCCAGATGGAGTTC
TGAGGTCATTACTGGATCTATCAACAGGAGTCATTATGACAAATACAGCAAAAATACTCAACTTCGGCAG
AGGTAACTTTGCCGGACAGGAGCGTAATGTGGCAGATCTCGATGATGGTTACGCCAGACTATCAAATATG
CTGCTTGAGGCTTATTCGGGCGCAGATCTGACCAAGCGACAGTTTAAAGTGCTGCTTGCCATTCTGCGTA
AAACCTATGGGTGGAATAAACCAATGGACAGAATCACCGATTCTCAACTTAGCGAGATTACAAAGTTACC
TGTCAAACGGTGCAATGAAGCCAAGTTAGAACTCGTCAGAATGAATATTATCAAGCAGCAAGGCGGCATG
TTTGGACCAAATAAAAACATCTCAGAATGGTGCATCCCTCAAAACGAGGGAAAATCCCCTAAAACGAGGG
ATAAAACATCCCTCAAATTGGGGGATTGCTATCCCTCAAAACAGGGGGACACAAAAGACACTATTACAAA
AGAAAAAAGAAAAGATTATTCGTCAGAGAATTCTGGCGAATCCTCTGACCAGCCAGAAAACGACCTTTCT
GTGGTGAAACCGGATGCTGCAATTCAGAGCGGCAGCAAGTGGGGGACAGCAGAAGACCTGACCGCCGCAG
AGTGGATGTTTGACATGGTGAAGACTATCGCACCATCAGCCAGAAAACCGAATTTTGCTGGGTGGGCTAA
CGATATCCGCCTGATCGTGAACGTGACGGACGTAACCACCCGCGACATGTGTGTGCTGTTCCGCTGGGCA
TGCCAGGACAACTTCTGGTCCGGTAACGTGCTGAGCCCGGCCCAAACTCCGCGATAAGTGGACCCAACTCG
AAATCAACCGTAACAAGCAACAGGCAGGCGTGACAGCCAGCAAACCAAAACTCGACCTGACAAACACAGA
CTGGATTTACGGGGTGGATCTATGAAAAACATCGCCCACAGATGGTTAACTTTGACCGTGAGCAGATGC
GTCGGATCGCCAACAACATGCCGGAACAGTACGACGAAAAGCCGCAGGTACAGCAGGTAGCGCAGATCAT
CAACGGTGTGTTCAGCCAGTTACTGGCAACTTTCCCGGCGAGCCTGGCTAACCGTGACCAGAACGAAGTG
AACGAAATCCGTCGCCAGTGGGTTCTGGCTTTTCGGGAAAACGGGATCACCACGATGGAACAGGTTAACG
CAGGAATGCGCGTAGCCCGTCGGCAGAATCGACCATTTCTGCCATCACCCGGGCAGTTTGTTGGCATGGTG
CCGGGAAGAAGCATCCGTTACCGCCGGACTGCCAAACGTCAGCGAGCTGGTTGATATGGTTTACGAGTAT
TGCCGGAAGCGAGGCCTGTATCCGGATGCGGAGTCTTATCCGTGGAAATCAAACGCGCACTACTGGCTGG
TTACCAACCTGTATCAGAACATGCGGGCCAATGCGCTTACTGATGCGGAATTACGCCGTAAGGCCGCAGA
TGAGCTTGTCCATATGACTGCGAGAATTAACCGTGGTGAGGCGATCCCTGAACCAGTAAAACAACTTCCT
GTCATGGGCGGTAGACCTCTAAATCGTGCACAGGCTCTGGCGAAGATCGCAGAAATCAAAGCTAAGTTCG
GACTGAAAGGAGCAAGTGTATGACGGGCAAAGAGGCAATTATTCATTACCTGGGGACGCATAATAGCTTC
TGTGCGCCGACGTTGCCGCGCTAACAGGCGCAACAGTAACCAGCATAAATCAGGCCGCGGCTAAAATGG
CACGGGCAGGTCTTCTGGTTATCGAAGGTAAGGTCTGGCGAACGGTGTATTACCGGTTTGCTACCAGGGA
AGAACGGGAAGGAAAGATGAGCACGAACCTGGTTTTTAAGGAGTGTCGCCAGAGTGCCGCGATGAAACGG
GTATTGGCGGTATATGGAGTTAAAAGATGACCATCTACATTACTGAGCTAATAACAGGCCTGCTGGTAAT
CGCAGGCCTTTTTATTTGGGGGAGAGGGAAGTCATGAAAAAACTAACCTTTTGAAATTCGATCTCCAGCAC
ATCAGCAAAACGCTATTCACGCAGTACAGCAAATCCTTCCAGACCCAACCAAACCAATCGTAGTAACCAT
TCAGGAACGCAACCGCAGCTTAGACCAAAACAGGAAGCTATGGGCCTGCTTAGGTGACGTCTCTCGTCAG
GTTGAATGGCATGGTCGCTGGCTGGATGCAGAAAGCTGGAAGTGTGTGTTTACCGCAGCATTAAAGCAGC
AGGATGTTGTTCCTAACCTTGCCGGGAATGGCTTTGTGGTAATAGGCCAGTCAACCAGCAGGATGCGTGT
AGGCGAATTTGCGGAGCTATTAGAGCTTATACAGGCATTCGGTACAGAGCGTGGCGTTAAGTGGTCAGAC
GAAGCGAACTGGCTCTGCAGTGGAAAGCGAGATGGGGAGACAGGGCTGCATGATAAATGTCGTTAGTTT
CTCCGGTGGCAGGACGTCAGCATATTTGCTCTGGCTAATGGAGCAAAAGCGACGGGCAGGTAAAGACGTG
CATTACGTTTTCATGGATACAGGTTGTGAACATCCAATGACATATCGGTTTGTCAGGGAAGTTGTGAAGT
TCTGGGATATACCGCTCACCGTATTGCAGGTTGATATCAACCCGGAGCTTGGACAGCCAAATGGTTATAC
GGTATGGGAACCAAAGGATATTCAGACGCGAATGCCTGTTCTGAAGCCATTTATCGATATGGTAAAGAAA
TATGGCACTCCATACGTCGGCGGCGCGGTTCTGCACTGACAGATTAAAACTCGTTCCCTTCACCAAATACT
GTGATGACCATTTCGGCGCGAGGGAATTACACCACGTGGATTGGCCATCAGAGCGTGATGAACCGAGCGGCT
AAAGCCAAAGCCTGGAATCAGATATCTTGCTGAACTGTCAGACTTTGAGAAGGAAGATATCCTCGCATGG
TGGAAGCAACAACCATTCGATTTGCAAATACCGGAACATCTCGGTAACTGCATATTCTGCATTAAAAAAT
CAACGCAAAAAATCGGACTTGCCTGCAAAGATGAGGAGGGATTGCAGCGTGTTTTTAATGAGGTCATCAC
```

FIG. 10J. Continuation of (CJLB-4 [organism=Campylobacter phage CJLB-4] partial genome)

```
GGGATCCCATGTGCGTGACGGACATCGGGAAACGCCAAAGGAGATTATGTACCGAGGAAGAATGTCGCTG
GACGGTATCGCGAAAATGTATTCAGAAAATGATTATCAAGCCCTGTATCAGGACATGGTACGAGCTAAAA
GATTCGATACCGGCTCTTGTTCTGAGTCATGCGAAATATTTGGAGGGCAGCTTGATTTCGACTTCGGGAG
GGAAGCTGCATGATGCGATGTTATCGGTGCGGTGAATGCAAAGAAGATAACCGCTTCCGACCAAATCAAC
CTTACTGGAATCGATGGTGTCTCCGGTGTGAAAGAACACCAACAGGGGTGTTACCACTACCGCAGGAAAA
GGAGGACGTGTGGCGAGACAGCGACGAAGTATCACCGACATAATCTGCGAAAACTGCAAATACCTTCCAA
CGAAACGCACCAGAAATAAACCCAAGCCAATCCCAAAAGAATCTGACGTAAAAACCTTCAACTACACGGC
TCACCTGTGGGATATCCGGTGGCTAAGACGTCGTGCGAGGAAAACAAGGTGATTGACCAAAATCGAAGTT
ACGAACAAGAAAGCGTCGAGCGAGCTTTAACGTGCGCTAACTGCGGTCAGAAGCTGCATGTGCTGGAAGT
TCACGTGTGTGAGCACTGCTGCGCAGAACTGATGAGCGATCGATGCACGAGGAAGAAGAT
GATGGCTAAACCAGCGCGAAGACGATGTAAAAACGATGAATGCCGGGAATGGTTTCACCCTGCATTCGCT
AATCAGTGGTGGTGCTCTCCAGAGTGTGGAACCAAGATAGCACTCGAACGACGAAGTAAAGAACGCGAAA
AAGCGGAAAAGCAGCAGAGAAGAAACGACGACGAGAGGAGCAGAAACAGAAGATAAACTTAAGATTCG
AAAACTCGCCTTAAAGCCCCGCAGTTACTGGATTAAACAAGCCCAACAAGCCGTAAACGCCTTCATCAGA
GAAAGAGACCGCGACTTACCATGTATCTCGTGCGGAACGCTCACGTCTGCTCAGTGGGATGCCGGACATT
ACCGGACAACTGCTGCGGCACCTCAACTCCGATTTAATGACGCAATATTCACAAGCAATGCGTGGTGTG
CAACCAGCACAAAAGCGGAAATCTCGTTCCGTATCGCGTCGAACTGATTAGCCGCATCGGGCAGGAAGCA
GTAGACGAAATCGAATCAAACCATAACCGCCATCGCTGGACTATCGAAGAGTGCAAGGCGATCAAGGCAG
AGTACCAACAGAAACTCAAAGACCTGCGAAATAGCAGAAGTGAGGCCGCATGACGTTCTCAGTAAAAACC
ATTCCAGACATGCTCGTTGAAACATACGGAAATCAGACAGAAGTAGCACGCAGACTGAAATGTAGTCGCG
GTACGGTCAGAAATACGTTGATGATAAAGACGGGAAAATGCACGCCATCGTCAACGACGTTCTCATGGT
TCATCGCGGATGGAGTGAAAGAGATGCGCTATTACGAAAAAAATTGATGGCAGCAAATACCGAAATATTTG
GGTAGTTGGCGATCTGCACGGATGCTACACGAACCTGATGAACAAACTGGATACGATTGGATTCGACAAC
AAAAAAGACCTGCTTATCTCGGTGGGCGATTTGGTTGATCGTGGTGCAGAGAACGTTGAATGCCTGGAAT
TAATCACATTCCCCTGGTTCAGAGCTGTACGTGGAAACCATGAGCAAATGATGATTGATGGCTTATCAGA
GCGTGGAAACGTTAATCACTGGCTGCTTAATGGCGGTGGCTGGTTCTTTAATCTCGATTACGACAAAGAA
ATTCTGGCTAAAGCTCTTGCCCATAAAGCAGATGAACTTCCGTTAATCATCGAACTGGTGAGCAAAGATA
AAAAATATGTTATCTGCCACGCCGATTATCCCTTTGACGAATACGAGTTTGGAAAGCCAGTTGATCATCA
GCAGGTAATCTGGAACCGCGAACGAATCAGCCAACTCACAAAACGGGATCGTGAAAGAAATCAAAGGCGCG
GACACGTTCATCTTTGGTCATACGCCAGCAGTGAAACCACTCAAGTTTGCCAACCAAATGTATATCGATA
CCGGCGCAGTGTTCTGCGGAAACCTAACATTGATTCAGGTACAGGGAGAAGGCGCATGAGACTCGAAAGC
GTAGCTAAATTTCATTCGCCAAAAAGCCCGATGATGAGCGACTCACCACGGGCCACGGCTTCTGACTCTC
TTTCCGGTACTGATGTGATGGCTGCTATCGGGGATGGCGCAATCACAAGCCGGATTCGGTATGCGTGCATT
CTGCCGGTAAGCACGAACTCAGCCAGAACGACAAACAAAAGGCTATCAACTATCTGATGCAATTTGCACAC
AAGGTATCGGGGAAATACCGTGGTGTGGCAAAGCTTGAAGGAAATACTAAGGCAAAGGTACTGCAAGTGC
TCGCAACATTCGCTTATGCGGATTATTGCCGTAGTGCCGCGACGCCGGGGGCAAGATGCAGAGATTGCCA
TGGTACAGGCCGTGCGGTTGATATTGCCAAAACAGAGCTGTGGGGGAGAGTTGTCGAGAAAGAGTGCGGA
AGATGCAAAGGCGTCGGCTATTCAAGGATGCCAGCAAGCGCAGCATATCGCGCTGTGACGATGCTAATCC
CAAACCTTACCCAACCCACCCTGGTCACGCACTGTTAAGCCGCTGTATGACGCTCTGGTGGTGCAATGCCA
CAAAGAAGAGTCAATCGCAGACAACATTTTGAATGCGGTCACACGTTAGCAGCATGATTGCCACGGATGG
CAACATATTAACGGCATGATATTGACTTATTGAATAAAATTGGGTAAATTTGACTCAACGATGGGTTAAT
TCGCTCGTTGTGGTAGTGAGATGAAAAGAGGCGGCGCTTACTACCGATTCCGCCTAGTTGGTCACTTCGA
CGTATCGTCTGGAACTCCAACCATCGCAGGCAGAGAGGTCTGCAAAATGCAATCCCGAAACAGTTCGCAG
GTAATAGTTAGAGCCTGCATAACGGTTTCGGGATTTTTTATATCTGCACAACAGGTAAGAGCATTGAGTC
GATAATCGTGAAGAGTCGGCGAGCCTGGTTAGCCAGTGCTCTTTCCGTTGTGCTGAATTAAGCGAATACC
GGAAGCAGAACCGGATCACCAAATGCGTACAGGCGTCATCGCCGCCCAGCAACAGCACAACCCAAACTGA
GCCGTAGCCACTGTCTGTCCTGAATTCATTAGTAATAGTTACGTGCGGCCTTTTACACATGACCTTCGT
GAAAGCGGGTGGCAGGAGGTCGCGCTAACAACCTCCTGCCGTTTTGCCCGTGCATATCGGTCACGAACAA
ATCTGATTACTAAACACAGTAGCCTGGATTTGTTCTATCAGTAATCGACCTTATTCCTAATTAAATAGAG
CAAATCCCCTTATTGGGGGTAAGACATGAAGATGCCAGAAAAACATGACCTGTTGGCCGCCATTCTCGCG
GCAAAGGAACAAGGCATCGGGCACCTTGCGTTTGCAATGGCGTACCTTCGCGGCAGATATAATGGCG
GTGCGTTTACAAAAACAGTAATCGACGCAACGATGTGCGCCATTATCGCCTAGTTCATTCGTGACCTTCT
CGACTTCGCCGGACTAAGTAGCAATCTCGCTTATATAACGAGCGTGTTTATCGGCTACATCGGTACTGAC
TCGATTGGTTCGCTTATCAAACGCTTCGCTGCTAAAAAGCCGGAGTAGAAGATGGTAGAAATCAATAAT
CAACGTAAGGCGTTCCTCGATATGCTGGCGTGGTCGGAGGGAACTGATAACGGACGTCAGAAAACCAGAA
ATCATGGTTATGACGTCATTGTAGGCGGAGAGCTATTTACTTGATTACTCCGATCACCCTCGCAAACTTGT
CACGCTAAACCCAAAACTCAAATCAACAGGCGCCGGACGCTACCCAGCTTCTTTCCCGTTGGTGGGATGCC
TACCGCAAGCAGCTTGGCCTGAAAGACTTCTCTCCGAAAAGTCAGGACGCTGTGGCATTGCAGCAGATTA
AGGAGCGTGGCGCTTTACCTATGATTGATCGTGGTGATATCCGTCAGGCAATCGACCGTTGCAGCAATAT
CTGGGCTTCACTGCCGGGCGCTGGTTATGGTCAGTTCGAGCATAAGGCTGACAGCCTGATTGCAAAATTC
AAAGAAGCGGGCGGAACGGTCAGAGAGATTGATGTATGAGCAGAGTCACCGCGATTATCTCCGCTCTGGT
TATCTGCATCATCGTCTGCCTGTCATGGGCTGTTAATCATTACCGTGATAACGCCGTGATAACCTACAAAGCC
CAGCGCGACAAAAATGCCAGAGAACTGAAGCTGGCGAACGCGGCCAATTACTGACATGCAGATGCGTCAGC
GTGATGTTGCTGCGCTCGATGCAAAATACACGAAGGAGTTAGCTGATGCTAAAGCTGAAAATGATGCTCT
GCGTGATGATGTTGCCGCTGGTCGTCGTCGGTTGCACATCAAAGCAGTCTGTCAGTCAGTGCGTGAAGCC
ACCACCGCCTCCGGCGTGGATAATGCAGCCTCCCCCCGACTGGCAGACACCGCTGAACGGGATTATTTCA
```

FIG. 10K. Continuation of (CJLB-4 [organism=Campylobacter phage CJLB-4] partial genome)

```
CCCTCAGAGAGAGGCTGATCACTATGCAAAAACAACTGGAAGGAACCCAGAAGTATATTAATGAGCAGTG
CAGATAGAGTTGCCCATATCGATGGGCAACTCATGCAATTATTGTGAGCAATACACACGCGCTTCCAGCG
GAGTATAAATGCCTAAAGTAATAAAACCGAGCAATCCATTTACGAATGTTTGCTGGGTTTCTGTTTTAAC
AACATTTCTGCGCCGGCCACAAATTTTGGCTGCATCGACAGTTTTCTTCTGCCCAATTCCAGAAACGAAG
AAATGATGGGTGATGGTTTCCTTTGGTGCTACTGCTGCCGGTTTGTTTTGAACAGTAAACGTCTGTTGAG
CACATCCTGTAATAAGCAGGGCCAGCGCAGTAGCGAGTAGCATTTTTTTCATGGTGTTATTCCCGATGCT
TTTTGAAGTTCGCAGAATCGTATGTGTAGAAAATTAAACAAACCCTAAACAATGAGTTGAAATTTCATAT
TGTTAATATTTATTAATGTATGTCAGGTGCGATGAATCGTCATTGTATTCCCGGATTAACTATGTCCACA
GCCCTGACGGGGAACTTCTCTGCGGGAGTGTCCGGGAATAATTAAAACGATGCACACAGGGTTTAGCGCG
TACACGTATTGCATTATGCCAACGCCCCGGTGCTGACACGGAAGAAACCGACGTTATGATTTAGCGTGG
AAAGATTTGTGTAGTGTTCTGAATGCTCTCAGTAAATAGTAATGAATTATCAAAGGTATAGTAATATCTT
TTATGTTCATGGATATTTGTAACCCATCGGAAAACTCCTGCTTTAGCAAGATTTTCCCTGTATTGCTGAA
ATGTGATTTCTCTTGATTTCAACCTATCATAGGACGTTTCTATAAGATGCGTGTTTCTTGAGAATTTAAC
ATTTACAACCTTTTTAAGTCCTTTTATTAACACGGTGTTATCGTTTTCTAACACGATGTGAATATTATCT
GTGGCTAGATAGTAAATATAATGTGAGACGTTGTGACGTTTTAGTTCAGAATAAAACAATTCACAGTCTA
AATCTTTTCGCACTTGATCGAATATTTCTTTAAAAATGGCAACCTGAGCCATTGGTAAAACCTTCCATGT
GATACGAGGGCGCGTAGTTTGCATTATCGTTTTTATCGTTTCAATCTGGTCTGACCTCCTTGTGTTTTGT
TGATGATTTATGTCAAATATTAGGAATGTTTTCACTTAATAGTATTGGTTGCGTAACAAAGTGCGGTCCT
GCTGGCATTCTGGAGGGAAATACAACCGACAGATGTATGTAAGGCCAACGTGCTCAAATCTTCATACAGA
AAGATTTGAAGTAATATTTTAACCGCTAGATGAAGAGCAAGCGCATGGAGCGACAAAATGAATAAAGAAC
AATCTGCTGATGATCCCTCCGTGGATCTGATTCGTGTAAAAAATATGCTTAATAGCACCATTTCTATGAG
TTACCCTGATGTTGTAATTGCATGTATAGAACATAAGGTGTCTCTGGAAGCATTCAGAGCAATTGAGGCA
GCGTTGGTGAAGCACGATAATAATATGAAGGATTATTCCCTGGTGGTTGACTGATCACCATAACTGCTAA
TCATTCAAACTATTTAGTCTGTGACAGAGCCAACACGCAGTCTGTCACTGTCAGGAAAGTGGTAAAACTG
CAACTCAATTACTGCAATGCCCTCGTAATTAAGTGAATTTACAATATCGTCCTGTTCGGAGGGAAGAACG
CGGGATGTTCATTCTTCATCACTTTTAATTGATGTATATGCTCTCTTTTCTGACGTTAGTCTCCGACGGC
AGGCTTCAATGACCCAGGCTGAGAAATTCCCGGACCCTTTTTGCTCAAGAGCGATGTTAATTTGTTCAAT
CATTTGGTTAGGAAAGCGGATGTTGCGGGTTGTTGTTCTGCGGGTTCTGTTCTTCGTTGACATGAGGTTG
CCCCGTATTCAGTGTCGCTGATTTGTATTGTCTGAAGTTGTTTTTACGTTAAGTTGATGCAGATCAATTA
ATACGATACCTGCGTCATAATTGATTATTTGACGTGGTTTGATGGCCTCCACGCACGTTGT
```

FIG. 11A. (CJLB-5 [organism=Campylobacter phage CJLB-5] partial genome)

```
AGTCGAGTTCTACCTCAAGGATAGCTTGCTTTTTGCTCCACTATCTAAACAATTATATCCGTCAGTTTTG
ACTGGTACTGAGACAGGCGATAACTGGATACGCAAGGACATGGAAGTCGATACAGATAGCGAAGAAGTGC
TTATCTCCACGGCCTTGCGTAATCTACGTAAATATTGCTATCCAGCTATCACATACGAAGCAGATGGATA
TTTTGATTTAGATATCGGAGACACTGTCAAATCCAAGACACAGGCTTTAGTCCTATGTTGGTGCTGGAA
GCTCGTGTCAGTGAGCAACAAATCAGCTTTACTAATCCAAGCGAAAACAAGACGGTCTTTGCAAACTTTC
AAGCTCTTCAAAACAAGGTATCAGATAGCTTGCTAACTCGCATGGCTAAGCTGGCAGAGCAAGCGATACC
GTATGAGCTGAAATTATCCACAGACCAAGGAACGACCTTTAAAAATAGCACAGGGCAAAGCTTGCTCATG
GCTACACTAGAAAAGAATGGCAAGGTGTACGAGCCAATCATCTTCTACAAGAAAGGCGACTCTATCATCG
GCAGCGGTAGTCAAATGCTTGTGCGTGCGACAGACTTTGAGGGTACTCTGCAAGTAACGGTTGAAGCCTA
TCTAAATGACGAGAAAGTGGCAACAGCAGAAGTGACTTTTAGCAACGTGGCTGACGGTCAAGCCGGTGCG
AAAGGTGACAAAGGCGACCCTGGCGCACAAGGTCCTCCCGGCCCTAAAGGCGATAAAGGAGCGCTCGACG
AGGAGCAACTCAAACAAGTCAATGACAAGATTGACAGCAAGGCCGACAACAAGCTAACTGCAGAGCAACT
AAACGCTTTAACAGAAGCCATGCAACTAGCTAAGGCGGAGTTAGAAGCCAAAGCAAGCATTGACACAGTC
AACGAATGGATAAAATCCTATCAAGACTATGTCAAAGCAGACGAAGCTGGACGAGCTGCGGCAGAAGCTA
AACTTGTATCTGCAAGTCAGAGATTAACCAAGATTGAGAATAATCTGGGCGACATGGCTGAAAGATGGAG
CTTCTTAGACCTCTACATGAGCGCTAGCAATGACAGGTTTGATATCGGTAAGAAAGATGGATCATCTTCT
GTCCGTATCGACCACGACCGCATCAGCTTTTACTCTGCAGGCTCTGAGGTGGCTTATATCTCGCAAGGTG
TCCTCAAGATTGAGAACGGGGTGTTCACTCGAACACTTCAAATTGGACGCTTTAGAGAAGAACAGTATAA
TCTCAATCCAGATATGAATGTAATCCGATATGTAGGGGGAGGTGCTTAAACATGGTCAGATCAATTTTTA
ATGGTGTATATGGTCATAACCTGCAATTAGAAGTCGTTTCGGATGGATATAGACAGGACATAGCCGGTAA
CTTCTCCGTCATCAATGTGCAAGTTAGACTCATATCTAATGGATATGCTGCTATTTATGGCGGAGCGAAT
AAGACACTGACTGTTAATGTCGGAGGAGAGTCAAAGAGCTTTTCGGTAGATGCAGCTATCAGCCAAAATC
AAAATAAGTTGATTTTTAGCAATGATTTTTAGAGTTCCGCACGAACAGGACGGCACTAAATCCGTTAACGT
TTCGGCAAGACTAGACATCAATGTCGGTGGCTATGGTTGGGCTATGGCCGATTTGACTAAACGGCTGCCA
GACATACCAAGAGCAAGCTCTGGGAATGATGTGACAGCCGTTATTGGTCAACCAGCGACAATTAACATTA
ATCGCAAGAATGACGCTTTTAAACACGCCGTATGGGCAACCTATGGCAGTTTTAATAAGCAGATAACGAC
TGCTAATGTTGATACCAGCTTTTCTTGGACACCGCCACTAGAGCTATGCGAACAGACGCCAAATAGCGCT
AGCGGCTTTGGTAATATAACCATTATCACTTACGACGGAAGCAGAGAGATTGGGCGTGATGTGAAGCGTC
TTAATCTCTCCATCCCAGATAGTGTCAAGCCGACTCTGACAGGTTTCACTCTCACAGACGGCAATACAAT
AGCGACTAATATCGTTTCTGGCGGTGAGCACTTCATCAAGATTTTGTCTGACATCAGAGTTAATTTTGGT
GCAGCTTCTGGGGTTTATGGCTCTACTATCACAGGCTATTATGCGGAAATTGTCGGCAAAATCAGTCCA
CGACAACCAACGGTGGTGGCCTTGGTTTGATGAACTATGACGGCCAAGTTGTTATCAGAGCCAGAGTGAC
AGATAGCCGAGGGCGGACGAGCAATGCGATAGAGCGTACAGTGACTATCCTTGACTACTTCCCGCCAATC
CTAAAATTTGATGTATCCAGAACCGGTCTGAACGGCGGAACATTGACGATTACACGGACAGCCAAGTCG
CTCCGCTAATTGTCAATGGATCGCAAAAGAACAAAATGACGCTGACATTCAAGGTCAAGCCCCTTTCGGA
CAATAGCTACACATCAGACACAGGTCCTGCCGCTGGCTCTTGGTCGAGCATATCAGAACTCGTTAACAGT
CCAGCGAACCTATCCGGCCAGTATCCGGCTGATAAGAGTTGGGAGGTTGTTGGCAGACTTGAGGATAAAG
TGACAAGCGCAGAATTTGTCGTAGTCATTACGACAGAGGGCGCAGTCATTCTTACAGTCGTTTTGGTGT
TGGCATTAATAAAATCTGGGAGCGTGGGGCGCTTGACGTCAAAGCGACATCTATGCGAATGATAAACTC
ATTCAAATGCACCAGTTGACGCAGAAGAACGGTACTGCCATCTATGCTTATGGTAAAGATTTTGACCAAG
AGCGGACAACAGGTGTCTATTTCAAGAATGGTACAGAAAACAACAATCCGGCTCGTCAATACGGCTGGCT
GTTGGTACTTAACAGTAACAACGAGTGCTTCCAGATGTTCTTTCCGTCCATAGCAACAGCAGAGCCAGCT
AAGCGTGTCCTGCTAGCCGGTAAGTGGAGCGCATGGTCAACCAATGCAAGGAGTGACCACGCCAACCTAA
AACGCACAGAATGGACTTCTACAGGTACTACAGGCGTGTACTACAAGCGCCAGGGAGATATCGTGTCGCT
TAGGATTGAGATAAGAGATGTCACAGGGAATGTTAGTCTTGGACGCATACCAAACGAACTGACCCCAATT
CAAGGTAACGCCGCCATGTTAAATGTGCCGGTTTTCGAGGGTGGATCAAGTAACGACAGGCATTTACAAA
TTAACCCTGACGGAGGTATGACTTTGCTTGCAAGTAATGATAAATACATTGGGACGCAGATAAACTGGTC
TATTTAATCAAAGAAAAGGAGATATATGTCTAAATTACAATTTAATCGCAAGAGTTGGATTTACTCTTCA
TCCAACAACGAAGTAGAGGGTACCCATGTCATTCTGACAAATGCAGAGGGTGCTTTCTATCCAGTATTGC
TTCCTAAAGAAGCGATTGACCTTCCAGTCGAAGAACTGGAAAAGCAAGCCCTTGAAGTCGTCTATCAAGA
GAATTTCCCAGACCGTGCTAAGAAAGAACAGGACGAGGAAATCAAGAAGAAATTCCAAGAAGCCGACAAG
AAAGAGCAAGAAGCTACTCTGCAGCGTGCAGAACTGAAAATTACTCGAGCTTGTCACTTACATCGCTC
TTGGTATTTCTGGTGGTCTGGACATCAACAGCTACACAGCACTAGCGCAGAAGATTGATGCACCAGTAAA
CGGCAAGCGGTACACAGGACCAACGTTTGTCACTATCGATTATCCGTACACAACCAATCCGAAGTGGCAG
AAAGGAAATCGAACAATCGTGAAATACACGGGCGCTACTGGTTATACCTACACCGGCCAGTCTGCTGAAG
ATATGCTTAAGTCTGGTCATGGACTATCGTGCTGCCAAATATCAGTAACTAATTAGAAAGGGGGTGATT
ATTATTTGAAACCAGAGTACCAGCTTTTAATGACCGTGGGCGGATTTATTATCACAGTCTACGGTTTTTA
CAATGTTCTGCGTGCGAAAAGCATTGAGCAAGCAACCAAAATCAATTCATTGGAATTGCGCTTGGGCTTT
TTGGAGCAGCAGACGAAAGACCATACACGTCGCTTGGACGACCACGACAAGCAGAACCAAGCTCTCGTCG
CTATGACAGAGCAAATCAAGAATTTGACAGAAGATGTCAAAGAACTCAAAATCATGATCGAAAAGAAAGG
AAGTTAAATCATGAACAAATTTGCAAAAAACTCGCTATCAAAGTAATCAAGACTATGGCTCAAGCAGCG
CTTGGTGTCATTGGCTCATCCGCCCTGCTGACAGAAGTCAACTGGGTAGTAGTTGCATCAACAGTCGGGC
TTGCAGGTCTGACATGTATCTTGATGAACTTGTCTGAACTAAAAGAAGACTAATAAGGGGTGGTCTTTT
GACGACTCAAAAACAACTACTTGATAAGCTGGAAAGTGTAGTAAATCAGCGCATGGAAGTGCCTACCAAT
CCTTATGGTGGGCAATGTGTTGCTTTGATTGATAACATTTTGCAGTATCAAGGGCTATACAAGCTTAATT
TTAGCTATGTAAACGCAATAGATTGCTTAGACCAGGCAGCAAGTCTCGGTCTAAAAGTAACACGCTTTAA
CGGCTCAAATAGGCCGCCTATCGGTTCTGTATGGGTATCAAATTGCTGGCCATATCACGAGTTCGGACAT
```

FIG. 11B. Continuation of (CJLB-5 [organism=Campylobacter phage CJLB-5] partial genome)

```
ATCGGCTTTGTGGTTGGTTACACTGCGGATGGTGGAATTATCACCATCGAGCAGAACATCGACGGCAATG
CCGACGCTCTATACAACGGCGGATGGACACGCAAGGTTATTCGCAATCTATCAAGCGACGGCACATTTAG
CTATGTTAATTGGCAAGCGCCAGCGCAGCAAATGGTTGGCTGGTTTGAGCTGCCATTTGATGCACCAAAA
GCAGATATTGTAATCAAAAACTTGGAGGATTTAAAACTAATGAAAGAATTTATTGTAACTAGCAAAAAAT
ATGGATACGGAGTTTTTGTAGGCGGGAAATACGTTGGATTGTCCGACATCAAGTCAGTAAACAGCATGAA
AGATAGATTAGGTTTCGCTATCGTTGAGCTGGGAGATGATGACTTCCTTCGCTTTTCAAAAGCTCACGGA
TAAGAACAGAAAGGAGCTTGCTCCTTTATAAGACACTTTTAAATAATACACCGCCTCGGCCTATTGGTCG
GGGCTTTTTGTTTGCTTCAAGGGGCAAAAAGGGGGCATAAGTTTAAAACTTTTGTATTTTTATGACAAA
AAATATAGATAGTTTTATCTCTTTATACGCTTATTTAATGCGTTTTAACGCTATTCTATCTTTTTAGATG
AACAGCGAGACACACCCGTACAGTACGTTAATAAGAATTTAAAAACCTTGCTATATCAATGTTTCGGCGT
TGTTGGCAAGGTTTTTATTTGTTATAAGGGGCAAGCAAGGGGCAAAAAATCTATTTTCGACTATTGGCAA
TATTGTCTAAAATATTCTCTATATTGGATTTCATGCTCTTTGTTACATGGGTATAGATTTGCATCGTAGT
ATTCGAGTCTTTATGCCCGACTCTTGCCATGATAGCTTTTACTGGTACATTTCTTTCGGCAAGCATGCTG
ATTAGTGTATGCCTAAAGATGTGGGAGCTGAGGGGCTTATTAATCGGCTTATCCAATCTCTGATTAGCTT
TCTGCAGGGTAATGTTAAAAGCGTTTCTTTGTATCGGCTTCCCATGGTTATTGAGGAAGATATAATCTGT
ATCAGAGAGTTCAGGGTTCGTACTAGTGGCTAGTTCATTTAGCTCGATAAACTCATCGATGATCTCAATT
TCACGGTTGGTAAGATTAGTCGTGCGGTAGCTTGATATAGTTTTCGTCAGTTCTTTCTTGGCGTTTCTGT
CAATACTGTCTAGTGTGCCGTGTATATCAAGCTCTCTGCTTTCTTTGCGGTAATTGTGTCTTTCGATAGC
TACAGCTTCACCGATGCGGCAGCCATTCAAAGACATAAATTCAGCCAATAGCCCCGCTCTGTATGTTCTA
GTGTTTTATATAATTCTTTCAAGAGTGAGTTTAGTTCTTCTGGCTCTAGGTATTTCTCAGTGACTGATT
GCATATTTTCCAGCGTCAATACACGTTTAGGAAGAGTAGTAGCCCTGGCAGGATTGTCAGTTATGATCCT
TAGCTCTTGAGCATAATCAAACACTCCGTTTAAGACAACTTTGATATGGTTTAGTTGAGAAGCTGTGTAG
TTGGAATTAGCAATATATCTCTTAATATAAGCGACATCGATATTGCGGATTGGAACATTAGGAGCAAAGT
TATTAGATAGTCTTTTGTATGCTGGTGTACGAGCACGGACACTAGACCGCCTGACTTCCTTTTGGTAAAA
TGTCCACCATTCTTCCAGGACATCGGCAAACAGCCTGTCTGATGTCGTGAGCTTCTGGAGAACATTCTCA
ATCTTTTCATCTAAAATCTTCTGAGCTTCTTTTTTAGCTCGGCTAGAGCTGCTATCTAGTGTGACTGAAA
CTCTGCGCCATTTTTCAGTATATGGATCTTTGTATCTTTCGAAAAATTTATATTTCCCGTTTTCTAATTT
CTCTATCCACATTGTTTTTTCTCCTCATTTTTGGTAAAATGAGTACAAGAAAACGACCTTTTGAATGGTT
GTTTCTTATACAGGATTTCCCTACATTCAAGCTTGCCGGCCGAGAATGTGGGGATTTTTTTATTTCTCT
AATAAAATTTCTATCTTCTGTTTCAAATCTTCCAGCTCAATCATTTCACTATTGGCTGTGCTTATGTAAT
AGTCTATATCTTGTTTGGCTTCTCTTTTTCCATCAGGATGGCCATATTGGTTTAAGTAATCAATCATCCG
CTTATAAAAGCGATACTATCTCGCAGATAATTTTCTTTCATCCTGTAGTAATCTATCTCAGATCTAGTC
TTGTCCCAAGTCGGGAAGTCAATATCTAAGTTAGTAGGAAAGCCTTTAAAAGAGTGAATTTCCCACAGCG
TGGCATATTTATCATAAAATTCTTGCCCGGCTGCTGTAAGTTTTGTTTTTTCACCCAAATCTTCTAGATA
TCCCTCGGCCTTGAGCTTTCTGGTTACCTTTTCAGCATTAAGATTATACTGGCTAAAGAAGTATTTGGGG
ATTGCTGTAGACGACTTACGCCCTTGCTTAGTCTTCCCCCACCAAACGAGCAGCAACCACTCTCTAAGCT
TGTGACCGTCGCCTGTCTTAAAACTGTCATTGTAAGCTGGCAAATCAAAACTGCGGCCGTAATAATCTAC
CAGACTAGGACGAGTAATCAAAATATCGTAATAGTCTTCAGAGAAGCTAGATTTATCTCTCACAACCAAA
TCAACCCTTGCATTATTTTCTTTCCAAATAGAGCGCTAAAAATCCCCATAAATTTGAACCTCCTAAAGAC
CTCCGGCAAACTTTAGATACTCGCCTTGTATCATGAGTTCGTCCGTGGTCGTTTTAAATTATATTTTT
AGCAAAATTAGACCAGTTAAATGCTGCTGGGTCATCATAGCTGGCCAGCTCTTCCTGGACCAGATGGCGG
ATCATGAAACGATTAGCTTCATTCTCGCAGCGCATAGCAGAGTGACGATATATAGAGCCGATATGCTCTA
AGTGCCCTAATTCGTGTAGCAGTACTCTGTGACGCTCTGCAGGCGATAAGGAGCTGTTTAAGAAAATAGT
CCTTGTCTCTGCGTCATAGAAACCACGCCCAGCCCATTGGTCTGGCTCGAAAGTATAAAGTGATACCTCA
TACTGCTCCAACAGTTCTTTTCTTTATCCATAATCTCCCTCACCTAAACTTATTTCTTGCTATTGAGGT
AGCCCTCTATGATACCCTTAATAGCTCGCTTGTCGTCATTGGACAATGGCTTGCCATCAAACAGCATAAT
GCGACCGTCCAAGTCGTCAAGTTCTATTTCATGCTCTGGAGCTTTTTCTCCTGCGATAGCTGGGTTATCT
GTCCGACCTAGTAAGTAGTCGGTAGATACTCCGAAATAATCTGCCACTTGATTTAATTTTTTGGTTTCG
GTTCACTACTTTTCCAAGAATACAAGGAATTTCTGCTAAAACCGATTTTTCTTCAAGAGCATTTATAGA
TAACCCTCTCTTTTGGGCTAGCTCTTTAATTATTTCAAACGTCGGAAACATTGTCACATCAGCCTTTCTA
AGACATGACAAAAAATATTTTAAAAAGTTCTATAAAAATGCTTGACATTTTTTAAAGAGTTTTGTAAAAT
AGTTTTTGTAAGTTAAAGATTTAGTAAAAAACCTTGTAAAAACTTATCTAAAAATAAAATAGCTTTGGCG
AGCGCATTGAATTGATAGATATAACGTTTTATCAAGCCTTTTAATCATGCCTACATTTTAAAACTTTCTT
TAAAATTTGTCAAGCATTTTTATAAAATAATTTACTATTTCTTTAACTTTCTAATTAAGAAAGGAGTTTC
GCTAATGAAACCAAGACGCTATCCGTATACAGGGAGATTGAAAAAACCAGCCAGACTTATGATAAAAGAG
TGGCAACAACATTACGACAATTATTTGCAAACGGTCGGACGATACAAAAAAACCGGCTCAAACATCAAAC
CTGAAGAAATTCCAGGTTATCAAGAGCCAGTTTTTAAATTCGATCGCAAAAGATTAAATGCTATCGAATT
CAAAAGTGACGGATTAACCATTAATCGAATCTAACGATTGTTCGGTCTGGCAGCTTATCAAGAATAGGCT
GACGATTAGACCAGATGGTTCTTCGCTTGACATAACAAGCAAAACTAATCCGTTTCAAAAGTCCGGAC
CATGTACTCTATCTCATTAGAGTTTGCTCCGAAAAGAAAAGTATCAGAAGTTTTTGAGCCGTACTTAATA
TCAAAAACTTCTTCGTCAGGAATGACGATTTTATATTTTGCAATTTTTTCATTCATCATAATCACCTCCC
TTCGAGATGATTATAGCACAAAAAAGCACCTCTGGGTGACGCGTTACAAAAAATTCTGACTAAATTAT
ATCACAAATGAAAGGAAAAGTAAATGCAAGAGATAGCATTATCTGACAATTTAGCGCAGATTGAGCTAGA
AATCAATCACCACAAGCAACTTGCCGGTCAGTCAATTTGGGAAATCGGCAGACGGCTTAATCATGTTAAG
GAGCATGACTTGGCTCATGGCGAGTTTAGAGACTGGCACGAAAGACTTGGCCTTGACAAAGACTTTGCTT
ATAAGTCAATGAAAATCGCTAAAGAATTGCCAAATGTCGAAACGTTACGACATTTAGGAACAACAGCATT
```

FIG. 11C. Continuation of (CJLB-5 [organism=Campylobacter phage CJLB-5] partial genome)

```
GCATCTTATCGCAACCTTGCCAGATGAAAACAAGCAAGAGCAGATTGAACGGATTGAGCAAGGCGACAAT
CCAACAGTCAGAGAGCTGCAAGAAGTAAAGCGCCAACTCAACCTCGCACGAAGCGCAAACGACAGCTTGC
GAGAGCAAAACGAGCGCTTAGCAGAACAAGCCTTGAAAGGTCTTGAAACCAAGACGATTGAAAAGGAAGT
CGTCAAAGAAATCGAAGTCGCACCAGCAGACTACGACGCTACAAAGTCGCTAAATGCCACGCTGCTAGAA
AAGAATAGCAAACTAAAGCGTGAATACGATGACTTAAACGACCGAGCAGCGTTTATCGAGCAGCAATATA
ACAAGCTTGTAGAAGAACGCAAGGCAGTTGACGAAAAGTCTGCTAAGTATGACGAGCTGACAGAAGCAAT
CAAGCAGTCACAAGGGCAGCTAAACGAAGCACAAGCGAAAATCGGCAGCTACAAGAGCCTGCTATCGTTT
ATCCGCAAGGGTAACGAAATGGTCGTGAACATGGGCGGTCTGGTCTATGTGGACGAACAACGGATATTAC
ATTCTGACAGCAAAGTCAGAAACGAATTTGAACAGTTGCAAAAAGCAATCAGCAGACTTGCCGAGGATAT
GGGAAGTATGCTCAAGGAAACAGAAGTATTAGAAGGAGAAATTATATGACAAACGAAATCATTGCAAAAA
GCGCAAGCAGCGAACAATCACTATCAGAAATCAGCGTAATGCGGAAAATGCTAGATAGCATTGAAAATCA
CGAGCACCGTATCACTAATCTCGAGGACACCATGCGAGTTAACGCAGTACAAGAAAACATGCTGACAGAA
GAAGTCAACAAGAAGATTGTCGGTTTCTTGCAAGGAAAGAAAGCCCCTGCTTATCGTGATAATCATATCC
GGGGCAAGGCATACTCGGACATCAATCATGCAATCCGTAAACATTTTGGAGTTCGCCGACGTGAAATTCC
TGCTAAGAACTTCCACGATGCTGTATCGTTCATTCGTCGCTGGTCTATCAGTCCAGAGCTGAAAGATGAA
ATTTTCAATGCAAATCAGCAAGTGTCACTATTCAATTAAGGAGAAAACATGAGTCAACAACACAAAAAAT
GGATTGAGTTGGTTAAGCGTCGACTTGGTGAAAAAGGTTGGAGTCAGTCGGACCTGGCGACAGTTATCGG
AGTAAAGCCGGCTACAATAAACCGCCTAATCAAAGAAGGGCATGGAAGCGATAGTCTGAAGCTTGAGATC
ACTAAAAAGCTATCTATATCTGATAGTTGGACCGTCTTTGAAGAAAGGTAGGGGAGAAGATGCCGCAGGT
AAAGATAAAAGAAATCATCTACACACCAGTCAGCGGGATGGAAGAACCGACAGGCGGAGATTATGATCAT
CTAATGCAAAGGTGGCAAGGGCTAACACTTCCGACGGCAAAACAATTTGTCAAAGAAATGCGAGAAAATC
CAGAATTTGAGCAATATGTCTTCAACCCAACGCACAAGCTGATGTTTGTAGACTATGAGGGTTTTCGCAA
GTTCTGGAAGTGGAAGCAACTCAACCGCTACCGTGCTAAAAAAATAAGCCTTGCCGAGATAGAGTCGGAC
AAGGCACTAGCGAAGCGATTAGGCTTCTAAAAAGTATTTGCTTAATTATATCACACAACGAGGAGAAAAA
ACAATGGAACCAACATTAGGAAGTCAACTTTTAGGCGTAACATTAATAGCCGCTATCGCATTTGTAGCAG
GCTGGTACGGCAATAGAATGGACGCTCGTAAGCGTGCAAAAAAAGAGCGTCTGGAGCGCATGCAAGCCGA
ACTGATGGAACAGTATCACGAAGACTTGGAGCTGTACCACATGGAACACGACAAGCGGAAATTGCTGCT
TTGGCAATGGCTAGAAAAGGTATCACGCCAGCGTTTGAATATTAGGAGGGGAAAATAATGAAAAAAGGAA
TTAAATTATCAGTGGTAGGACTAACAGCTGTAGCAGGCTTGCTAATCAGCACAAATGTATTGGCAAGTGA
AGTTGCTAAGGACGGAAACCAAATTCAGATCACAGAGCCTGAAATCACATACAGCTCAGAAGCGGCTGAA
ACCTATGTAAACAAAGACCTGACATATCACACGGAAATCCCTGACGAGGTAGAAATTAACGAAGGTGATA
CACTCACCTACACTCTACCTGAGCAGTTGCAGTGGACTACTACACAGGAATTTGATGTGACTAGCCCTGA
GGGAGAGGTAGTTGGACGAGCAGTAGCCTCTAATGACACACAAGCTGTTACTACCACCTTTAACAGCTAC
TTTGCAGAGCACCCGCTTAACAAGAGCTTTGACATGACGCTCAAGACCATGTGGAAGAAAGAGGTAGTCA
CAGAGCGTGAAAAGTATGACCTCAATTTCAACGGCACTATTGTTAAGCAGGCAGAAGTTAAGCCTCAGAC
ACCTGCAAACTCACAGGAAATTGTGGCTAAATGGGCTGGCAAGACAAAGATGACCCTTCCCTTGTGCAA
TGGGGAGGACGAGTGAACTTTGTGAAACACCACCTCACAGATGTAAATGTCTCAGATACATGGGACGACA
ATAACGAGTACGTAGAGGGCTCTATGCGTATCTTTGAGCTCTCATCAGCAGAGCCTTGGGTCGGTATTCG
TGAAATCCCTCTCTCAGAGGTTGGTGTTCAATTCTACAAGAATGGTTTTAAGTTCAGCTTGCCTGATGTT
AAGAATATTATCAGTGTGGAGTACAAAACACGCTTAAAGAACAAGCTACAAAACCCTGTGAATGTGCTGA
GCTTTACAGCTATGGGTCAAGAATACTCATTTGAACGGGAAATCACAGTGGCTAACGCTACAGGAACAGC
TAAAGGCAAGGTACGCCCATTCACTTACGATGTACCACCAGCTCCTGTGTATGATATTCCGGAGTTTGAG
GGAGGTGTAGTCCCTAATGACCCACCAGTATTGGATAAACCAGAGCTTAATATCAATGATATTGAGCAAA
CGCCACCAGCACCAGTATTTGAGCTTCCTGAGTGGCAAGGAGGAACTACACCGCTTGACCCTCCTACAGT
AGACAAACCTGAGTTGGAACGGAGGGGGAGTGCCAAACGATCCGCCTGTGTTAGACTTGCCAGAGTTAGTA
ATTCCATACGAGCCTAAAAAGCCAGAATTACCGCCTAAAACGCTCGAAAAAGAGCCGCCTGCTCCAAGTG
CCAAGGAAGAACCGAAAAATGCAGTAGAGAGCAAATTAGAGACCTCTGCGAACGGGCTGCCGAAGACGGG
AGAAGTCAGTAATGTCTTTCTGTCAATCTTCGGTATTTCACTACTGATTAGCGGAGCGATGATTTGGCAC
GATAACAAGAAAAGTAAGGAGGAGATTGAAATAGCAAATCCAAAAAATAGGCGCTTCTATTGGTTGCAG
CTGTCCGAGGAGTTTTTCAAATCGAAAGAAATGAAGCTCTCTCAGGAGGCGCTTCCAGGAGGCGAAGAGCACA
CGATCATCTATCTCAAACTCATGCTAGCAAGTCTGCAAGACAACGGAAATATCTATTTTGAGGGATTGGC
TGACAGTCTGGCAGAAGAAATGGCTCTTATTATCGATGAAGATGCTGAAGCGGTCAGAATGACACTGATG
TTCCTGGAGCAAAAAAAGCTATTAACGACATCAGACAATTTTGCTTATAAGCTGGAACAAGTACCAGAGA
TGATAGGCAGCGAAACCGCAAGCGCCCGTAGGGTTCGCAAGCACCGAGTCAAACAAAAGTGTTACAATG
CAACACCGGTGTAACAAAGTGTAACGGAGAGATAGATATAGAGTTAGATAAAGAGATAGAAATAGATAAA
GATATAAATATAGAGTCAGAAGTAGAGATAGAGAAAGAAAATGAAAATGAAAATCTAACTGCTGCTGAAA
TTGCTCAATACTATCAATCCAGAATAGGAGTCCTTGACGGCGTACAGTATCAGAAATTGATTGAGTACCA
TACTTTTGACCACTTGGAACTTGAGCTTATCAAGCGAGCCATTGACAAATCGGCTGATAATGCGGTTAGA
AACTTTGGATATGTCAATTGCATCCTGAAAAACTGGGCGCAGAACGGCATCAAAACGATTGCCCAGCAGG
ATGAAGACCAGAGGCGATATCTGGAAAAGAAAGGCATCTATAAGCCGGACTCTAATATCCCTGAATGGTC
GAAAGAACATCCCAATTACCAAGCGCCTGAAGAGCCAACGATACTATCAAGAGAGGGTTCTTAGCACAA
GATGACTAAAATTAACTACGATCAAGTCGCAGGGAATGAATCTCTGTATAAGCAGTATAAGAACACTTTT
GCTAAATGGTTCAACATGCAGCTATCCAGAAAGCAATATGTGGAATTTGTGGACGTGTGTCGAGAACATG
CGAACATGCACCTCAATCCGTTTAGCATGTGCGCCTACATTCTCAAAAGGCCAGTAGGAGAAATTGTGAC
TAGATTTTTCAAAAAGGAGATAAAACATGACAATACCAGAACTTGAAACAGCTCTACTGTATCATGTAA
CGCCAAATGAGCGCAAACGCCTGAAGTGGTACAAGAAACATGACGTAGTGAAGTTTGTTAAGGAGTTAGG
```

FIG. 11D. Continuation of (CJLB-5 [organism=Campylobacter phage CJLB-5] partial genome)

```
AAAACTTTGGCGAAAATACAAGGGAGAAGAAAATGGATAAATTACACAAACGAATTTTACAAGCCATTCC
TGTAGGAAGTGATCGGCCGAGACCACGGCGGGAAATTGAACAAATGCTCGGCCTGAGCAAGCGATCTGTA
GAAAAGGCTATTGAACGACTGATATATCGAGATGGTATTCCTATCGTGGCAATCAAACAAGCCGGGCACA
ATGGCTATTATCTACCAAGGAATGAAGAAGAGCGCCAGGAAGGTCTGCAGGCTTACAAAGGTCAAATAAG
GACCTCGCAACGCCGAGTATCAAAAGTTGAGTCAGTTGACTTGGTGAAGTTCCACCAGGCACTAAAGGAG
GGGGTCTATGCTCGAACCGTTTGATTATGACCGCTGGTTGACGACACCACCTGAAGAAAAAACGGAGCGT
CCGGATCCCGACAATTGGATTTATAGAGCTGGACGGTGGGTGTATGTGGGGGACGAAGTATGACAGCATA
CCTACTGAAAGAAATTGATCGCTGGCGCTCTGAGTATATTCACCTCGGCCATGAACTGGGCGAAGTTATC
AACGAGCAGCAAGATAGAATCTTGGCACTGAGCCAAGAAAACAAGCGTCTTAGGCGTGAAAATTGGAATT
TGAAACAGACAAAAAGGAGAAAATAGAATGACTAATGAAATATCGACACAAAAGAGTACAACAAAAGTCAGAGCGATT
CAATCAATACAATGGACTGGACAGCCCAAGACATCAAACAGTATTTTGACCCAGACAACCTTTTGACACC
GAAACAAGTTGGGATGGCGTTGTCGCTCATTAAAGGGCGAGATTTAAATCCGTTAGCCAACGAGGTTTAC
ATTGTCGCCTACCGTAAAAGAACGGCGGAACAGAGTTTAGCTTGATTGTATCAAAAGAAGCTTTCCTAA
AACGAGCAAATCGCAATCCGCAGCTTGAAGGCTTTGAAGCTGGAATTGTTGTAATTAACGAAAGCGGTTT
GCAAGTGGAAAGAAAAGGTGCACTCGTTCTACCTAATGACGAACTTGTCGGTGGATGGGCTAGAGTTTAT
CGAAAAGATTTTCGTGTGCCGGTTGAAGTCTATGTCGGCAGAGGAGTACAACAAAAGTCAGAGCCATT
GGAACTCAATGCCGGCTACTATGATACGGAAAACAGCTCTAGTAAATGCACTTCGTGAAGCATTCCCAGA
AGACCTTGGCAATATGTATACCGAAGATGACGGCGGGGAGACTTTTGACCGTATTAAAGATGTCACACCG
CAAGAAAGCCGTGAAGAAGTGCTAGCTCGCAAACAGCAGCAAATCGAACAGATGAAACAGGAAGCAGCGG
AGCGAGAAGCAAAGCAGCAAGCAGAAGCTACACCATCAGTTGATCCTGAAACTGGCGAAGTGCTAGGCCA
AGAAATGGATCTGTTGGAGGGAGAGGAGTTTTAGATGACCGCAAAAACAAAGATGTGACAGATAGCTTG
GAGCTGGTTCCGGTGACTGACTTAAATTTTGACTTTAAACTGACGCCGGCCAAAATTGAAATTGAAGGTA
AGGAAGTTCTGGAACAGGCCCTGACAGCCTACCAGAAGAAATATGCAGGCTATGTCGTAACTGAAGATAC
CATTGTCGGCGACACGGCTGTCAAGAATGAACTAGGACGAGTAGAGCGCCAGCTCACAGCAGCAGTCAAG
GAAAAACTAGACGAATACAGCAAGCCGCTTGACGAGGTTAAGGCATGGGTCAAAGACATTCTTGACCCGG
TAAAGGCGCTAAAGGAAGATATTGCAGAGCAAATCAAGACCTTTGAAGCTAAAGAGACCGAAAATCGCAA
ACAGACGGTCAAGGACGCTTTTGAGACTGCAATTGTAGAGAACGGCACAGATCTAGATATAAACCTCTTT
GCTATCCACTTTGACGATCTGGCCAAGAAAAAATGCTTTATGGCAGACAACGTGCGCATTAATCAAGCGA
CGCTTAAGATTATCAGCGACCTGGTAGCAGAAGAAGCGGCCAAAAAGCAGCAACGTGAGACCGGTCTTAT
ACAAATCTCAGAAGCGCCGGAAAGGCTGGCTTTGGTCCGGCGGTTTATATCCGACGGTACGAGCAAGGC
GCAGCGTTAGGAGATGTTCTGCAGGCCATCCTTGACGACAAGGAACTGGCTGACCAAGCTAAGGAAAAGG
CAGAACTAGCAAAGCGCATTGAGGAAATAACGTCTATTGCAGAAGCTAAGAACCTAGCTCCCCAGAAATA
CGTTGACATGCTCAAGGCTGGCAAGTCTGCCCTGGATGTCATCAACATCCTGCATGCTGACGCATCAGAA
ATGAGACAGGCGCAAGCTGAAACTGAGCGAAATACGCAATCAGAGGCGGATGATTTACTCTACAATCAAT
TTTACGGCGCATCAGAAGCTCCTGACGGAGTTTTTAACCAATCCGAGGGTAATTATACCCAAGAACAAAA
AAAAGGGCTTAAAACGCAAATAAAGCATCTGACGGCGTCGGTAAAAAAATATGGTTTTAAATTCACGGTT
GATTTGATTTTCCCAGCGGAGAACGCAAAGGAAACCAAGGAGCAATTTAAAGAATGGCTCAATGCTCACG
GAGTGCAGTTTGAACCTAAATCAAATCAGTAAAGGTGGAAATGTGAAATGATTGAATTTATCAAAGAAG
CAGGAATGGCTCTGCTATGGGTGTTTCTAGGATACCTTGTCGGAGAACGTACAGCAAAAAATAATAAAA
CAAGCCGGGCATCCTTGTAAAACTGCGAACTAGAAAGCGTCAATCGGTTATGTGACCAATGGACGAGCGA
CTGCCCGTATTTAGCCAAACTTACACAAAGGCAGTCGCATTTTTTGAAATGATATGACTGAAATCAAAGA
AAAAGCCCTAGCGAAGATGCTAGAGGAGTTAAACAAACCGCATGATATCGCAATGGACCGCATTCATAAC
TGGATATGCGACCAAGAAGACGAGGATTTGCTCCAGGGGATCTTGAAAGATGGGTACTCTCTGAAATGCG
CTCTAAAATATGCAAAAGAAAAAGCCCGTAAATTCGCTGAAAACGGAGTGGCTTGCATTGATGATAATAC
TGTTTTCGGATCGAGAATATTTTGTCTCAAATTCGCAAGTATCCAATATCAAGCAGGTGCCTGTT
GAGGGCATCAAAAAGAATAAGTCAAACAAGCCAAAAAATCCTCAAGAAGAGAAGGTCGACGTGGCCAAAA
TCAGGAAAGGTGCTGGGCCAGATGATGATATTATCAAAAAACCTAAAATCAAGAAAGAGAAAGGAGTAGT
CGAAGGTCAGTTGGACCTTTTCGCAGATTTGGCATGAGCGAGATCAACGAACAATGCAAGCGAGAAGCTG
ACAGACGATTGAAACCACCTGCAGACTTCTGGAGCTGGTGCTACTCGCAAATCACAACATACAAGTGGAG
CAATAAAGACAAGACCATAATCGCTTCAGATTTGGACCTTGGTTATTGTGTCGAAAAGCGACTCACAAAG
TCGTCTCGGCTTACTTTTTACGACAAGACCTACTTTTTCTCAATCATTCTCAGTACATCGAAGCGCATCG
AGATCCAATCTTATGAATTTCGGTCAAAATTAGTCGACGGAAAGCAGTTCATTGATTGGCATTTTACAAA
TTTAGAGCGATTTGAAAATGATAAGCATGTGAAAATCGGCCAAGATTACACTGGCCAATATTATCCGTAT
CTATTTGCCAATTATTTTGGAGGCGGATATTATACAGGCAATAAATTCTATCCGAACAACTGGATTGGAA
AGCTGAAAAAGTATCCGAACTTAAATATTTGAAATTTGGTGAGATTGCTTACTGGGAAATCGAACGTCT
CTACAAATACAAATTTGAAATTGAATTTGCTCAGAAAATTCATGCTTACAAATTGCTAATCAAATCATG
GGTTATGTGTACAACTGGTCACCATCTACTGGTTATACAAAAGGCGTGGATATGCGAACCTTAAACCGCA
GATGGCTCCAGAAAATAAACAATTTTTTCAAAAATTCAAATCGCAGTTTCACTGAGTTCGAGCTTAGCCG
CCGGATTAAGGAGCGAAACGGCAAACTTGTGCCAGGCATTGAGTCTTATCTGACTTACCATGATATCAAG
CATATACCGAAAGGTGTCGGGATCAATAAATTCCAAAATTGGGTCATTAAGCAAAAACTTGATTTTAAAG
AGTATATGGACTACTTAAAAATGCTGGACACAATGGGAGTTGAGCCTGAGGGTGATGCTATGCTTGTCCC
TAAAGACTTTAATGCTATGCACCAACACACAGTAGAGCTTTATAACCAATTCTTAGAGGACGAGCGCAAG
CGTAAGAAAGCCGAAGAAGACAAGAAGCTGGAGACTGAGTTTAAACGGCGTAAGAAACTGGACAAGGTCG
TCAGCGGGTACAGCTTCCATGTGCCGGACAAGGTCGCAGAGCTTATCTACGAAGGCAAGAAACTTCACCA
CTGCGTCAGCTCATATACCGATAAGCACTTTAAAGGCCAGACGACAATCGTTTTTGTCAGGGCTGAGAAC
GCACCAGAATGCCCGCTATACACTCTAGAAGTAAAAGCGGGTCATATAGTCCAGTTCAGAGGAAAATATA
```

FIG. 11E. Continuation of (CJLB-5 [organism=Campylobacter phage CJLB-5] partial genome)

```
ACCACAGCGTCCCTGAAGATGTCTGGGATATAGCCAGAGATTGGATGCAGCAAGTTAAATTAATTAAAAC
CACTACAGCAGCATAAGGAGAAAATATGCACAAGATAAAAGTTACAGAAAACATCGAAGCGCTGATTGAG
CGCCAAAATCGTACAATCGAAGTTACTACAAGCCTGCCTTGGGATATTGAAGTGGAATTTGCACATCAAG
ACCAAGACGTTAGCCTTGACGAGAGCGGTGACATCTTTGAGCCGGTCTTTGAACTGGCATTATATGCTAA
ACCTAAGCAAAAATTGACTCTGACGTCATCAGGTCAAGCAAACACGCACAAAAAAGAAGTCGCAGAAATC
ATGAAGTTTTTTGACTTCGTAAATGACAACAAGAAAAACCTGTTTGAAATGACAGGTGTGATGGGAGTTG
TGGAATGAGTCTAATACTATCCATTGACGCAAGCACGAGCGCTACAGGTTGGGCCGTTTTTGACGGCTCA
CAGCTTGTAGAAAGCGGGGTGATCAAGGCCAAGGGCAGCTTTTTAGAGCGAGCCCTAGTGATGGCCTCAG
AGTTGCGAAAAGTCCAGCTGCGGACAATTAAAGAGCAAGGGAAACCCTTTGAGTCCATTGCCATTGAAAA
GAATAATGTCGGAGGTGTCAATCAGCAATCAGTCATTAAGATTGGTATTGCAACAGGAATCATTCTAGGG
AAACTGATAGCTGATGATGTTTACTTTGTCAATGTCTCAACCTGGCGCAAGTACAGCGCTATCAAAGGCA
GAGGAAAGAAAGAGCTGAAACAGCAGGCCATCAGCTTAGTTAGCCAACTCTATCAGAAACAAGTCAAGGA
CGACGAAGCAGACGCAATCATGATTGGTCGCTACTTCGTTGAAATGATTGATTTTAAGGACGGATTAGAA
AGTCATAGATTGAGCAGGTGACAGTATGACGAAGTCAGATTTAGAGGCTTACAAAATAAGCCTTGAGCGC
TGCAGAAATCGACTAGCAGACAAACAGGCGGAAAAAGAGGTCATATCCTCTTTTGGCCATGGAGCAGCAA
CCAGACGCAAGGGAACGGATGCGTGAGAACATCCGAAATTTAGAAGAGAAAATCAAGGAGTTGGAAGATGA
CTGAGACTAATGTCCAGAAGTTTTACAGAATTCTAGCTGAAAAGACCGAAGCTTTCGGCACAAAGAAAGA
AATGATGGTACAGTTAGGGTTTGAGGGTGCGAAGTTAAACTCTGACCGAACTAGACTTAACAGCGACGAA
AGAGCAGGACGCTTTCCGCCAGTTCGGCTGATGATAAAGCTAGACAGCTTGTTTGATAGAGAGTTCCTTA
TCACTTGCTTGCGCGAGAAAATGGACTGCAAGACGGTTGATAAACGCTGGGCGGCGGTCGCACAAGATTA
CATCGACGACAACTCAAAAATCGGGGGGGCGACGAGTGACAGCGAAGCGGAGCGACAGCGTAAGCTAAGA
CGCAGATTGAAACGTGAAATGTACCTAGAGAGGTCTTTTGGAATTTAAAGAGGAGGAAATATGCAACAAT
CAAGAATTGAGAGACTTGAGCACGAAGTAGCCAGGCTGCAGATATTGACAACGTTGGCCATGGCAGTTCT
CATCGCAACACTACTAGTCTTTATTTATGCAACTCAAGGACAACTTAATCAAATTAAAGAACTAACAACA
AGGCTGGAGCAAGTGGAAGGAGCAAACAGATGATACCAAAATTTAGGGCTTGGGATGGTGGCTCGTTATG
TCGCATGTATCAACCAGACGAAGTGATGGTCGGGAATGGTGATATTTGGATAATCGACGAAGATTCGGTC
GCTGGCGACTGGATTGTGAATAATGACATTGAACTCATGCAATCAACAGGCCTCAAAGACAAGAATGGCA
AGGAGATTTTTGAGGGGGACATAGTTCAATATCAAATACCAAAGTTTCATCTGCTGACAGTAAAGGAGT
TATCAGATATTTTGATAATTGGGCCATGTTTGGGATTGATATAGAACACAACGAACCAAGAGCGCTATTC
TTCAACGGCTTGGCCGACCACATATCATTAGAGGTCGTCGGCAACATATACAAAAACCCAGAATTGATTG
AATAGAAAAAGGCCGACACACTGCAGCCCTTCGGTATATTTTCGATAAACCTATTATACCACAAAAGGGA
GGCAAAAAGTGAGTAAGGCTAAAGAATTATTAAACGAGCTACAAAGTCTAGATTTAGATATTCAGAGCAG
GATAGACGAAATCAACGAGCTTGAAGTTGGTTTGCTTTCAAGCCCTAAGTTTAAGTCTGACAAAATCAAA
GGAGGTCCAACTCGAAAAATTGATGATGTCTACTGCCAGCTTATCGTGATGAAGGAAGCCATAGAACAGG
ATACGAGTGAAATCATCATGCGAAAGATTGAACTTGGACGACTGATCAATAAGCTGAAAAATCCTAGGCA
TAGGACGGTATTGAGGATGACCTACATCAATAAAATGTACGTTGATGACATCTGTGACAGTATGGGCGGT
ATGAGCTCGCCTACTTATTATCGTTTAAAGAAACAAGCGATAAACGAGTTAGATATTATTATTTCAGAAT
TGATAGAGAATGATAGCAATCGTACAGGCATGAAGTCTGAAACCTGCTAGAATGGTAGTATCAAGATTTG
AAGTTAAGACACCTTAGGCAACAGCCTAGAAAAGCTTCGACAAAAACTGCCAGCTTGGGTTACTGGTGGC
GATAGAGTAGGATGTTTTAATATCGCAAGGCGAGGCAATAAATGCCTTGCTTTTTTTATTCCACAAGAAA
GCGAGGTAGTCCAGTGAGTGGGTAATCTTACGGTTAAGCAAGAGAAGTTCGTCCAAGGTATAATCTCCGG
ACTATCTCAGAGGCAGGCATATAGAGAGGCTTATCCATCAGCAAAAAGTGGCTAGATAGTAGTGTGGAT
AGCAAGGCAGTAGTCCTCTTGCAAAATGCAAAGGTTATGAAAAGGTACAGAGAGCTTCTAAAGGAGTTCT
CGAATATGTCCTTGTGGTCCAGGGAGCAGGCCTTCAATGAATATGAGTGGTTAAAAAACAAAGCTCGAGC
AAGCATTGAACAAGACGGAATCAGACAAGCTAATTCCAATGCTTTTTTATCTGCTTTAGACGGCATGAAT
GAAATGGCATGGAAAGATCTGGAGTTGACAGACGAGAAGCTGAGGAAAGAAATCGAGCTGCTTAAGATTA
AGATTGAGAGCGGCCAAGGATCTAAGTCTGATACAAGTCTCATGACGGCCCTTTTGGAAGCCGTGAAAGG
CGGTGACTAGCTTTGGATATAACTTTTTCTAAGAAGCAGCTAGACATCATCAAGCGGCCTTTTAATTATG
AGCTAGAGGTTAATGAGGGGACACCTCGGAGCGGTAAGACTACGGCTGGCCACTTTCGATACGCCAGGTA
TCTGATTGAGTCTCCGGACGAAAATCACCTTATAGCAGCCGTATAACCAAGACGAAGCTTACCGTCTGTTT
ATTGATGGTGATGGCCACTGGTCTAATGCACATCTTCGACGGCGCTTGTAAAATCAAGCATGACGAACACG
GCGATCACTTGCTGATTGATACGCCTAACGGACAGAAACGGGTTATTACAAAGGCGGCGGGAAGGTAAA
TAGTGTTGGTGCTATTACTGGTATGTCACTAGGCTCTGTGGTTTTCTGTGAGATTAACCTCTTACACATG
GATTTCATTCAGGAAGCACTTAGACGTACCTGGGCGGCCAAACTACGGTATCACTTAGCAGACCTCAATC
CTCCAGCGCCACAGCATCCAGTCATCAAGGATGTTTTCGACGTGCAGAATACACGCTGGACACATTGGAC
TATGGATGACAATCTATTCTTTCTGACGAACGGAAGCAATCCATCATTCAATCGCTGAAGAAAAACCCT
TATCTCTATAAGCGGGATGTACTCGGCCAGCGTGTCATGCCTCAGGGTGTCATATACGGCCTGTTTGACA
TCGAGAAGAATATCAGCGATATATTGACCGGACAGCCTGTAGAGATGTATTTCTGTGGCGACGGTGGCCA
ATCTGACGCAACATCCATGAGTTGCAATATCGTAACAAGACACAGAAGATGGCAAGACTTTCTTCCGT
CTCAACCGTGTTGCTCATTACTACCATAGCGGAGCGGATACAGGACAGGTTAAAGCAATGTCCACTTATG
CAGTTGAGCTCAAGGTATTCATCCAGTGGTGTGTTAGCAAGTACCAGATGCGTTATACAGATGTCTGGAT
TGACCCAGCGTGTAGATCATTGAGAGAGGAATTGCATAAACTGGGAATACAGACCCAGAGGAGCCATGAAC
AACGCTCATGATGTCAGCAGTAAAGCGAAAGGTATTGAGGTAGGGATTGAACGTGGTCAAAATATTATCT
CATCTGGCCAGTTCTTACTTATCAATCACTCTGAAGAGGAGTATGATCATTATCATTTTTGAAAGAGAT
AGGTCTCTACAGCCGAGATGATAACGGCAGGCCGATTGATAAAGACAACCACGCAATGGACGAATTTAGA
TATAGCGTGAACGTGTTCTATACACGATACGCCAATTTTTTAGCAACAAGGAGCCAGTAAATGGGCATCA
```

FIG. 11F. Continuation of (CJLB-5 [organism=Campylobacter phage CJLB-5] partial genome)

```
TACAGACTATTAGAAATCTATTTAAGAGAGGACAGTACGCAATGACGACAGACAGTCTGACAAGTATTAC
AGACCACCCCAAAATCGCTGTCACTAGCGCAGAATATCAACGCATTAACGATAATCTGAGGTATTTTCAA
AGCAAGTGGCCTAAGGTTGAATATCTCAATACAGATGGAATCAGGAAGAGTAGGAAAGCCAATCATTTAC
CGATTGCACGAACAGCGGCCAAGAAGATTGCAAGCCTGGTATTTAACGAGCAGGCAGAAATCAAACTAGA
TGACGATATTGCTAACGACTTCGTCCGAAGACGCTGGCAAATGACCGCTTTAACAAGAACTTCGAGAGG
TATCTTGAGAGTTGTTTAGCTCTTGGAGGTCTTGCTATGCGGCCTTATGTGGATAACGACCGAGTGCGGG
TGTCATTCGTGCAAGCGCCAGTATTCTTGCCGCTACAATCCAATACTCAGGATGTATCAAGCGCCGCTAT
CGTGACCAAGACGGTAAAGTCTGAAGACAAGAGAAATGTGTATTACACATTGATTGAGTTTCATGAATGG
GCAAAGGATGGAAAGTATATTGTCACGAACGAACTTTACAAGTCAAAGGATGTTGATAAGATTGGCGATC
GTGTGGCTTTGGCTGAACTTTACGAGGACCTTGAGGAGACGGTAGAGCTTGACGGACTATCCCGTCCTCT
CTTCACCTACCTCAAACCCCCAGGGATGAATAACAAGGACATCAATTCGCCCCTCGGTTTGTCTATCTTT
GACAATGCCAAAAGCACCATCGACTTTATCAATACCACTTACGATGAATTTAAGTGGGAAGTCAAGATGG
GGCAACGCAGGGTAGCAGTACCTGAAAATCTAACTGAGACAAGGATGGTTTCAAGAGATCGTGATGTTAG
TACAGTCCAAAGATTTGACAGTGAACAGAATGTCTATCTAAGGCTTTCGACAAGCGATATGGACGGAGGT
CAGCTCACAGATCTAACAACTCCTATCAGAGCCGAAGACTATATCAAGACTATTAACGAGGGTCTGAGTC
TCTTTGAGATGCTTCTAGGAGTATCTGCAGGGATGTTTACCTTTGACGGCCAGAGCTTGAAGACGGCCAC
AGAAGTAGTCTCAGAGAACTCGGATACTTATCAAATGCGTAACAGTATTGTGAGCCTGGTAGAGCAATCA
ATAAAAGAGCTAATCATCTCAATATGTGAAATAGGCAAGCTTTATGATCTCTATCAAGGAGAAGTTCCGG
AGATGGCCAATATCACAGTCAATCTTGATGACGGCGTCTTTACGGACAAAAACAATGAGCTGGAATACTA
CACTAAGGCGCTGGCAAGCGGACTTGTAAGCCGTGAATATGCTATCCAAAAAGCGCTGGGAGTATCTGAA
GAGGGAGCCAAGAAGATGATTATAGCTATCCAAAACGAAGCTCAGGTGGCCGCTAATCAAGCCAGAACTC
AAGAAGATATTGATATTTACGGAGAATAAGCAACATGGCCAAAAGCAGGAAGAAGCCAATCAAACTGAAT
GATGAACAGCTCTTGCTAGAGGCTAGCCAAGCAGCGGACATCTATCACCAGCTAACCTTAGACCTCTTTG
ACCAGGTCATTGATCGATTAAAAGAGAGGGGGACGGTCAGTCTTGAAGATAACCCCTATATTTGGCAGCT
TGAGAAAATGTCAGAGATGGGCTTGCTCAACGATGACAATGTCAAGCTTATTGCTGAGCGGTCAGGGATA
GCTGAGCAACAGCTTAGGCATGTCATAGAGGGCGAGGGATACAGGGTCTACCAAGACACCAAGCAGCAGC
TCTTAGATACGCTGGGAAAGTCAGGGAGTGTTGTAAATAGTGAACTCCAAGACCGTCTTGCTTCGTATGT
CGGCCAGACCATGAGCGACATCAGCAACCTGACAAACTCAACCCTGCCGGCCAGTGTCCGAAGTGTCTAT
CAATCCATAGTTGAGGAGTCCGCGGCGGCTGTTATAACAGGTTTAAAGACCGCTGACAAGGCCATATCAG
ACACTGTCATGAAATGGGCTGACAAGGGCTTTTATGGTTTTACAGATAGCTCAGGGAAACGCTGGAAAGC
AGATACTTATGCCAGGAACCTGATTAAATCCACCGCCTGGAGGACATACAACGAGGCTAGAACAGCACCT
GCTGAAGAGCTCGGGATAGATACTTTTTACTATTCACAAAAGCCAGCGGCCCGAGAAATGTGTGCTCCTC
TACAGCACAGGATAGTTACCACTGGAAAAGCTCGGACGGAGCATGGTGAGAAAATTTTGGCTCTGGACGA
CTACGGTTACGGAAGCCCCGGAGGATGCCGAGGCGTCAACTGTAGCCATGTCATGACACCTTTTGTGGTT
GGAGCCAACTACAAGCCTGAACTTGGTCCGGACTGTAAAAGATATACGCCGGAGCAGGCGGATAGAAACG
CCAATGCAGAAGCAAAGCAGAGAGCCCTAGAGCGTTCTATCCGGAACAACAAGGAAAAGCTGCACGTCGC
CGAAAAGTTGGGTGACCAGGAGCTTATAAATCGCTACAAAAACAAAGTACAAATCCAGCAGGGAGCTATG
AGGCAATATCTGAAAGATAAACCATTCTTACATCGGGATTACAGTCGGGAGAAATACTATAGCGACCCCT
ACACGCAGGCCAAGAAAGAGGTTAAACTTAGGGAAAATCTGGCCAAGCTTGAAAAGCGCAGATCAGAGCA
AAAAGAAATGCAGAAAAAGTTCAATTTTGCTGTTGAAAGTGGTATAATTAAGACAGAAATTAACAACGAG
CATTTTGAACGGCATGTCAAAGGGACTAGAGGGTATGAAGATTATCTAAATTCTAACCTGGCCAAAGGAA
AGAACATGCCAAGTTATCTGACAATCACAAAAGAAGAATGCCAGAAATTAGTGGATCGCTATGCTGGAAC
TGGACAATTTAAGTACAATCCAAAAACAGATAAAATGCAGGAAATCATCTCACAAAACAAACCTATCGGA
ACTTATATAGACCCTAAAACTGGGCAAGTTATCGAAGATGTTACTGATTTCCGCATTCATTACAGTAAAA
CCGGTGCGCACATCGTGCCAACTATCAAAGGGAAAAGGAAACGAAGATGAGTAAGAAGTTATGGAATTAT
CTACGCTCAAAAGTTCGAGTAGTTGATATTAACGGCAATATCATTAGCGGACTTGTTACGGATTTTGTCG
ATGAAATGGATAACGACGAGCAAGATGAAATCACTATCCTCATTGACGGATCAAATTCTGACAGTCCCAC
TGAGGTTTCTCTATATGAGAGAGATATCTCATCAATTCAAGTAATAACTGGCGCTTAGTTAAAACTAGGC
GCTTTTCTTATATTTAAAAATCAAGACTGGCTTTGCCGGTCTTTTTCTTGCCCTGGAGCATGGCGTAAA
ACTGTCTGAATTCGTCCATGTGACGTAAAAAAGGAGGAGTTTTAGACATGAGTTTAAAACGAGAAATGTT
AGTCGAAGCCGGTATCGAGGACAAAGAGCAGCTTGATAAAATCATGGCACGCGTACGGGTCAGGGATTGAG
TCAGCGAAGTCCGGATTGCAGGCAGAGATTGACAGTTACAAACAGCAACTTGAGCAACGCGACCAAGCTA
TCAAGGACTTACAGGACAAAGAGGGAGCGAGTGAGGAAGCTAAGAAGCAACTAGCAGACCTACAGGCTCA
ATTTGAAACCTACAAGACGGACAGCGAGGCTAATCTTGCACAGTTGCAAAAGACCAATGCTGTAGCCCTT
GCTTTGAAAGATGTAGGAGCTTACAACTCTGAGGACCTCATGAAGTTTATCGACCTAGACAAGATCGAAC
TAGGCGGAGGACGGAAAAACCAGTCCTAGAAGAAACTATCAACGGTCTTAAAGAGTCTAGCCCTTACTTGTT
CCAACAAGGACAAGAGCAAGCAAAGCCGCAACCGCGCTTTTCAGCTGGTGGAAATCCACCGGCTGGAACA
AACCAAGAAGACGCCTTTTTGAAGGCTCTAGGATTAAATGACTAATAGGAGAATGATCAATGACAATTAA
CTACATCACTAAACATGAGGGCACCTTTGAAAAGAAATTGATGCAAGGCGCCCTTACAAACATTTTGGAA
ACTCAACAAGTAAATTGGCTAGGAGCCAAGTCGTTCGAGTTGCCAACCATTTCAGTTACAGGCTATAAGG
CGCACACTCGTTCTAAAGGATACAACGCTGGTACAGTATCAAACGACAAAAACGTTTATACGCTTGGTTT
CGATCGTGACGTTGAGTTCTTCGTAGATGCTGCAGACGTCGACGAAACAAACCAAGAGCTTTCTGCTGCT
AACGTATCTAACACATTCATCACAGAACATGCAACTCCAGAAGTTGATGCTTACCGTTTCTCTAAGATGG
CTACAGAAGCTATCACAAATAGCCACTTCAAGTCTGAGGATGACCTATCAGAGGTGAACATCTACACTAA
ATTGAAAGCTGCCCTCTTGCCGGTTCGTAAATACGGCGCACAAAACATCGTTATGTATGTTCTAGCGAA
GTTATGGACTTTTTGGAACGCTCTAAAGAGTTCACACGCTCAATCGCTACTACATCGCCTCAAGGAATTG
```

FIG. 11G. Continuation of (CJLB-5 [organism=Campylobacter phage CJLB-5] partial genome)

```
ATACTCGTGTCACTTCACTTGACGGAGTTCAACTTATCGAAGTTTGGGACGATGCACGCTTCAAGACTAA
GTTTGACTTCACTGAAGGCTTTGTTAAGGCTTCAGATGGTAAAAACATTAACTTCTTGATTGTTGCTAAG
CCAGCAGTAATTGCCAAGGCTAAGTTTAACTCAATCTATCTTTTCGCCCCTGGTCAACATACAGAAGGCG
ACGGATATTTGTACCAAAACCGCCTCTATCATGACCTTTTCGTCTTAAAAGCCAAGAAAGACGGGGTCTA
TGTATCTCACAAATCTGCTTAATAAGGGGGTAGAACATGCGTAAGTACGAAAAAGGGAATCAAGTATACA
CCGTGCAAGAAGGTAGCTTGCTTGAAACTCAGCTAATCGCCGATGGATTTGAAGAAGTGATTGAAGATGG
CCAAATCTCAGAGATTTTGGCTACTCATTCACTTTCGGACATGACTTTGGCAGAGCTGAAAGCTCTTGCG
AAAGAAAGAGGGGTTGAAGGTTATTCGACCAAATCGAAAGACGAGCTTTTGGAGGTACTAAATGGCCAAG
TTTAAAGCAAAATTGAACGTCTATCTTGCTAAGTCTGACCGCCACTTTGACAAAGGGCAAGAATACGAGC
TGGATCAAGACGAAGCCAATAGAATCAATAGTCTGTTTAATGAGGTTGTTGGTGGTGATTGCCTTGAACT
TGTTGAAGGGCCTGAGAAAGAGTTAGTTGAGGTGGAGACATCCACTTTTTAAGGAGGTGTTAAATGGCCT
ATTTGACCAAACAAGAGTATAAAGACTTAGGTTTTGGTGAGGCGAAAGACTTTGAAAGTTTGCTCAAGCG
TGCTGAAATGGCTATAGACCTCTACACTCGGGATTTTTACTCTTACAATGACTTTGAGCGTGATTTTGAG
CCAAGGCGGCGGGATGTAAAGCGAGCTGTGGCCTTTCAGGTTGCTTATCTGGATAGCACGGGCATCATGA
CGGCCGAGGACAAGCAGGCAGTGGCCAGCATGTCAGTAGGTCGAACATCTGTAAGCTATCAAAATGGCTC
TCAGAGCTCCTCTCAGGGGCTTTCTTTGGCTGCTCGCTATAATCTATCTCGGGATGCAGAAAACTGGTTG
AAATCGGCCGGATTTGGATTTGTGAGGGTAGAATATGATAGATAAGAGAATGCTTACTGACTCTGTTAAA
ATCCAGAAACCGACAGGAAAGGATGACTGGGGCAAAGAAACCTATTCAGAACCCTTGTTACTATCCCCTT
GCAAGTTTGACCGAGTCTTATCACACACAGGAGCCGGAAGCAACAGAAGCGAGACGAAACCATCAACGGT
GATTGTTTACCCTCAATTCTGTCCGGTCGAATTGGACAAGTCTTACTTAGGCGGTGTCGTCGACGATGAC
GGTACCCTCTATCTTGTCCGCAGTATCATTCCGCAGTATCATCCGCTAACCAGAAAGCTTCTAGCATATG
AAATCGAGGTGATTTGATGTCTGGACGTGTCAAGGTGTCTTTTAATCTCAATGGGATTGAGAGAAAGGTT
TCTCCTCAGGCTCTGGCTAAAGGAAAGCTAGCCATAGCTAACCAGATGCTCTTGGATATGGATCAATTTG
TTCCTCGTAAAGGAGGAGACTTGAGAGGGAGCGGAAGCGTCCAAAGAGACCGAATCACTTACTCAAAGCC
ATACGCCAGAGCTCAATACTATGGCAGTTCTTACAACAAAACAGAAGCTTTAAATTTAGGAGGTATTCA
ACTCCAGGAACTGGCCCAAGGTGGGACAAGAAGGCATCAGCTATCCATGCGAAAGACTGGTCCAAGGTCG
GCCTTAGAGCCATGGGAGTACGAACATGATCAATAACAACGACTTTTCGACGGTTCTGCTAAATCATATC
AAGAAACTGAATCTGGCTATACCAGCTAGACTTGACTACTTGGGAGAACATGAGGACTTGGTTATCTATC
CGCTGCCAGGTGGCAAGGTAGAGGCAGAAGATATGGCAGGCACGCAGACAGTGAGCCTGCCTTTTGAAAT
TGCTATCAAGTCGCAGGATCAGTCACTAACCAACGCCACATTGTGGCTTATTAATACTTCTCTATCGCAG
CTTGATTTGGACTTACCTAGTCTGAATCAGTCATACGAATTTTTAGGTCTTGAAGTAGCTAAGCCGTTTT
TGAATGACTTAGACGAACAAGGCTTCTACATTTATCAGCTGGATATCACAGCCAGCCTCGAAATAGAAAG
GAAATAACAAAAACATGGCAAAACGCAAAAACGCCCTACGGAAACACTACATCGCTCCGTTTGACCCGGC
AACACAAGATACGGAGCCAGCTAAAGAAAAATACAAATGGCTTGCAAAGGACATCACCTCGTCATCTCCG
GAAGTTGATGAACAGACAGACGACTCTGCAGACTTCGCAGGTGATGGAACGCCTGTAGAAACAATCACAT
CAGTCAAACGCGGACGCTCTTTTGAAGGCAAGCGTAATGACACTGATGAAGCTCAGAATATGATTGCAGA
TATGCAGGACGAAGTAGGTGATGGCCGCAAAGTATGGTACAAGGAAGTGGATGCTGATGGCAAAAACCAG
CGGGTAGGAGTAGCCACTGTCTCTGGAATCGAAATTGGGGACGGCGAAGCAACCGAACATGAAGGTTTA
AAGCCAAAATCATGTGGGATCAGAAACCGAAAAAATCTGCTGTAGTACCTGGTTAAATTTGAATGAGGGC
GTACAATATGCGCCCTCTTATTTTGTGTAAAGGAGAAAAAATCAAATGGTAGTAATCAATTTACGGAACA
AAGTAATCCCGATCGACTTTGGAGAGTTTCAATTTGAATTTTCAAAGAGTGACGAAAACATCGAGAAGAT
GCAGTCATTCGCTCAAGATCTGCAGTTAGAGGCTCAGAAAATTGTGGACGAGGACGGCAAGGAGATGTA
ACCAAAGCAAGAGAAATTCTTAAACTTGCCTACAATGGTATCTTTGGCGATGGTTCTTTTGACAAGGTCT
ATAATCTCTCTGGACAGTCCACTGTCGACTGCATTAATTATTTCATTGAGATTATGCAGGGTGTTGAACA
GGAGCAAATCTCGAAAGAAAGTCAAGAATTGCTTGATCGCTATCTTGGTAAGTAGCCATGTTTGATTTGT
CAAGGAGATTTAGAGATGAGCTAGTCCTTGATGATACGAGCTATCCGCTTGACCTGTCTTTTGACAATGT
TTTGAGGCTCTTCGATATGATACACGATGACTACATCCCTGTTATAGCCAAGCCTATCTTTGCTCTCAAA
ATATTGCTGAAGACTAGCACTGATAGCGAGAAGCAGGCGGCTGATGGTCTTTTGGAACGCTTAGATATTG
AAACGGCCTTAGAAATCTATAAACGGATTTCCGAGGAACACGTCGTCATCAAAAGTTCCAGAGGCGAGGT
TAAAGAGTATGACTTGGCCGGCAATCTTATTGAACGTATACCAATAGATGATGACGAGGAAGAAGATGAA
AAAGAACCGCTTTTTCTTTGAAATATGACGGTGTTTACATCTATTCCTCGTTTCTGCAGGCGTACAATA
TAGATTTAATTGAGGCCCAGGGTAAACTTCACTGGCAGAAGTTTAATGCTCTTTTAAACGGACTGCCAAG
CAATACGAAGTTCGCAGAAGTCCTGAAAATACGCTCGTGGGAGCCTCAAAAAGACGACACTCAGGAATAC
ATCAGCAGCATGCGAAAGTTACAAACAGAATATGCATTGCCAGAAGAAATTGATTACTAACGAAAGGAGG
AACTAAATGGCGGACGAAGAGTTGTTATTCAAGTTGATATGAACGGCGACAGAGCGCAGAGCGGCATTA
GTAAGCTAAGGGCTTGCTAGGCGGATTGAGCCGATACCGGACAAAAGGTCGGATCAGTTTTCAAATCTGT
CTTAGGAGCGAATCTAATAAGCGGGGCTCTAATGAGTCGGTATCGAAGCTTTGACTGGCTCCATAAAAGGT
GCTTTTTCAACGGTCATTTCAGAAGGTGCTGCACTCCAACAATCGCTAGGAGGAGTCGAGACGCTTTTTA
AGGGTTCAGCAGATAAAGTCAAAGCATATGCTGACGAGGCTTTCAGGACTGCTGGATTATCCGCTAATGC
CTACATGGAAAACGTGACAAGCTTTTCTGCTAGTTTGTTGCAGTCTTTGGGCGGTGACACAGAGAAAGCT
GCAGATGTAGCTAACAGAGCCATGATTGACATGTCCGACAACGCCAAACAAGATGGGTACAAGATCGGGC
GCATCCAGGATGCTTACCAGGGGTTCGCCAAGGATAACTACACGATGCTGGACAATCTCAAATTGGGCTA
TGGTGGCACCAAGACGGAAATGCAGCGATTGATTAAAGATGCCGCGGCGATGAAAGACATCCAAGACGAG
TTGAATGTCTCTGTAGAAGATGGCAATATGTCCTTTGGGAATATCGTGAACGCTATTTCAGTTATGCAGA
AGAAACTTGAAATAACAGGGACGACAGCTAAGGAAGCTAGCTCAACCCTGAGTGGTTCTTTTGCATCAAT
GAAAGCTGCTTGGCAAAGCTTGGCCGGGAAGTTAGCTCTGGGTATGGATATAGGGCCATCGCTCAAAAAC
```

FIG. 11H. Continuation of (CJLB-5 [organism=Campylobacter phage CJLB-5] partial genome)

```
TTAGTTTCTACAACGTCCACTTTCTTGCTTGGGAATTTTATTCCTATGGTCGGTAATATTATGCGGCAAC
TTCCTGGTGCTATTTCCAGCGCAATATCTGAAGCAGGGCCACAGATACAGCAGGCTTTTAAAACCATGAT
GTCTGGACTTGGGATAGATGCAAACTTAACAATAGCTAAGCTATCGATTGCTATAGATAATGTAAAAGCG
GCTATTTCTGCAGTCGGAAATGCATTCGCAAGTGCCGGAAGCAAGACAGCGTGGCTAAATACTATCAGTA
ACATCGTAGGTGCTGTTATCAACACATTTTCGGCGGGAGCGAAAATTGTAGAGAACTTCGTCAACGCATT
TGCGCAGACTGGAGCAATAAAGGCAGCAAAAGGAGCCATAGACAGCTTAATTTATGCTTACAACAATGTA
ATTACTAGCATAGGAGATGCATCTATCTGGTCGACGCTTGGGTCTGTTATCGGGAATGTGGTAACAGTCA
TATCAAACGTTGTAAAAGCCATCGGAGACTTCATTGCAGGGTTAGATCCGTCTATCGTTCAAGGGATAAC
AACAGCTCTAGTTGGTCTTGTCGTAGGTTTTAAAGCATTCAACTTCCTAAAATCATTCAATCCGTTTAGT
ATTTTCAGACGGAATGCAGCAGATGCATCTAACGGGGCAGCTGAAGCTGTGACACAAGGGAAATCTAAAA
TCTCTCAAATATTGAATAGCCTAAGTTCAGTTATCAAATCTATCGGCGGTGCGATTAAATCTGCTGCAGT
TGGTATCGGAGTAGGTATTAAAGCAGCTTTAGGCGGTGTATCACAAGTTATCATGGCTTTTGGTGCAGCG
CTTAAAACAGCAGGAGTGGCTAACATCCTAGCCTTTGGTGCTGCGGTTGGTATTGCTGCAGTCGGTATTG
GAGCAGGAGTAGCTATTATCGCCGCTGGCTTTGCTCTTTTGGCAACTCAAAGCCAAGGAATAAGCGCAAT
CATTGGAGCGGTAGGCCAAGCCTTTTCTGCCTTTGCAACAGCTATTATCGGCGCATTCGCACAAGCGATT
GTAACGGTAGCGGGAGTACTTCCGACAGTTACATCGGCACTTGCTGGGCTATCTCCGTTAGTCGTAGCAG
TAGGGCAAGCAATAGCGGCAGCATCTCCATTCGTTACAGCCCTAGGAGAAGCATTTACATCTATCATCTC
TGTGCTTCCGCCAGTTATCACAGCTTTGACTGAGGGCGCAGCGGCTATCGTAACAGCATTAACACCTATC
GTTGAGATTGTAGGGAATGTGTTTACTAATATAGCTCAAATCGTAGCAGACGCTATCGTTAAGATTGTTC
AAGCTTTAGCGCCGTTTATGCCCGCTGTTTCGGAAATGGTACAAGCATTAGCTCCTGTACTGCAGTCAAT
TGTCGAAGCATTTACGACGCTAGTTAGTCAGATAAGCCCAATCATCGACAGTATAGCTAACCTCTTTAAG
AGCTTAGGAGAGTCTATCAAGACTGTTCTTGACCGCGCTAAAGGCGTGATTGAAAGCTTTGGCGGAGCGG
TAAGAAATATACTAGACGGAATTTCTGGGATATTCGACGCAATCGGAAACGCTGCTTTAAATGCCGGAAA
AGGCTTTAAACTGATGGCCGAGGGCGTGGTCATGATTACCAAGACAAACCTTGGCGATATGGCCGCTAGT
CTAGCCGCAGTAGCCACTGGGATTGGTGCGATTGCTGCAAATGGCGCAGGAATAGCAACTGCAGGGAATG
GCATGAAAGCACTAGGTCAAGGAATGGCAATGGTACAAGCATATAGCGCAAGCGCTTCTGCTTCGCTTAT
GTCAGTATCAGCAGTGCTTCCTGCTTTAGCTTCTGGATTTTCAGCATTAGCACCAGTTATTGCCAGTGCT
ATGGCTAGAGCTGTAACAAGCGTACAGTCTGGCATGACCTTGATAGTGACGGTCATTGTTTCAAGCGCAG
CTCGTATGACTGCAGCAGGACTACAAGCAGGCCAAGGTGTATCTCGTGGAGTTACCAATGGTATCCGGTC
TGGTGTAGGTCAAGCTACAAGCGCCATGAATACTCTTATATTGTCTGTCCAACGTGTCGGAAATATCGGC
GCCAGGAACATGGTTAATATCGGCACTCAAATCGGAAACGGCCTAGCTCGTGGCATGATTGCCGCTTTGC
CAGCGGTCACATCAGCGGCTAATGCGCTCGTGGACCAGGCAGAGAGAGCGGCAAAAGCTAGAGCAGATAT
CCATTCGCCATCCAGGCTCTTTAGAGACCAAGTTGGTCGGTATATCGCTCAAGGTATAGCTGTAGGTATT
GAGCAGAATACCTCAGATGTGGTAGACAGTCTTGACAAAGTCCAGCGAGAAATGATGCGCTACAGCTTCC
ATCCAGAGAAAATGATCAGTCAATCTGCAGGATCTATCACAAGTCAAGTGCAGCTTAAATCAGCCAGTGA
TCGATTGCAGGGTGGCCAAAATAAGAGCGTCAAGGATAAAGCGGATGAATTTCTTCGCAAGGCGTTAGAA
GTGGCAGAGGAAGCCGTGAAGAGACCTGTCTATACTGTTCTGGATGACGGCACACTAGTAGCTAAGACAG
GAGAAAAATTCAAAAACTGGCAGGATAATCAAAACTTTATTCGCAACAGGATGAGAGGGGTGGAAATTTG
ACAAAAATCGACTTTCAACGGAGTTGATATGTCCAAGTATTTTAAGGTCTTGGATGTTATTATCCCGA
TAGGAAACACAAGGAGTATCGCAACAAGCGACGCTCCTTTTTTGGGCGTAAACGTTCAAAATGTCAAAAT
CGGACCCAAGAGAATTAAAGTTAAGATCAAGATGCAAACCAGGACTCCGGAAGAGATGGAAGAGCTGAAA
GATGAACTTGCTGGTGTACTGAATGTATCTGAAGCAAAGCGTATCACTTTCAACTTCAAGCCAGGTAAGT
ACTACATGGGCTTTGCTTACGATGACATTACTCCAGACAATATTACTCGCTGGCTACAAAAAGCAGAAAT
TGATTTTTTGATCCCAGACGGCGTGGCACACTCTACAACTTACAAGCGTGTAGTGGACTATGAAGAAAAG
CAAGGCAAGATGGTCTTTGCGATTGATAATAAGGGGACAGCAGCGCTTATCCAATTATCACATTTAAAG
CCAATGACGAAAACGGCTATTACGGCCTTGTGAGCGAGCGGTTTGCTTTCGAGGCCGGAAGTATCGAGGA
AGCCGATATCGTGCCATATAAGCACTCTGAAATCCTCTGGGACTATGTTACTGGCGAGGGTATTATCAAG
GGTCTTGCGGACGGTCAGAAGAATGTAGCAATCCTGAATGATAATTCCCAAAACTTGAACGGAACACTAG
CCATTCAAAGCGTTTGGGGCAGACCTCATTTATCCCTTGCTAATCCTGGAGGTGGCCCTCTTGGAAATCA
TGCTGGATCAGTCACTTGGGAAATTCCCGCTGATAGCGTAGGAGAAAAGGGAGCGCTTCATGAGTACATA
TGGTGGAGACAAATTTTCTGGGTTAATCCAGCTAATCAATATGGCTTTATCAAGATTTCATTTACTGGTG
AAAATGGCGAGTTCCTCTATGGCGTTGAAACCATTAAGCGAGTGAATGGCCTGAATACAGAGTATAACTT
CCTTGCTGCTAATGGAAGCGGCAGCTATAAGCTGGTTAAGCAATGGACGTTCTGGCCGACTCACAACCCA
AGCGAAAATCCGTTTAACAAAGATAGCGGTCAATCCGACATCTTACGCAGAGACGACGAAGTTCAGCTGT
TTTGGAATGGTTCGTATCAGAAATTCACTGTCCCTGAAATCAAAGGCAAGAAGTCTATTAAAGTCCATGT
TGCAATGGGAGCTTTTGGCGATAAGCGCTCCCTACACACAGTCGCTTAGATAGTACTTCGTTTATCGAAAA
GACTTTGTCAATGGCACAAAAGACATCCCTAACAGATACGCTCAGGAAGTACGCTTGTCATTAACAGTG
AAAATGACAGTGTATTTCTGAACAATCTTCCGAATCTGGATCAAGTAGTTGATGGCTCTCTATGCCGGT
CATTCCACCCGGTAAGTCTGAAATCGAAATCTTGCAGTCTAATTGGGCGAGGAAAAAACCGAGTGTGACG
ATTGAATTTGAAGAAAGGTGGCTCTAATGCTTTTAACAATCCACGATAGCGCCTTGAAAAAGGTCGCTTT
TATCGACAATAACAAGCAGACCACCTTGAATTTCTTCAACGACAAGTGGACACGTCCACTTGAAAGTGCG
ACATCAGTCTTTGAGTTTTCAGTTTTCAAAAAGAAAATTCAATCTGACACATACGTTGAACAAGCATATA
AGCACCTCAATGAGCGGGCTTTTGTCAGCTTCAAGTATAAAGGTCGGTCTTATCTCTTTAACGTGATGAA
GACCGAAGAAATGAGCAGATTATCAAGTGTTACTGCGAAAATCTCAGTCTAGAACTCATGCTCGAGTAT
CAAGAGGCATACAAAGCCCCTAAAGCCATGACTTTTGAAGAGTATTTGAAAACATGGGGAATTCTCAGTG
TCGCTAAACTTGATTTAGGTATCAATGAGCTAACAGACCAGCGCAGAGCGTTGCAGTGGGAGGGACAAGA
```

FIG. 11I. Continuation of (CJLB-5 [organism=Campylobacter phage CJLB-5] partial genome)

```
AACCTCTCTTGCTCGCTTAATCTCCCTGGCTCGTAACTTTGATGCTGAAATCGAGTTTGAAACTCACTTG
AAGTCTAATAGCCAGCTTGACCGCTTTGTTTTGAACGTCTATAAAGCACATAGTGCAGAAAATCAAGGTG
TCGGACGCAAGCGAAACGATGTTGTGTTGAAGTATGGCAAGAATGTGCGGAGTATTAAGCGGAGCGTTGA
CAAGACGCAGTTATACAACGCTATCAAGCCAGTTGGACGCAAGGAAGAAACCAAGGAGACATCAACCAAG
GTTGCTAATCCGTCAGCTACGCAAGCGGCAAACAGTGGCAAGAAATATACTGGTGGCGGTCTAAACTACG
CTGGGCATCCTATGAGTGCTGCTATAGTCCAAACCATCTTAAATCTCTGTGTGCAGTACAACATACTGCC
GTCGGGTATGATTTGCCAGCTTTACCTTGAAAGCTCTTGGGGAAGTTCCTATCTTGCTAGGGTTGATAAC
AACTGGTCTGGCATGTCTGGCTCTGCCCAAACTCGGCCAAGCGGTGTCAAGGTCACAACAGGAAGCGCAA
GACCGGCTAACGAGGGCGGAACATACTTCCACTATGCGAGCGTAGACGACTTTATGAAAGACTATGCTTA
TCTGCTGGCTGAACAGACTAGCGGCGGGCGGAAGTTCTACGGGGTCAAAGGCAAGCAGAACATCGAAGAA
TACACGAAAGGGCTTTTCCGTGTTGGAGGTGCGCTATATGACTATGCGGCCGCTGGATATGGCCACTATA
TCGCTCTCATGCGAGATATCAGAGGTGGGGTCAATCGCTCTAATGGCAATATACTAGACAAGCTAGATGA
TCTCTGGAGACAGCCTAACAATCAATTAAGCAGCCCTAGCCAACCAGTGACAAGAGTAGTCAAAGCCGAT
AAAACAATCGCTGTTATCAACGAAATGAAAGGACTACAAGGCCGGACAGTCGGTAGCGGCCAATGTTATG
GCTTAGCTGCTTGGTATTCCATGAAGTTAGGCGGCCCTGGTCTTGGCGGTGGCGTAACTGGTTTTTCTGG
AAAAGTCGGTGCTGGTATGGCTGCGGCTTATATCGGAACGGACTACGCTTGGGCTAATTTTGGTTGGTCT
GTTGTCCGTCCTCGTGGGACTAATGAGCTGAAAGCCGGCTCTTTGGCGAACATCAAAGCTCATAACGCTT
TCCTAGGAACTGGACAGTATGGCCACGTTTCAATCATTATTGCTAATAACGGCAGTACAGTGACGGTACT
TGAGCAAAACTATGCTGGTCGTCAGTATGTGACTCTTGGGACTTATAATGCTCAGGCTTATTTGGGAGCC
ATTGAGACGCTTTGTTATCCACCGGAACTAAAAGCCGGCAAGACGGTTGAGGGTAGGACAGAAACAGGCA
GCACAGTCGATGTACCAGTACCAGAGATAGAACTTAAAGAAGTAACCGTCAGCACCACGCAGATTGTCAT
AGACCCCAAGAAAAGCAAGAATGGAAGAATGAAAAAGGCGA
```

FIG. 12A. (CJLB-7 [organism=Campylobacter phage CJLB-7] complete genome)

```
ATATTACTAATATTTATAGAGAGGGTTTTATGGGTATATTAAATACAGCTGTTGGTGCAA
TATCAGATTTTTTGGTGGTGATAAAACACAATCAGCTATAACTGAATTAGCACAAAAAA
TACAAAAAACATATGGTATTAATTTTGATTTAGAAAGTTTATATAGCATTGATACTTTTG
CTTTAAAAAATGAAGTTCCTGGTGCTGGTAGAATTAATATTCTTGACTTACCAAATATGG
ATATATTAATACAAAGAGTTTCAATAGATCCTATTTCATTTGCTGAAATAAATGAATGGA
TAGGTTCTAGTTGGGTTTATACCCAAGGACGACACGAATTACAACAATTAACTATAACTT
TTAGAGATAGTGATGGTGGTTTTTTATATTCAGCTTTTAAAAAACTTACTGGTCATTTAA
AAGATCAATATCCAGATGATCAGATGTGGATCATTAAGATAAGGAAAAGAACATTAAGAG
AATCTAGGAATTACATAAATCAATCTGTACAAAACAATGAATTTAAAAATGGTGGACATG
TTATTGTAGATACACAATGTGCTATGATAAGAAGTCATGGTGGATTATCACTTGATCAAA
ATAGTAATGGTTTGGCAACATTTGATGTAACATTTTATTTGATCCTTTTCCACCACAAA
TAAGCTATTAAATATAAATAAAAATAAAATGGAGATTTTATAAATGGCTATTACAAACTA
TACAGAATTTGAAAAGTTATGCCCTAAAAATGGTGAAATTGCAGATCAAGATGTCCTAGG
GAAACCTAGTTTACAATTAAAAAGGGAACTTGATACTGTTATGTCTCAAGTGAATTCAAT
TATTGGTATTACTGATCCATCAAATTGGGATACAGGCACAACATATACACAAAATCAAAT
AGTAAAATATAACAATTCTATATATGTTTCTTTATCAGATGGAAATAGAGGGAATCAACC
AGATACAAGTCCATCAAAATGGAAAAAAATAAGTGGAGGTTCTATATCATCTTCTGTTAA
TATAACTGTTAGTTCAAGTGATTATAATACTCCAGTTACAGAAGTTTCCGATAATTCTCT
TTCATTAAAACCTTCAAAAGTATATGTTAATGGAAACCTTATTCCAACAACAAATTATAC
ACATGATAGTACTTTAACAAAAATAACATTTACAAATGAAATGTCAGTATATAAAAATGA
TGTTGTTACAGTAGAATATTAATAAAAGTAGGATATATCCTACTTTATATTTTTAATGC
ATTATTTAAATTCTTCTTTAAAATCATCCAATTAGTTTCATTTGCTAAAACTCTAATATA
TTCATTAGCAGTGCATAAATTAAAATAATATGATTTTTTATTTAATGAAAATGTTAGTGT
TTTTGTTATATTATCATATTTATACTGAAATGGAATATTTTTTCATTTTCAACATATCC
TAAAACCCCTCTTTTTACTTCAACAGGTGTTTTATCAAAGCATATAATATAATTTTTAT
AATAGTTATAAGTTTATTACCTTTTAAGAGTTTTTGTACCTCTTTTTGGAGTAATTTTGA
CATAAAACAAAAAACTAATGGTTTTTTTTGATGATATAGTTTTTTTAAGTTCTTTAACCAT
ATTTTTTTCAACAAAGTCATTATAAACCTTTCTAATAAATATTTTAAAATATTTATTAG
AAAGAAGGATATACAATGGACAAACAGTTTATAAAAGAAATTAATATGCTAATTACATAT
GAAGATTTAAATGTGTTTCATGAAGTATTAGTTGAAAGTTTAAAATATTATAATAGCTAA
GGTATTTTTAAGGAATTAAGTAATACAATTCTCTAAAAAGGAGAATTGTATGAGTATAAA
GCATATAATTTCAGATAATACATTTGGAGCACCAAAACCTGGATTTGCTTTGAAAAGCAA
GTTTATATGTGATAACTATAATGAACAGTTAGAAAACATAAAAATCCCAGTTGATAAATT
AGATGAATTACTAAATGAAATAAAAACATTTTTAAAAACTTCTTATTATGAATGGGATGG
TATTGAAGGTGATAAAAATATATTTGTTTTAGGTTATCTAACATATATATTGAAATAAC
TTATAGAATAGGTAAAAGTGTTCAGTTAGATATGTATTCAAACAGTATAGATTTTTTAAA
AGGATTCTATAACAATATTTTAAAGAAATATATTACTGGTACTGATGAGTTATTAATCAA
AATAAAGAGTTTCTATGAAGAAAAAGGGGAATTAGTATATGTAGATTCATCTAAAACTAA
AGATAATTATAAAAATATTGATTATGATTATTACCCTTTTCTAGATTTAAATGAAATGTT
TATACAGTTTCTATTTGCAAATAGCAATATTTTAATATTATATGGCCAACCTGGAACAGG
GAAAACAAAACTTGCAGAATGTTATTTAAACTTTTTGTTAAATTTGGATTATAAGAAATA
TAAACATCTTGAATTAGAAGAAAAAGTATTTGATAAGTCAGATGATGATGGTAATTTCAT
AAATGTTGCAGTTGTAAAGAATGAGAGTTTATTAGCTGGTGATGCTTTCTGGAATGAGTT
ATTAGCAAATAGGTATAATTTAGTATTATTTGCCTAGATC
TGATATTCAAAATGGTATAGATGCACAACGAAATCAATTTATGTCACACTTTTTATCATT
TACTGAAGGTATAAATAATGATATTACATGCAAAACAAAGTTTATAATTACAACAAATAG
AAACATTAATGAGATTGATCCTGCATTATTAAGAGCAGGTAGAACATTTGATATATTAAA
CCTAAGAACATTGACTAAAAAGAAGCCTTGAAAATATGGGAAAACAATGGTTTACCTAA
AAAATCATTCAACAAATTAATAAATGATAACATTCTTCAGTGTAATTTAAGTAATATTAT
AGAAGGAGAAAAATATAACATTGCTTGTAAAAATAATTTTAAAAATTATCTAAAAGAAAA
TGACATATCACATATGAAAAATATAAACAATAAAAGATAGGGTTAATTTAGTGAATTAA
ATTAAGATAATTTCAAGTTAATGTTTGATATAATACAATTAATAAAGGTGAAAGGAAAAT
AATGACAGACAATAAAATTGTATATATGGATAATGAAATAATAGTATTATTTAAACCTGC
CTCACCTTATAACAGGTTCATTAACATCATTTAATAATACAGTTAAAGTCTTAGAAAATA
ACAAAATTGTTAATAAAGAAATAGTGTATAATCAAACATTAACAAAACAAATAGATGAAG
CTATTCAAAATTCAATCGATGAATTTACTAGAACTGGTGGAAAATACGCTAATAAAATAT
CATTAAAGATTGACAAAGATAACGGTATAATAACAATATCAGACAATGGTAGGGGATTAC
CAATAGACACATATGTTATGGCAACTACCAAGTTTAGAACATCAAGTAACTATACCTTTT
TAGAAAAAGAAAAAAAAGATAGAATCACAATAGGTGCGCATGGCATAGGTTCTAAATTAA
TACCATTGTTTAGTTCTGAGTATCAATTAACAACAATTACTCTTGAAGGGAATAGAGGTG
TTGTAAAATGTTTAAATAATATGTCTATAATAGAGCATAAAGAAGATAAAGCTCCTGCTT
CATCAATACATGGTGTTACAATTAAGTTTAAACCCGATTTTGAAAGGCTAGAATTAAAAG
AAATCAATGATGACTTAATAAATCATATACATGCGTTACTTATAAACATAGCTTATTCAA
ATCCTGGTATAGAATTTACATTTCAGGGAAAACTAATTAAAGTAAAAGAGTTTAAAGAAT
TTATAAAATATTACTCTGATAGTTTCTCAATATTGCAAAGTGATGAAAACTTAGAACTTG
```

FIG. 12B. Continuation of (CJLB-7 [organism=Campylobacter phage CJLB-7] complete genome)

```
CTATATTTCCTACTGATGAGTATAAGTTTGTTCATATTGTAAATTCACTTGATTTAAATA
AAGGTGGGGTAGCATTAGATTATATTTCAAATAATATTGTAAATGCTTTTGGTAATCGTT
TAAGAAAGGGATACTCCAAAATTACAAATACAGCTGTAAAAAGCAGGATAGGTGTAATTC
TGATTCTTAAAAATAAAAGAATTTAAGATTTGGTGGAGGCCAAACAAAAGAAGAAATTA
AGAATACTATAACTGAATTAGGAATACCTACACTAAAATATGCTGACTTTGCTGAACTAT
TATTCAAAATACACACATTAAAGACCCAATAATTGAGTTATATAAAGTTCAACAAGAAT
TAGAAAATAGAAAACAAAATACTTTTGAAAGAAAAGAAGCTAAAGAAAGATTTAATCCTA
AATTTACTAAACATACTAAAGATCCTAAATTTATGTATATAGCGGAAGGAGATAGCGCAC
TTTCTTCTTTAATACAAGCAGTAGGTAGAGATTGCAGTAGTTTCTTACCTTTAACAGGTA
AATTACAAAATGCTTTAAAATGTTCTACAGCACAATTATTAAAGAATCAAAGAGTTATGG
ATATTGTAGAAGCTATGGGCTTAGGGTTACCTGAAACAAAATATGAAAACATGGTAATAG
CTACCGATGCTGATTTGGATGGAAACCATATTGCATGTTTAATTACAGCACTAGTTTACA
AATTACAGCCAAACTTACTAACAGAAGGTAGAGTATATAGATTAAAAACACCTATTATCT
CAGTGTTACAAAATGATAAGTTAATTAGATGGTATTATACATTAGGTGAATATCAAAAAG
ACCAAGATAATTTACCTAAAAATGCTGAAGTTATATACATGAAAGGGTTAGGAAGTTGGT
CTGCAGCTAATTATAGAATAGTGTTTGCAAAAGATGGTATAGATAACTGCTTAGAAAAAA
TTGAGTGGAAAGATAATGATGAAAAAGTTCTAGAGCAGTGGATGTCAGATAATGGCATTG
ATTTTAGAAAGCAAATATTAAGTACAAAATCATTTAATATTGAAAACTTATAGGCCTTCA
GTATGACAAATCAAGAGAAAATAGAGTATTTACATACTCTAGGCTTTCAAGTAATATCTG
AAAATCTAACTACTAATTTAGTAGTAAAATGTTCTAAAGAGCATGTGTTTAAGCGAGAAT
TTTATGATTTTCAAAAAGGATATACAGCATGCCCTACATGTGAAATAGAACAAAAAATAA
CTTTTTTAAACAGTTTAGGTTTTGAACCTATATCTGAAAATTTAGGAAAAAAGCTAAAAG
TGAAATGTCAAAAAGGGCATGTTTTAAAAGAACATTTGGGAGTTTTAAAGATGGTATTT
TAAGCTGCCCTGAATGTGAGAAAAAAGAGAAATATGGCTTCTTAAAAGAATTAGGCTTCG
AGATTGTGTCTAATAATTTAGGCACTAACTTAGAAGTAAAATGTGAGAAAGGTCATATTT
TTAAGCGTCCATATAAGAGTTTTAAAAATGGCCACATTAATTGCCCTATATGTGAAACAA
ATAATAAACATAGTTTTATTGAAAATTTGGGTTTTGAAATATTATCTAATAATCTTACTA
ATGATTTAGAGATAAAATGCCAAAAAGGTCATATTTTTAAAAGAACATTTGGGAGTTTTA
AAAATGGACAGCAATGCTGTCCTATATGTGAAGCAGAAAATAAACATGCTTATTTAAACA
GTCTAGGGTTTACAATTATGTCTGATAATTTAGCTGATAATTTAGAAGTAAAATGCCAAC
AAGGTCATGTGTTTAAAAGGACATTTGGCAATTTTTCAAAAGGTCATCATTTGTGCCCGT
TTTGTTATCCAAATTATAGTACATTCGAGCAAGAAGTTAGGGAATTAACAGGTGGAACTA
ATAACTGGGAAATATTGAATGGAAAAGAACTAGATATTTATTTACCAGAATACAACTTAG
CAATAGAATGTAATGGTGATTTTTGGCACAGAGAATCAATGAATAAAGATAAGAAATATC
ATTTAAATAAAACAGAAAAATGTAAAGAGAAAGGTATTCAGCTTTTACAAATATTCGAGT
CATCTTGGATAGAGAAAAAAGATATATGGAAGTCAATTATTAATAATAAACTAGGGAAGT
CTAAGAAGATAATGGCTAGAAAATGTATTTTGAGAGAGGTATCTAAAAAAGAAGAGAAAG
AGTTTCTGGACACAAATCATCTTCAAGGCTTCACTGGATCAGGTATTTGTTATGGACTTT
ATTATCAAGATGAATTGATGTGCTTAATGTCATTTGGAAAACCTAGATTTACAGATAAGT
ATGACTGGGAGTTAATTAGGCTATGTACTAAGAAGAACACAAATGTAATAGGTGGTGCCT
CTAAATTATTAAAATATTTTCATAAAAATCACCCAGGCTCATTAATAAGCTACTCAGATA
GATTATATTCTGATGGAAGTATATATTTGAAACTAGGATTCACATTTAGTCACTATTCTA
AACCAGGTTATTTTTATTTTAAGAATAATAAAACATATTCAAGACAGCAATTTATGAAAC
ATTTGTTAAAAGATAAATTAGAAATATTTGATCCAAATAAGACAGAATATGAGAACATGG
TGGAAAATGGATATCATAGAGTATGGGACTGCGGTCAAGGTGTTTGGGTTAAGGAAATTT
TAAGTTAAAATGTTATATAATATATAAAATGAAAGGATAGAAATGGATATTAATACATTA
TTTAATGATAATTTATGTCAATATGCTTCATATGATAACATTAGAAGTATAGCAAGCTTA
ATCGATGGGTCAAAAATTCAGGTCGTAAAATAGTTTATTTTAGTAAAGACTTGACTAAT
TATAAAAAAGTTTCAACATTAAAGTCAGAAATAGCATCTAAATCACAATATTTGCATAAT
GAAGATATTTTACCTGATATAATTACAAATTTTGCAAGAGATTTTGATTGTGGTCCTGTT
ACATTACCATTATTTAAACCATTATCAGCTATAGGATGTAGGACTTCACCAACATCAGCT
CAACCAAGATATTCTTCTATAAAAAAATCAGATTATTATGATCTTTTATTCAATAAAGAC
GATGAAGAGATTTTAGATCATCAGTATTTTGAAGGACAAAAAATAGAACCAAAGTTTCTA
TTACCTACTTTACCATTAATATTATTAATTAACAATAACGGTATGGGTGTGGGTTTTGCC
CAAAATATAATGCAAGAAGTGCTGAAGATGTTAAACAAGCTATTAAAGACATTTTAGAT
AACAAACAACCAAAACCACTAGTCCCATATTTTAAAGGTTATAAGGGTACTGTTGAATTA
CTTAATACAGAACATGGTAAAAAACAATGGAAATTTAAAGGTGTTTATGAAAAAATAGAC
ACTTATAATTTAAAAATAACAGAAACAACACCTTATGCTACTAATGAGAGTATGTTAATA
CATTTTAACTCATTAAAAGAGAAAAAATAATAAAAGATTATAAAGACTACTCACTAGGT
GACAGTTTTGAATATGTAATAAATGTAAGTGGAGATTTTTGGAATAATCAAAATATTCAT
AAATTATTAGGGATAGAAACAACTGATACCGAAAATTTTACTTGTGCTGATAGAAACAAT
TTCATTAAAACCTATAAAGATGAGATTGGGATGTTAAAAGAATATATAGATGTTAAATTA
GAGTATATACAAAAGAGAAAACAACATAAATTATCTAAATATTCAGACCAAATTGAACTG
ATTAATAATAAAATAAAATTCATCCAAGCAGTGTTGGATAAAAAGGTTATATTTGAAAGA
AAGAAAAAAGAGGATATTATCAAACAAATAAATAATATAGGTATAGTTGATAATATTGAT
ACACTTATAAAATATGCCTTTATATTCATTAAGTGAAGAGAGCATAAATAGTTTGAATGAA
```

FIG. 12C. Continuation of (CJLB-7 [organism=Campylobacter phage CJLB-7] complete genome)

```
CAGTTGAGTGGTTTGCAACAAAGTTTTAATGAGTTATCACAAAAACACGTTAAAGATATT
TGGTTGGATGATATAAATAAATTATTTGAAAGATTATGATTGCATCATGATCTTGATATA
TTCATTAATAAAATGAATATATCAAGGTTATGGTAAGCTTATTAGGTTAACTTTCTCTTT
ACTTTTAAAGAGACCATAGCCTGAGTAATAATATAGAACACATAAGGTTAATACGCAGAC
CTAAAATAAGGTCCCTCCTTTCAATCTTCAGATATTCTTAACCTGGTGTTCTCTAAATAT
AAAAGGAATGATATGAAATTTAATTGTAAAAATTTTGCAAAAGCGTTATTTTACTCAAAA
GATATTAATTATCTTATAAAATTATTCAAATATGCCAAACAGGAAGATAAAAAACAAGCA
ATGCAGATTTTATTATGGGCCAGAGATGTAAATGGAGGAAATATAAAAAATTCAATTTTA
CTTCTAAAATATATCGCTGAAAAAACAAATAATATTAATGACATGTTTTTAACATCTGTT
GTAAAATATGGCTGTTTTAAAGATTTAAATGAGATGTACAAAGTTGCAAGTAATTCTAAC
AAAGAAAAAATATTGGCATTTTATTCAAAAGAGTTGAGATTAAAAAACCAGTTAGCTGCA
AAATGGACTCCAAGAAAAGGACCATTATTTTATGCATTAGCAAATAGTTTGTGTTTAAAA
ATTGGTGACTTTAGAAGATATATCACAAGTTTATATATTTCAGTAGAAGCAAAAATGTGT
GATAACATGTGGGATAGTATATCATTAGATGAGATACCAGAAAGAGCTATAAAAAAATAT
AAAAAAGCATTGGAAAAAAGATTGAAAATCACTATTTATTGTAGGAATCCAAAACAAAGA
AAGCTAAAGTTTAAGGGGTGTGAAAAACTACTAAAACAATATTATTAAAATATTGAAAAA
GCTATAATGAAAAAGCTAACATATATTGTTATTTTTTATGCATTGTATTTACAACAACA
TCACAATCAGTTATTTTTCATGCTAAATATAATTTTGAAGATATTATTCAAGAAAGGTTA
TCATATTTAAAACAAATATGATAAACCACATTTCAAATATAATAACAAAAACGCTACT
GAAATAACAAACTACATATTTGAAGTATCTTTAAAATATAATCTAAATCCAGTTTTTATA
ATGTCGTTAATACAATCAGAATCATACTTCAAATATAAAGTAAAACATAAACATAATAAT
GTTAAGGGAATAAGTGGAATAAATTACAAAATGTGGAAGATGGTATTAGCCAAACATAAT
ATAAAACATATAAACTCGTTAAAAAATCAAATAGAAGCTACTGCTATTATAATAAATGAT
ATTAAGAAAAGATATAAAACTAGTGATGACTTAGAAATATTACATTATTACAAGGGAAGG
GGGTATGACAAATACTTGAATAAAAGTGGGTTAGATTTAGCCCAGTATAGTTATAGCATG
TATATAAAAAATATTAAAATAATATATAACTAAGATAATCTTAAGATTAAATGTTGTATA
ATATCAAATATAATAAAGGAGTTAGTAATGACTATAAAAAATAAAATTAATGATATTAAT
GAAATACTACAGTCTTATGTTGGAGAGTTAGTATTATCTGATATTGATACTCAGAAAATA
GTAGAAAATCTAACAGAATTGGAAACTATTATAAAAGATGCTATTAATAAGCAATCAAAT
AATAGTAAATTAATATTAGGATAAAAAATGAGTTATAGTTTTGAACAGTATTGTAATAGT
AATAATTTTAATAAGTTTCAGATATACTTAATAACACAACTTAGCTACATAAACAATAAA
AATGTTGTTGCTATACAAGATCCCGAGTATATGGATGTATTTAAAGCTATTAAACAAGAG
TATTATAAAGCATCATCATATAAACACAGCGATAAAGAAGAGGTAATACCTGAGCATTAT
ACTAAACTGGCAATAGAACCCATTGATTTTATATATAAAAATAATTTGAATTTTGTGAA
GGTAACATAGTAAAATATGTTTCAAGACTTGGCAGTAAAGATGATAATAAATCAGAGTTA
AAGAAAATATTTTCTATTTTGATTATTTGTTGCATGGTAATTATGATTTGACTAAGAAA
ACCTTTAACTAAAGGTTTTTCTTAACATAAATTATTATATAATAACTAAAATTAAGGAAG
GTTATATGAAATATGTATTTATAGGTGGTGGTGTAGCAAATATATACACTATTTGTTATG
GTATCATGAATAATATTATTAATATGAAACATGATGAAGTAATTGTTATTGAAAAAGGGA
AACATATTAATAATAGGATACCTACAATAGATATTGTAAATGGTCTTCTAGGTGGTGGTG
CATTTAGTGATAATAAAAATATATTTTCACTACATGATGATCAACCTATATTTGAGTACA
TTAATAAGCAACAAGTTTTAGAATACTATGATTTTTTAAAAAATAAACTATTTAAAATGT
TTTTACCAGAAAATGCTTCTATACACATAACACAACCAGTTGAAACAGGATCAAAGTTTG
TAAGTGGTTATGGTAATATAGCTTTAAAACAATCTGAGTGTTATCATATAGGTTCAACTT
TGGGGCTTGAAATGTGTAAAAACATGATAAAATGGCTTGAAAGTAAAGGTGTTACAATTT
ATTGTAACTCTACATATATTCCTTCAAAACTTGATAAATGTATAACAGTAAGAGATACAA
ATGGTATTGAATCATATATAACTTATGATAAACTTTTTATAGGTCTTGGTAGAAGTGGCA
TGAAAGATATTAAAGAAACCTTTGAATTAAACAACATTAAATCCGTTGCTGACCAAATTC
ATATAGGATTAGGTTTGAGTGTGAATATAATAATACAATTCAAGAGTTAGCAAATAATA
TTCAATATGATTTTAAGTTCTCTAAGAATATTAACAAAAATCATCTTAAAGAGTTGAGAA
CATTTTGTGTTAATCATGGAACAGCAGAAGTTGTAACAGAAAAAGTAAAAGGATATTCTA
TTCCTATTAGAGAACAAGCAAATGGACACGCTTATGGATTACATGTAAAAGACAAATGGA
CGGGAAATCTAACTGGGCTATTTTAGGTTCTTTTAAAAATGTAAATGTAGAAGATTATT
TATCACAAATAGAAACCATTACTAATGGTAAAATTTATGAATTAAATCAGAACTCATCTT
TAGAGTTTTTAAATTGTTTTGATAACTTAGGTGACTCACTTTCAGAATTTATTAAGGAAC
TTTGTGATATACTACATATAAAGGAATGGAAAGGATATTTTCCAGAAATAAAAATAATAG
GTCCTAGAGTTAGTTATAATAATAATTTTACAGTACAGGATTTTAGCAAAAATATCTTTT
TTGTAGGTGATTCAGCTATTACAAGAGGTATTATTCCAGCTGCTGTAACAGGCATTCATG
CATTATTAAATTGAAAGAGGTAAAAATGAAAAATATAGAAATTTTAAATATGGTTGAAGA
GTTGGTGAAATTAAACCCAATATTGTTGATTAGTGAAAACTTTTCTCATACTTATGAATT
ATTAAAAGAAAATGTTAGAGAAAGTAAAAGTATAGAAAATAAAAAAATAAAATTGAACTG
TATATCTGTTAAATTAGATGATGATACAAAACTACCATGCTATGGGACTGTTTTATCAGT
ACTTATGAAGGATAATTTAGAAAATATAATAAATAAAAACCCACAATCATTACTTGAAGT
ATCTTTTAAAATATGTATTGATGTACTACTTGACTTAATTGATAAATTTATAGAAATATA
TGATTTTAATTATGAATCACTACTTTTAGTTAATAGGATAAAAAATATGTGTGTATTAAAA
ACATGGCTAGAAGACAGTAATGCAAAATTACCAGAAATATCAGTAATGGGCTCTGCTTGT
```

FIG. 12D. Continuation of (CJLB-7 [organism=Campylobacter phage CJLB-7] complete genome)

```
TACGATATGTTTTCAATAGAAGATAAAACAATTCAACCTGGTGGGTTTGAGTATGTTGAA
AATGGTGTTAGATTAATAATTCCAGATGGATATTATATAAGATTTAACACTAGAAGTAGC
CTAGGATTTATAAAAGATTTATTTGTTTATCCTGGTATATTAGATGCTTCTTGGAGTGGA
AATTTAAAAGTAAAAGTGTATAATTTTGGTAAGGAACCATACACTATAAAAAAAGGTGAT
AAGTATTGTCAGTTTGAGTTATTAAAATGTAATGAAAGTAAAATAGAAACATATCAAAA
GATGATTTTGATAACATTACAAAAAATTTAGTTAGAGGTAATAACGGTGGATGGGGCAGT
AGTGGAAAGTAAAACAGAGCTTTTTAATAAGCTCTTTGAGTTTAGAAAACAAAAAGATAT
GATGGATGATTGTATTTTAGATGTTATAATTGAATTTGGAAATCATATTAATATGGAACC
TGAATTAATAGCATCAGAATTGTCTGACTATGCAATATTCAGGGATATTGTTGAAAAAGA
CTTAAAAAAATTCAAATTTACAAGATATGATCTAAACCAAAGCGACATAGATATATGGGA
GTAAGGAATACTGCATGAAATTGCACTATTATGATATTTATAATATTTCTAATGGAGTGT
TTCTTACATTTCAAAAAAACTTAAAAGAAAAATTATTATGTGTATCTCATAGCAAAGATA
TAATGAATAAAAAAATAGGTTTTTATCCGTTAAACTTTTCTGATAGAGGTGACTTCATTT
TATTGTGTGTATATATAATGTTTAAATACAGTCCATCTAGTATTTATGGTTTATGTGATT
ATTTAAGAAATTACAATAAAACAGAATATGAGAAGTTTAAAAACACAATAAAATTCTATA
AAAATATAATAAAAAAAGACATAACATTATTAGAAGAGAAATACAAAAAACCGATGTTTA
AAGAAGTAATGCGTGAATATAATAAAAAACAAATATCTTTCGTTACTGTGTATTGGTATC
TAATGTTATATAATATTAAAGATTTTAATGGTATAAACAATTCTATTATATGTGAAAGTA
TTTTGAATGTTTTTAAGTTTTTAAAGTTTACAGATGAATCAAAAGATTACATAAAAACTG
TATTTAAACAAATTGAAGGCGAAGTATTATAGATTAAGGTAATTTTAAGTATAACTATTA
TATAATAAGTAAAAAAGAAAGGATTGATTTGAAAAATATAAACGAAAAAGAATATATATG
GGCTGAAAAATATAGACCGTCTAGAGTAGATGATATGATTCTACCAGACCAACTTCATTC
AAAAATAAAAGAATGGATTAATTCTGGTGAAATACCAAACCTTGGTTTTTTAGTAACAC
ACCTGGAACTGGAAAAACTTCATTAAACAAAGCAATATGTGATGAATTAGGTGCAACTCA
TTTATTCATTAACTCATCAAAAGAGAGTGGAGTGGATCTTGCTAGAAATAAAATTACATC
ATTTGCAAGCAGTGTTTCAATAGATGGTTCATTAAAAATTATATCTTTATCAGAATGTGA
TGGGATGACAAATGAATTACAACGCTCAATCCGTGATATAATAGATGAATATACCCAAAA
TTGTAGATTTATATTAACAGCAAATTATACTGATAGACTAATAGAACCTATTTTGACTCG
TGTTACATGTATAGACTTTGATAAAGAGTTTAATGATAATAAAACTGAACTAGGTGTTAA
AATACTTGATAGGTTGGAATTTATATTACAAAATGAAAAAGTAGAATATGATAAGAAAGA
TTTACAGAAACTTATTCAATGTTTTTATCCATGTATTAGAGATGTTAATAGTTATGCA
GCATAATACTGTTAATAATAAATTAGTAATAGATGAAAAGTATTTGAAAATATTAATAA
TTATTCCAATTTAGTCGAAGCTTTAAAGAAAAAGATTATACTGAAGCTAGAAAAATTAT
AGCACAAACAGTAAGTTATAGTGGTTTTTACCAGTATTTGTTTAAAAATGTTGATAAATT
TTTTGAGTTAGAAAGCATACCACAGGCTGTAATGCTTATAGAACATTATAGTGATCATGA
TAGGACAAGTAGAGATAGAGAATTATGTCTAAGTGCTTTAGTAGCTGCTCTTATAAAATA
CGACATAAAACATAAATAATTGAAAAGGATATAAGTATGATATACTCAAAATTTTTAGTT
GAATCTATAAACGATTTGAAAAACAACGATAAGAACATTAGCAATAATATTACTAGTTTA
ATACTTCCAATAGCTAAAGCTAATTTAAAGGTAAATGTTAGTTATGGTAAAACTATATTA
GACAGTTATGAATTAAGTTCTATAGTTAATGACTCTGATATACAAATTCTGATATCATTC
TTTGTTAAAGAACGAACTGCTCGAATAAGAATAAATCTAATAAAACCTTGTATAACAGTG
AGAGTTACTGGTATAAAAGAAGATATTTTAAATGAAATACGAAAAGTAGCAAACATA
AGTTTTGATGGAGAAAAATACCCTCCTATTATAATTAATTTTGATGAAAAATCACTGCAA
AAATTAGCAAGCGTTATAGCATCAAAAGTTGATGATATAGATAATATCATTAAAGATGAG
CTATATGATTGGGAATATTATGAAGGTGACATTGGTTCAAAAGTAAGAGTTGGTTATGAT
GATAACTCAGCTATGAAAATAAAAATTATGAAGGTGAATGGGAAATTGTTATTGATAAC
TTTGGTGCTGAATTTGATTTAGAAGACTCTGATTTATATGTAAAACCTAAAAAATAAACA
TGTTTTGATACTCGTTTTTTCGAGTATCAAACATTTAAAGGATGCAAATGTTTAATTTTT
TATTTTCATTTATAAAGTCAAACATAATTTATATTTTGTTAGGATCTTTGTTAGCTTTTA
CTGCTTATAGATATATTTCATTAGAAAAATCAAATGCTATATTGATTGAAAATGAAAAAC
AATTAACACAAAATATAAAAAATTCTAAAAAGGAATTAGAAACACTTAAAAATTATAATA
ATCTTACTATTGAGGTTTTTAGAGAAAAAGAAGTAAAATATAAGGAAGTTCTTAATAACA
TAAAAAATGTTGAGACTAAAATACAAAAATTAAAGCTTATTAGAAAGGATGAGATGAAA
CACAGTATATTATTGTTAATTTTTAGTACATTTATGTTTGTTGGCTGTTCAACAGCAACC
AAAACAATAACAATTACTGAAAAGAGTATTTAAAATATCCTCTTGATGAAAAATACATT
CCTCATAAAATAGGTGTTAAAATCATGAAACAGGAAATTAATGGTAAGAATATCTGTTA
ATATCTCCAAATGATTTATACTTATACACAATCAATATAAACATCTTGAATTTAACTAT
AATAATCTTTATAACTCAATAGAGAAGTTTAATTCACAAGTTAAGTAATATTTAAGAATA
TTTGTAATATAATATTCTTAAATTTATTATACGAAAGGAATAAAATGGTTATTATTAATG
ATGATAATATATATTTTGTTAGTAAAATAGACTCATTTAGTGTAATTAAAGACAATTCAT
CTAGTATTGTATTTATTAAATGTGGGCTACAAGAGTACAAGTTTACAATTAAACATAAAA
CATCAAAAGAAGTATATAATTTTATTATGGAGGCGATAAATGAAGAAAATGTAAGCCAGC
ATCATGTTGTTATAGATATTAAGAAATTTAGAAAGGATTAAAATGTCATTAATTAATAAA
TTATTAAAAAATAGCACTCTAAAAGATAGAACTAATAAACTTGAAGATAGTAAATATTTT
GGTAAAACTGAATTTGTTGAAACACCAGTACCAATGTTAAATCTTGCATTAAGTGGTAAA
ATTAATGGTGGGCTAACACCAGGACTAACAGTAATTGCAGGTCCTAGCAAACATTTTAAA
```

FIG. 12E. Continuation of (CJLB-7 [organism=Campylobacter phage CJLB-7] complete genome)

```
AGTAATTATGCACTTGTAATGATGGCTTCATATTTGCAAAAATATCCTGATGCTGTATGT
ATTTTTTATGATTCTGAATTTGGTATAACTCCAGACTATATGGAAAACTTTGGTATTGAT
ACAACAAGAGTTATCCATACACCAGTTATGAATGTTGAGGAATTAAAATTTGATATTGCA
AATCAATTAGAAAATATCGAAGATGGTGATAGAGTTATAATAATTCTAGATAGCTTAGGA
AACTTAGCAAGTAAAGCTGAAATAGAAAATGCTATAAATGAAAATCAGTTGTAGATATG
CAAAGAAGCAAACATATCAAGAGTTTGTTTAGAATTGTAACACCTTATTTGTCTATGAAA
CAGATCCCTATGGTTGTTGTAAATCATACTTATGATGATATTGGATCTTTGTGGGGTGGT
CAAGTGGTATCCGGTGGTACTGGTGTAATTTATAGTGCTGATACTATTTTATTATTGGA
AAAGCACAAGAAAAAGATAGTAAAAAGAATTTACAAGGTTGGCAATTTACAATAAATGTT
GAAAAATCAAGATTCATCAAAGAAAAATCAAAAATACCTATTTTAGTTACTTTTGATAAC
GGTATAAATAAATGGTCAGGTTTGGCTGATCTAGGGCTAGAACTTGGATTCCTACAAAAA
CAAGGTGATAGTCATTTTAATCCATTTACAGAGAAAAGTTGTATTTAAAAAGTGCATCA
CAAGAGCAGCTTGATGAGTTCTTTAGTGAGCTACTCTCTAATAAAGATTTTGTAGATGCT
CTAGAATATAAATATTCTTTACTGAATGTTACACCTAATAACGAAACTACCGAAAATAAT
GTTTAGGGCGTATCCCTAAACATTAATATGGGGAACACACATGACTAACCACGAAAAAAT
AATATTTTTAAACAATTTAGGATATAAAGCTATTTCTGAAAACTTATCCAAAAGTTTAAA
AGTTGAATGTAAACATGGCCATGTTTTTGGAAGAATGTTTGATGATTTTAAAAGAGGTTC
TGTAAATTGTCCTGAATGTGATAGACTAGGAAAATTAAACTATTTAAATAATTTAGGTTA
TAAAGCGGTTTCAGAGAACTTAGCAGATAGTTTACATGTAGAATGCCCAAAAGGTCATAT
TTTTAAAAGAGCATTTGGTGATTTTAAAAATGGTAAAATTAATTGTCCTAAATGTGATAT
TCGAAATAAATTAGATTATTTAAATAATTTGGGATATGAGGTTGTTTCAGAAAATCTATC
TAAGGGATTAGAAGTAAGATGCTCAAATGGACATGTTTTTAAAAGAGCATTTGGGAAGTT
CAAAGATGGCTTTACAACTTGTCCAAAATGTAAAGATACTAGTAAAATAAATTATATAAA
CAATCTAGGATATGAAATAATTTCTAATAATTTAGCTGATGAATTAAAAGTAAGATGTAT
ACAAGGACATGTTTTTAATAGAACTTATGGTAACTTTAAACAAGGTAAAATAGTATGTCC
AATATGCAACCCTTCCACTAGCTCATTTGAAAAGAAATATCTGAATTATTAGGTAATTA
TATAAGCAATGATTATTCAGTTTTAAGTGATAAAGAACTAGACTTCTATTTACCAGAACA
TAACTTAGCCATAGAATGTAATGGAGACTACTGGCATTCTGAGCAAATGGGTAAAGATAA
AAATTATCATTTGAATAAAACACTAAAATGTGAGAGTAAAGGTATCCATCTTCTACACAT
TTTTGAACATTCATGGTACAATAAGAAAGAAATATGGACTAGTATTATAAACAACAAATT
AGGAAAGTCTGAGAAAATAATGGCTAGGAAATGTGTTATTAAAGAAGTACCTAAAGCAGA
AGAGAAAGAATTCCTAGATACAAATCATCTCCAAGGATTTACTGGTAGTTCTATCTGCTA
TGGACTCTATTACCAAGATGAACTAGTTTGCCTTATGAGTTTTGGAAAACCCAGATTCAC
AGGTAAGTATGACTGGGAATTGATAAGACTATGTACTAAGATGGGACTAAATGTAATAGG
TGGTGCTTCTAAATTACTTAGCTATTTTCATAAAAATAATAAAGGAAGCCTCATAAGCTA
CTCAGATAGACTATATTCTAATGGATCAATTTACAAACAATTGGGATTCGAATTTAGTCA
TTATTCTAAACCAGGTTATTTTTATTTTAAGAATGGTGTAGTTTATAATAGACAACAATT
TATGAAACATAAACTAAAAGATAAACTAGAGAAATTTGATCCAAACTTGACTGAATCAGA
GAATATGAAAGTAAATGGGTATAATAGAGTGTGGGATTGTGGGCAAGGTGTTTGGGTTAA
GGATAATCTAAGTTAAAATATTATATAATGTAAATAAAAAAGGATGCTTATGAAAATTAA
AGAATTAATATGTAAGTTTATAAATTTTAAAACTTTACAGAAAATTATAACTATAGATAG
ACAGTTTATAATTGAAGGACAAAACGGAATGAAATATAGTGGTGATTTTTCTTTGTAGA
TGAAGGTGGATATATTTGCAAAATAAGTGATAGCAGTTGTGTTGGTACAATGGTAAAGAG
TAGCAAATGAAATTATTAGTAGCTGGTAGCAGAGATTTTAATGATTATAATCTATTGAAA
AATAAAATACTTGAATTAAACATACAACCATCAACAATTGTATGTGGTATGGCCCGTGGT
GCTGATATGTTAGGTTATCAATATGGTATTGATAACTCTCTTAAGATAGAAAAATATAAA
CCAAACTGGAATCTATATGGAAAATCAGCAGGACCTATAAGAAATAAATTGATGGCCGAT
AGTTTAAACAAAGAAACAGATATGGCTATTATTTTTTGGGATGGAATTTCAAAAGGTTCA
AAGAATATGATTTCTATTTTAGATGACAAAAAAATAAATTATAAAATAGTTTATTATAAG
GAGAAAGAAATGAATAAACAGTTAGGAATTTATGCAATTATATGTTATTGTGTAATTTC
AATTATTATCAATTTTGTTAGTTTGCCTGTTGCTTTTGAAGTGTTTGATAGAATTGGAAT
ACATCTTGAAAACCCAAAAGAATATGCTACAATGGTATTTGAAACATATACAAATATACT
TATATGGTCATTTATAGTAATTTGTTGTATTTTATTACTTGTTACCAACAAATATACAAC
TATATTATATAATATAGTTGTAAGTCTTTCAATTACATATATTGTGTATGACTTCATTTC
AAATTGTATTGAGTTATATAGCATGTATAATTTAATATATGTTGAACAGTTTTTGATGT
TAATGAGTAAGGATATTACAATATGTTATTGAGTAAAACCAATTTAGTGACAGATAGATC
CAAGGAAAATTTTTCTTTGGAGAATACTCAGGTTTTCAAAGATATGACTGGTATTCACA
CAATAAATTAGAAAGTTTAGATAGAAAACAACAAGCACAATTATGGTTTCCAGAAGAAAT
TAGTATGATTCATGAACCAAAGTCATTTATAGAATTGCCTGAGCATAATCAAAGACAAAT
AAAAGCAAATTTAACTTTTCAAACATTAATGGATTCTGGCCAAATTAGAGGTTTGGACAA
TATATTAATACCACTAGTAACATCATCAGGATTAGAAGGTTGTTTAAAAACACAGGCTTA
TTTTGAATATATTCATTCAAGATCTTATTCACATATGATAAAAGCGTATTTCCAAACCCC
TACTGATATTTTTGATGAATATTGTGAATATCCTGAAATAAAAACTAGAATTAATGATGA
AATAGACACTTATGAATTACTAGAAGGCAATTTAGAAGAAAATGATGAAATAAATTAAA
AATATTAGAAGCTTGTTTAAGAATTCAGTTTTTAGAAGGTGTTAAGTTTTATGTAAGTTT
TTTAACAACTTATATGATTAATAAATATTCAGCTGGTGGTAACAAAATACCAAATTTAAC
```

FIG. 12F. Continuation of (CJLB-7 [organism=Campylobacter phage CJLB-7] complete genome)

```
TAAAATTATAAAATTAATAAATAACGATGAAGATATTCACCTTGTAATTTTTAGTTTTAT
TATTAAAACTCTTAGAAGTGAGCAACATCAAGGATTTTCACACCTTTTTGATGATAGTTT
GTCACGAAAAGCTAGAAAAATAGCAAAAAAAGTTTACCAAGATGAATTAGAATGGGCTAA
ATATTTACTATCTATGGGTCCTATTCCAGGATTGACTATTGAAAATATTGATGGTTTTCT
AAAGTTTTTTGTTGATGATAGACTAAAAAAATGTGGCTTTCAACCTATATGGAATGCACC
AAAAACAGACTTAGTCAAAGAATTCCAAGAAATAAAAAATATAAGCAGTGAAAATCAAAT
GCTTCAAGAAGTTGATAGTATCACTTATTCAAAAGGTGTTATGAAAAAAGATACAAAGTT
AGAAGTGTATAATGATGAAATATTAGAAAATGAGTTAGAAAAAATATTGAATGGAGATGG
AAATGTTGCCAGTTAAATCACTTACAGAATTAGATGATATTAACATAAATGTTGTTAAAA
GGAATGGGACTGTTGAAAAATACAGTCCAGATAAAATGTATAAATTTTTATTAAAAGTGT
GTGATAATAAAGAATCATATGCAATGAATATTTTGTCAAAATCAAAAATAAAATTAAGAG
ATAACATTAAAATACAAGATCTTTATGATGAAATATTATCTACTACTGTGAATGAAATAA
GTATGTTATATCCAATGTATGAAAAGTTTGCAGCAAAACTATATATCATTAAATATCGAA
AAAACATGGGAGATGAAATATCTCTTGGTAATGTTTTAAGACTTGGTCTTTCATCAGGGA
TATATTCTAGTGACTTTGTTAATAATTTTTCAGAAAATGAAATACAAGAATTAGATAAAT
ATATTGATAATAATAGAGATTATTTGTTTCAAAACTATAAAGCTATTAGTATGTTTTATA
CAAAGTATTGTTTAAATAGAACAAAAACAATAAAATTAGAAACACCTCAAATAACTTATA
TGAGAGTTGCTATGTTTATTTGTATGAATGAAAATAACAGAGTTGAAAAAATTAAAAGGA
TATACGATTTAATTTCAACTCACAAATTACATACGCTACACCTATAATGTTAAACTCTG
GTATTAATAAAGGTCAGTTGTCATCTTGTGTATTGGCTAAGATGGGTGATGATTCACATT
CAATATTAGCTACAAATGATAACCTTGCAATATATAGTAAGAATAAAGGTGGTACTGCTT
GTGATATTTCAGCTTTAAGAGCCACTGGTTCTATTATAGATGGTGTTGGTGTTTCATCAG
GACCTATTCCATTTATAAAATTATTAGATTCTACAATATCTGCATGGAATCAAGGTTCTA
CAAGAAAAGGTAGTTGCTGTGTTTATTATCCAACATGGCATATGGATGTTCAAACTTGA
TAATGTTAAAAGATAATGGTGGAACTGAATCTACTAGAGCAAGAAATTTACAGTATGCTA
TTAAAATAGATGATGTATTTGTAAAAAGATGGTATAATAATGAAAACTATACATTATTTG
ATCCAAAAGATACTCAAAAATTGTTGGATAGTTTTGGTGATGATTTTGAAAAATATTATT
TAGAATATGAGCAGAAATCAAACATTAGGAAAAAATCAATAAATGCTAGAGAGTTATTTG
ATGAAATTTTAAAGTATAGAGTTGAAACAGGAAATATTTACATTTTCTTTATAGATAATG
TAAATAAACAAGGTATGCTAAATAGAACTGTTACACAAAGTAATTTATGTTGTGAGATAG
TTTTACCAACATCAGCACCTTATAAAAAAGATGAAAAAATAGTACATTATATGTGATTAA
GTCATATTTAAGGGGATTAATGGTATAATTCCCTTATTTGAAAGGAATAGTAGAATGATA
AACAAAAAAGAATTAATAAATCATATGTATTCAGAAATGTTACATAAATGTTTAAATGGA
ACTGAAACTGTTGATAACCCATATCATTTAGAAAAAACTGTATTAGATCACACAATAATG
GTATTAAATAAGGTTGAAGATTTATTTAAAAATGATAAAGATTATAAAGTTTTAATGTTT
GGTGCAGCCTTACATGATTTAGGTAAGATATTTACAAGAGAAGTAGTAACAAAAGATGAT
GGAACAGTAAAAGTAAGATTCCTTAATCATGAAAATGTTGGAGTATATTATGCTTGTGAT
GTTTTATCTAAGTTTAATTTAAGTGAAGAAGAAAATAATAAAAATAATAAAAATAGTTGCT
TATCATGATATTTATAAATATGATATAGATAAATTAAAAATAAAATTCACTTATGATGAT
TTGCAATTATTATGTAAGTTTTCAATATGTGATTCATTAGGCAGAATCACACATACACCA
AAACCAACTGACATATATAAACAGATAAGATTATTAAAACCTTATGAAACAAAACCTATT
GATATAACAAAACCAACTATAACAATGTTAATAGGTGTTCCTGGAGTTGGAAAATCAACT
TTGTGTAATCAATATGAAAATGTAATTTCAAGAGATGATATATTGATGAGTTATGGTAAA
ACAAAATTTAATTTAAATACATACTCAGAAATATGGAGTAAATTATCTCAAGATGACCAA
AAAGAAATAGATAACATCTTTAAATTTAAGTTAAATAGACTACTACAAGGTAAAGAT
ATTGTAGTTGATAAAACAAATACTTCAATGAAGTCAAGAAAGTCTTTGTTAAATTCATCA
AGTTTGATTAAAAATTACAACAAAGTTGCAATAATTATGTTATGCCCCTATAACACAATA
CTAGAAAGAATTGGAAAAGATCACTAGAAACAGGTAAAGAGATATCAAAAGATATTGTG
GATAATTTCATAAAATCTATGTGTTTACCTACATTAGAAGAGTTTGATAAAATTGCTTTT
AAATGGTCAATATAAATATTATTTACCAAATGATATGAAGGAACATAATGATACAGCTTA
ATTTATTTTGCAGTTATGTAATATTTTCTGTTGTTACTTGTGTTATATTTAATGACATTA
ATAATAGGGAATATAAAAATATGATAGTAGAGTTTATATCAATATTTATATTTTTTATAT
GTTTTTGTTATCAGTTAATTATTTATAGAAATTTTAACAGGGATAAAGTTGAAGATAATT
TGTGTTAAGGTACATTTAAGGGGATTAATAACAGAAAAACAACTATTGTAATGCTTACTC
TAAATTATAGGAGGTTTGTGAAATGACACCTGGAAAAATAAAAGAAATCTTTGAAATAGT
TTTAAAAGAAAAGAAAAGAATATACTGATGAAAGATTAGAAGAAATAAGAAAAGAAAG
AGAATATGTTGAATCTATTGTAAATGAGGGTATTCAAAAATAAAAAATTATTTGGAAGAA
AAACAATTTCTTTGATAAATTTGAAATGTTAGAAACTCCAGAAAAAATATGATACAATTG
AATATTTTCATGATTTAGCTAATAACAAACTATGGGCCTTAAAAAGACAAGAAGAAATAT
TAGATAAAGTTTCCAAATTTGATCTTAAGTTTAATTTAAGGATATTTTGATACAATACCC
TTAAAAGCTTTTAAAAGGAAAATAAAATTGATATAAAGAGCGTAAATGAAAATGAAAATGA
TGATGCTTTTACAAGGAGAAAAAGGTGATGAATGAAAAAAGTGCAAAATATATCAAGATG
ACAAAGGAAAAACAATGAAACTAAAAGATTTTGATTTAGGATTTTTGATAATAATGATA
TTATCAAAACATATTAAAAGAGATAATACTTATAAAATGTTTAAAATAGAAATTTTTAG
TAAAAACTTTAATAAAAAATTTATAAAAGGAAAGCTGAACCTGATATATCTTTTTTAAAA
GTATTTAAGTCAGAAAAAAATATGAAAGTTATCGGTAATATCCAAATTATATCACACAAC
```

FIG. 12G. Continuation of (CJLB-7 [organism=Campylobacter phage CJLB-7] complete genome)

```
GAAGAGAAAAAACAATGGAACTTTACTGGTTTTTATGATAAAAATGGTAAAAAGATTTAT
GAAGGTGATGTCATAATCTTTGATGATATTGTTCATGATACTAACAGAATTGGTGTAATA
ATTAAAAGACATAGCGGTGAATTCAGATTAGAATTTAGCAAAAATGATACTTTAGGTTTA
AAAATATTAAATGAGTCAGAACTTTTAGTTATTGGTAATATTCACGAAAATATGAATTTG
TTAGCTAGAAATAGATAAAGATATAAATTTAAAAATGCTACCAAAATGGGATAAATAGTT
TTATGCTAAAAATAACAAAGATTAAAAGAAAAATAATGAATATTTACAGTATTTTTTAA
ATGAGGAAGTGGAACCTCAAAAGGATCTAGCCAAAAAATCACTTGATTTTTAGGTAAAA
AGTTAAATGCTACACATAGTGTTTCTGAGAAAGGAAATACTTTAATAGCTACATATAAGG
ACAAAAATGGTAATAAATTATGTGATGTTAATATCACAGTAAATGATAATATTAAAGTAA
CAAAGGTTACAGATAATAAAGGGAAACCTAAACAAATTGACTTAGTTATTCACAAAATAA
ATGATATAATTGGCAACAAAATTATAGGTTATATTAATAAAGCTGGGAAAATTAATGAAT
CATCTTTAGCTGACTATGGACTTGATGTAAATGGATTTTACAAGTATATAAATGGTAAAG
AAAGTATAGTAGAAACTGATGATTTTAAAATAAAAATAACATATGATTCTGCAAATCCAG
AGTTTGATGGTGATAATGAAGAGTTGTTATTAAAAATGCATTGTAATATTATTGAATTAA
AATATGAAATTGAAAATATTGTTAAAGATACTATGAGAATCTCTGATGAAATAAATGATA
AAATAGTTGGAATTATAAAAAAAGATCTTAAAAAAATTATGATATTTCAAAATATTTAA
TTTTAATAGATAGTGGAGTGTATATAGACCCTGATGATTATCCATTTGATGGTCATGTTC
AAGACGCTTATATAATAATACAACCTAAATACTAATGCCAGAATTCAAACAAGGTTTTTA
TAAACCTATTAACCCAGAAAAATATATAGATGATGTAACAAACATCATCTATCGTAGCTC
ATGGGAATATAAATTTATGTTATGGTGCGATAATAATGCTGGTGTTCTTAAATGGGCTAG
TGAATCAATAATTATACCTTATGAGTTCCTAGGTAAAAAACATAGATATTTCCCTGATTT
TTATATTGAAGTAAAAGATAAAGACAATAACATAAAAAAATATCTTATTGAAATTAAACC
ACAAAAAGACGCTATATTTAAAAAACCAAAAATAATCACAGAAAAAAATAAAAAAAGAGT
AGTAGAACAAGCAATAATAGTTTCAAAAAACCAAGCAAAATGGGAAGCTGCAAGGGAGTT
CTGTAGAATAAATAATATGGAATTTATGGTATTAACTGAAAATGAATTATTTAAGTAACC
TTTAAGATTGTTTGTGGTATAATACTACAAATATTTGAAAGGAATAATTATGAATAACGC
AACTGTGATATCTTTTAAATTTGAAACTGAGCAATTAGCATTTTTAAATAATTGCATATG
TTATTATGATGATGAGTTCTACAATGTTAAATATATGTGTAATCTTTCAGATGATGAATT
TAAAAGAATTACTAACTTCATAAGCTGTATGAAAAATAATATAAAATACTTAGAAATAAA
TGATAAAAATGTGGATATTGAAACATTAATTAACAGACTAGGTAGCCATATATTCCGTTA
TGCACATACTGATACTCCGAAAGAACATAAAGACGCAGAGTATATGTTACTAAAAGACTA
TTTATTACTACACATTAAAGACTATGGTGATAATGAATTAGTAAAACAAATTCTCAAAAA
ATCAGAAGAACTTAACAGCAAATTATATTATAAATGAAAAATATAAAACAAGGGATTAAA
ATGTTAGAACATATTAAAAACTTTTGTGCTGGAGCACCTATAGTCGGTGGTATAATATTA
CTATGCATATTAGTTATATACTTTCCTTATATTATGCTACCATTAATTATGGCAATACTG
CTTATAAGTTTTAGTTATCATATAGGACAAGAGTTAAGAGATAAAGAAGAGGCTTATAA
TTTAAGTAATTTGATTAATTTTTAGATGAATGTGATATCGGAGCAAAAAAATTTAGAGAA
TACTAATTAAATATTTTATAAAGGAGTATAATTATGGCAATGATTTTAAGTCAAAAAGAA
ATTGATGCTTTATTAGAATGTGGTAGTCGTCCCACAAATCTTGGAATTAAATCAATTGTA
GATAGAAAAATATCAGAGTTGAAAAAAGAAAAGAGCAAATTAAGTATTAAAATGAAAGCA
ATAGAAGGTTTGAATTTATTAAAGGATACTGATAATTTTACAATTAAAGATTATATGAGT
ATTATAAATGATTTAATAGACTGTTTAGAATACAAGATAAGTCATTGTCAATCGTTTGGA
GATAATATTCCTAATAAAAAAGCTGAAAAGGAATTTTTAAAAGAACTTGGGTCATTTAAA
TCAACATTATTCAGTTTTGAACTTGATGTGAATACAGGAGAGGAAAATGGAGAAAGATGA
GTTATTAAGCATTCTAGTACCTACAATTGAAGATGAAGAGTTAAAGAAATTTTATAAGA
ATTAAAAGATAAAGATAGAGATAAAAACTTTAAAAAGGCTTCAAAAGAAAAATTAAAGA
GATGTCTGAAAGGTTAGGAATATGATAAAATCAAAATTTATTATTAAACGCAAATTAGAT
TTTAAAAACATGAGATTTGGATATCAATTATGGGATATTTCAGGATACTCTGAATTTGTT
GAAAAACCAATTTATGATCATATATTAGAAGAATTTAAAAAATTAGATCCAACGATGAAA
GATATAGCTATTTTGAATAAAATTAGATATATTGATAGAGTTAGACATGATTTATTATAT
GAATCTACATTTATTTTGGGATATTTTAGAAATGAATTAAATAAAGCTATTAAAAATGGA
AAAGATTTAGATGAATTTATTTTTTATGATCTTCATTCAGATTGGTTACTGAAAATGATA
AATGATATTATAAATAAAGAAACTTTATTAGAAGATTTACCATCTCTATATTAGATGTATG
GGTAATATAATTAAGTCTATAAATGATAATTTTGATTTATCAAATAATTCAATATTTAA
TGGTTTCAAAATACTCATAATTATGTAAAATTATTATTAGACGGTAAAATTGATTATGAA
AACTATTGCATTAATATGGATTAGTTATAGAGAGCAATATGGAAAATGCGTTATTATTT
GAAAAAGAAGTTATTGAAGAATTAAATAGGTATTAAAATGGATAAAAATGTAGAGATAG
TTATGGTCAAATTGATTATTTAGATGATTATGGAAATATTATTAAAACAGGATTTGAAGA
TCCTGAATTAGATGAAGCTATGAAAAACTTAAGTGACTCCATTGACAAGACTTATGAAAA
ATCAAATTTTTATGAGTTTATTAAGAAAAGGTGTGATAAA
TGAAACAAATAAAATCTAAAGGTATAGCATTAATTCCTGATGGAATTGAATTTGATAAAG
AAACTAATGAATTTTTTGAACATGCGTATAAAGATTTTCTTGAGGGTAAATATATTCTTG
AAGGTGAATCAAAATATCCTAGAAGATATGAAAATATTAACCAAATAGAAATTAGTGATG
AAGAGCGTAATAATTTTTTAGAAAAATGTGGTATAAAAGCTGAGGAATAAGACTAACTAA
TTATTGTTTTAAGCCAACTTTAAGGCTATTATAATATAATAATTGTATAATAATTGAAAG
TAAAAATGATAGGAGCTTAAAGTATGAAGAGTTACAATAATGCTTTTGATTTAAAAGATG
```

FIG. 12H. Continuation of (CJLB-7 [organism=Campylobacter phage CJLB-7] complete genome)

```
AGTATTACACACCATTAATTCTAATTGAATTTTTAATACCTTGTTTGTATGAAAAGAATA
TTATTAAAATACTTTGTCCTTTTGATGATGAAAGTTCTAACTATGTTAAAGTTTTTAAAC
ACTATGGTTTTGATATAATTTATGGACATATTAATCAAGGTAAAGACTTTTTTAGCAAAC
GGTGGCTTAATTATGACTTTGACATTTTAATAAGCAACCCACCTTTTAGTAAGAAAAATG
AAATCATAAGACTTTTAACCCAAGAGAATATTGATTTTATGTTATTAATGAACTTAATGA
GCATAAATTATCAAGATTTTAGTGAAACATTAAGATTAGTAAACTTACGAAAACCTATAA
ATTTCATAATACCAAATAAAAAAGTTAGCTTTGATGGAAATACGAGTAGCTTTAGTAGTG
GTTATATATTTGTAATTGTATAGAAAGTAATTTGTTTGTTGATCTACCGCACAATAATTC
AAATAAACATTATAATAAAGATATTTAAGTTTACTATAATTGTGAAAATTTTGAAAGGAG
TAAGAAATGTTACTTGAAGTTGTATTTGAAAACTTTAAATTTTGTAGGCAAGATAGAGTT
GAAATCAATTTTGATAAACTTTATAGTCCTGATTATTTTAAGAAAACTTTTAGAAAAGTA
AAGTGTAAATGTAACCCTTTAAAATCATTATTTTTTGTTGATTGTGATTTACCAAAATAC
ATTTTAAAAGCAATTAAAAGAGACAAAGTCTTTGTAATGAAATAACTAAAGATTATGGT
GTTATCACACTCACTTATAGACAAGATGATTTTTTAATTGATTACATTTTGAAAATTACG
GAGTCTGAAATTATCCAAACAACCGATTTAGTTTACTTAGATTTGTATCTAAAGGATGAA
AACTCTGATTGTGCTAAAACTATAAATGAAAATACAAAATTAAAACCTTCTGAGAAAAAA
GCACTTGAAAAAGTTAAGCAATTTGAAAAAAATACAATAGAGTTTAATTCTTATGAGTAC
AAAGATAAACTTGATTTTCTAACGCATATTTTCAAGCATTTTGATAATAAAACTAATTGT
ATAATGTTTTTGGATGATTTATTAATGAAATTATCATATATGGCACTTTACAAATTTTCA
GTTGAGTTATATGATGACAAATACGAAACATCCAAAAGTTTTGTTTAATAGATGGAAAA
CATTGGCATTTATTAAAAGACTTTAGAAATTGCTTAATTTCACCAGACAATGTTTATTTT
TATGATAAAAAAGATTTAATTTCAATAAGTGATTATGAAGATGCTTTAAAAATATTTAAT
GAACCTATTCATCGTCGTATGTTTATTGAATATGGAAGTCCTTATCAGGAACCTGATGAT
AAATTTATTACTGAATATTAATGAAACTTAAAAACTTTATTTTTAGAATATATGATTGAA
AAATATATGATTTTCATGAAACTTTATGTGGTGAATTTGACATTGATAAATGTGAGTATT
TAAATACTTTTGAAGTAGTTGGTAACATTTATGAAAAATTTATTAATGAAGTTGTTAATG
ATATGCTCAGTAAGATTTATGTAACCAACAGAAAAACAGGTCTGGATTTTAAAGAAGATT
ATAAAAATATAGAATCGCTTGGGAAGAAAGCTTTGAAAGTTCTACACAAGCTTGTAAGGG
GTGGATATGATTCCAAACAATATTATAACATTTATAGTGACTTGCTGAACGAATTATGGA
ATATAAATCAACATCTAGTTATCTATAAAACGAAATACCTTGGTATATGTATGAACTCA
AATCACCAAGATTGAAAATATACCAAGAAAATATCCACGATTATATGGATGATATTAAGC
AAGCTATGAGAGAGCTAAAAGCCGATTATGCTTCTGTTTCTCACATTAGTAATAAAAATC
TAGAGACCAATATAGAATCTATTATAGACGAATATAAAAGATTATATAAAATAGTTGAAA
AAATCGCCCTATCATAGCGATGAAGTGAGAAAAATATTAAAAAATTAAAGGAAAATAAAG
GAAGGTGATAATGAATAAAATTAAACAATGGACTATAGAATTAATGTGTATATTCTATCC
TATAAAAATAAAAAGCACCGCAAAAGATAATTATTATATATCATATAAATTTAAATTCAA
TAAGTATTATGTTTTCGGTGATAGAGGCGGAGAAGTATTTGTTGAAAATTATGAGGATGC
TTTAAGAATAGCAGACTGGATGGATGATAATTAAAAATTGAAAGGAAAAGGTAATGGTAA
CAACATTATTTGAAAATGAATATGTTGAAGTATTAAATAGAAAACAAGCAGATTATATTG
TAAAAAACTTTGTAAAAACTTGTAATTGTAATTGGGAAGATGATGAAGATTGTGATAAGT
TTCAATATCTGAGTATATTGAAGAAGAGTTAGAGAGTGATATTGAATTAGTTAAAAGTGA
AATGGGTGGAAAATGAATAAAAAGCAATTTAATGAAATTAAAGAAAGATTAGAAAAATAT
AGAGAAAGAAAGAATTTAACCTATGAAAATCAACAAGAAAAGTTTTTAGGTAATGTTTTT
GAAAAAGTAAGCGAGTATTTTAGAGCAAAAGATGATTTAGAAAAAATAGATGCACTTTGC
GATATAGTAATTTATTGTTTCAAAACTTTCGATATTAAATATAAGATTTTAAAAATAAAC
TTTTAAATTGTGTTATAATTATAAAAGTAAAGAAAATTATTTAATTAAAAAGGGATAAAA
TGGAAAATTACAAATATGTCTATAATGATTGTTTGTCACTTTTTGTGGAACTACAAAAAA
GCGATGATAACAAAAAACTACAAATATATGATTTAATGTTAAAATGTATTGAACTAAAAT
TTCCTGAAATAACAACTAAAAAGAATATTAAAAAAGTTGAGGAAATATTAAAAAATTATA
AAGAAATAGAAACTCTTGATAAAGACGAAGATTATGGAACAATTTCTTGGCATTATATTC
TTTGTAATATCGGGGATGTTTATAATGTTGGATATAAAGTTGTATATGCTGGTACAAATG
GAAGATATTCATATGATGACGATTATTTTGAAAATATTATTAATTTATACTCAACCATAA
CTTTTTTAAATGAAAAACTACAAAAAGGTTGCCCAGATAAGTTTCATTAGCTGTATTTA
ATAAGGAAGGAAACTAAAATGAATTATTTGTGGAAATATAGGTTACTCAATTTATGATGA
TATTTTGGAGTTAACAAAACTTAGTTTATACAATAACTACAGAGGATTAAGATGACAAAT
AGATGTTTATAGGTATATTAGAAAACAATAATAATGTGAAATACTCGTTTTGTATGTAT
GATGGTAATATAGAATTAGCTGGTAGAATACTTTTACAAAATTATAATTATAATAAATTG
TGTGAATTATTAAATATAGGTAAAGATATTCGCTTTTTATCAAACTGTATTGATTCATGC
AATTTCTTTGAATATGAACATAATTATAATTATGATGTAAGAATGAATTTGGAAACATTT
AAGAATGTAGTATTTGATGACTATTATTGTGATATAAATACATTTATTTGTTTAAAGAT
GGTAAATATTATTTTGCTGATAGAAATAATTATAAAAATCTACTTGAAAATGCACTTGAA
GACTTTATATATTAGGAAATTTTTACATATTTTAATACAAAATAAGTTTAATTTAAGAC
TATTATATTAGAATATGAATAATGAAGATAATTTACTAGAGGAAATAAAATGCTAGAATA
TTTTAATTGCTACACAAGTAAAAAAGAACTTTACAGTTATGAAAAACTTAAGCAAGAATT
AAATGGACATGGGTTAAACATCAAAGAGGATGAAAACAGCATAAAAGAAGATAAAAATAA
AAATATGTCAAAAAGGAAAAACAATGAAACTAAGTAATTTTATTAAAATGTGTAAGATTG
```

FIG. 12I. Continuation of (CJLB-7 [organism=Campylobacter phage CJLB-7] complete genome)

```
GTAATAACTATCACAAAATCACAATTTGATACTGTAAAAAAATATATAAGTTTAAACTAT
AATATACATATTGAAAAATAGATAAGGAAACTGAATTATTTTTCTTTTCAATAAAATTA
TTATGTGATATTATAGAATTATGTCCAAACCACAAAAAAGAAATAGAAGATAAAGTAGGA
GAGCTTTGTGATTTTAGAGAATATCAATTGGAATCTTGATAAATAATTAAAAAGGAGATA
AAATGTTTAAAAAAGTATTAAATTGGTTTATGCATAATTTTTGTGCTTGTATTTTGTTGT
TATATCTAATAGTTATATTAGTAGAAATAGATGAAGTTAATTTAAATAAGGTTATAACTG
TTATTGTACTTACTGGTTGTTATATTTCAGAAAGAATTGAAAATATACTATTAAAGGTTA
ATAAAAATGTCTGAGGGATATTAACACAAATGATTTTTAATGCAATAGAATTAAACAAAG
CCTAATTTTGGCTTTGTTGATTCTTGCTAATCATTTTTGTTATTTGAGCAATAGTCATTA
TTTCTTGCTTACCACTACCTTTTTCAGCTTCTTTTGGAGCTATCTTAATTTGAATATCAA
CTATATTTTTGTAGATATCAGTAAGTAGTTTTGTACTATTGTTTATAGTATCAACTAATG
TTGAATAAGCCATAACAGCTTGATTAGAAGATAAAGGATCAGCTAATATATTATTCGAAA
TAACTTCTAATATATCTTGTCCTCTTTTAATAGTATTAACTAAAGATTCTCTCATTAAGT
TAAAATCTTCTTTTAAATATGTGAATTTTAGATTTTCTTCTGGATTAGATTTTATTAAAT
CTGATTTTTCAACTTCAACTATTGTTTTTTCTGTCACATTAAAAATATCATTTATTTTAT
CTAATTTTTTCCTAATGCTTCTGCTTTTTCTTTCATGAGAATTCTAACTCCATTTCATA
AATATTACTTTGTAAATCAAATGAATTTACTGCTTGAATACTTAACTTTAAGGTACCTTT
ATTTTTAGCAAACACAGTAAAATAATTTAATTGTTTTGATATAATAGGATTAACACCATT
ATCTTCTAATACATTTATAATAAACTTAATATTATCATCAGTATCATCTGTGTATAATAT
TCTATATTTTACATTTTCTTGAATAGGTAAATTTTTAACTTCACCTTTTACACCATCTAT
AACTGGCTTTACTTTATTCCATTCTTCACCATAATCTATTCTAACAAATGAATCTATATC
CATCATATGTGTATTTTCATCAACATTAAATTTATGCACTATTTCTTTACTATCTTCAGA
GAAATCTACAACTGGTGATAAGTATAATTTAACTTGTTGAATAACAGCACCATTTTTAAT
AGGGGGATATATATTCCCGTGAAGTCTCATTGTAACATTAGCACTACAAACTCTTATATC
AGCTCCATCATTTTCATCAGGTAATTCATAATCTACACTAATTAATTCAACTTGTATAGT
TGTAGGTTCTGTTAACCATTCTAACTCTCTAACCCTTAAATTAATGTTTGGGTTAAAGAA
AGGTAAAATTTGCTCTAATATAGAAGTTAAGTCCGTTAAAGACCTTGTAGCTATACTTAA
TACAAAATCAAAAGAATAAGGAACACAGTTATGTTGAAAAGTTATATTTTTCCGTCAAT
ATCTTTTATAGGTATTTGAAATCTACTTGTAGCTCTTTGATCATCTCTTTCCATACTCAT
TAAAGCTAAAGACATTCTAGGTAATATATTAAAATTACCATTTAATAATTGATCTAACTC
TGTATCACTAAAGACTGAAGCAGCATCTTTACTTCCAAAACTAATAGGTACTGTGACATA
CTTATCTGTTTTTTCATCTATTTTCTTTTTAACTTGTATACTGTTGAATAGACTGAGTAG
TGATTTTGTGTATTTTTTAGTTGTTTTGAAAAAGAAAAACTCCATTTAATTTTACCGAAA
AAACACAATTTTTAAATAAATTAGGTTATGAGGTTATTTCAGAAAATTTATCAAATAACT
TAGAAGTAAAATGTAAAAATGGACATGTTTTTAAACGAACTTTAAACAATTTTAAAAAAG
GTTGTATAATAAGTGAAAATATTTGTGATGAATGTGCTATATACTAACTTTAAAGAATGA
TAAAGAACTAGACTTCTACTTACCAGGACATAACTTAGCCATAGAATGTAATGGAGACTA
CTGGCATTCAGAAAGTAATGGTAAAGATAAGAATTACCATTTAGATAAGACTAATAAATG
TTTGGAAAAAGGAATACAATTACTCCATATTTTTGAACACTCTTGGATTGAAAAGAAAGA
AATATGGACTAGTATTATTAATAATAAACTAGGAAAATCAGACAAAATAATGGCTAGGAA
ATGTGTTATTAAAGAAGTACCTAAGACAGAAGAGAAAGAGTTTCTAAACAAAAATCATCT
CCAAGGATTTGCTGGTAGTTCTGTCTGTTATGGACTCTACTACCAAGATGAGCTAGTTTG
TCTTATGAGTTTTGGAAAACCTAGGTTTACTAACAAATATAATTGGGAATTAATCAGGTT
ATGCACAAAAATGGGTATAAATGTAATAGGTGGTGCTAGTAAATTATTGAAACATTTGGG
TCATTGATAAGTTATTCAGATAGGCTATATTCTGATGGTTGTGTTTATAAACAATTAGGA
TTCGAATTTAGTCATCTAGACAACAATTTATGAAACATAAATTAAAAGATAAACTAGAGA
AATTTGATCCAAACTTAACTGAATCAGAGAATATGAAATTAAATGGGTATAATAGAGTGT
GGGATTGTGGTCAGGGTGTTTGGATAAAAGATTAACTATCTAAATAACCAAACACACTAT
CAGTTCCTTTAACTAAAGGACTTTCTTTATCTTGCTCTTCTTTTATTTTATCTTTTGAGT
TTTCTGCACTACCAACTAAATTAAAAATTTCATCTAAAGATTCATTAACTTCTTCATTAT
TAACTTCTTCTAAAGTTGGTATATTATCATGATTATAATTAAATGATTTACATCTTAGCA
TATAAACATTTTTTGAATTTGAATAAGTAAATTGGTTATTAGCACCAGGCACTTGATGTT
CAATACTTGTTATTTCAATATATTTCCCACTTGGAAGCAATAATATATCACCAACAGCAG
ATGGTATTTTAGACTCATCTTGAAATATCCTTTTCATTGTATTAGCACTAATAAAAGAT
TCATAGAATCCATTGTAAATATACCAAATTTATTTAATATATCCCCTCTTTCATCAAACA
TTTCTGCATTTTCTGGTAATGCAAATATCTGATATGTTGCTTCGGTCCCATAATTTATTA
TATCATCTAGAACTTTATCGTGTCCTAATCTTGTTGTTTTATATATGTTAGTTGAAACC
CATACATATCTATTATTTCTGCTGATAGAGTACCAAATAATTGATACTCATTTTGTCTAT
TATTTAAGTTCCAAGCCATATTTTACCTATTGTATTTCAATACAATGTAAGAAAATAGAT
TGCCCATCATTAGTATTATCTAGTGGATGTTGAACTACATCACCTTAAAAAATGAAAA
TATGATTCAGCACCACTTGTAGCGTCAAAAGCTTTTGTTATGTTATAACTATAAAATGCA
AAGCAAGTAGAACCATCAGCTATTTCGACTTCTTTATTTCTATGCTTATAAGAAATTAGC
ATATATTCTTTATTTAAAGCATTATAATAATCACAATATATTTCTGTTGCACCTATGGAT
CCCATGAAATATGAGTTTGTGAAATCTTCATTTGCTTTAAAATTAGGATGTGACATCAAT
TTAGCGCAAGTTTCATATGGTGCTGTAATACACATAGTTATAGCTCTTTTGGTTGAAGCA
GCCATTTCCAATATTTTTTTCTGAGCTGCATTAAATAATTCTATACCAACTAATGGATCA
```

FIG. 12J. Continuation of (CJLB-7 [organism=Campylobacter phage CJLB-7] complete genome)

```
TTAGGTGCTTTTAATGTTAATTGTGTTTTTGTTGCCTTAGTTGTCATCATTTTTAAAGCT
GAAAAATCAATTTCTTGAATAATTTCTGTTAAAAGTTCTTTTTCTAATATATCTTCAACA
GTTGTTTTACCAGTAAGAGCAACTAAATCGGTAATAGCTTCTATTGACCATTTTGATCTT
ATTTTTTTAGTTTGACAGTTTATTGCTCTTTTTACAATTTCATAATTCATTTCAGCTTTT
ACATCAGTTTCCTGATTATTAGCTCTATTTCCAGCAAAATCAGGTAAAACAGTAGCATAA
GGGGTGCTTCTTTTATCAGTTCCAGTATAATCTGTTAAATATTTTCCCTTAAAAGCAAAA
ATACTGCCATTAGGAACTGCTACATTTATTCTTGCTCCTATTCTATTTAACAAAGATTCG
GTGTATATACGATATATTAATTTTGCAAGTTTTAATTCAACACCAGCAATATCAACTGTT
GTGGTTGATTCATTTATAACCTTACTCATATCTTTCCTTTATTTAAGTATATTATATTAT
TTATATTTATTAAGATGACTTTAAGTTATTATATGTTATAATAAAATAAAAAGGAATTAT
ATGGATTACTTAAAGGAAGAAGATTTAAGAGATGAAATTGTAAAATTACAAAAGGTTGAA
AAGCTAAAAGAATTACTAAAAATAGAAAATAAAACAGATGATGATATTCAACAAATAAAG
AAATTAAGAGAAGAAGGGATATCTGAACATTATAAAAAAACAAAATTTGGTGAAATGTGT
TTGCTTCTAATAAAGCACATATTAACCATGCCTAAATTCAGTGGATATACATATAAAGAT
GATTTTTATTCAAATGCTACTGAAAAGCTAATGTTGTATGTAATCCCTAATTTTGATGCT
AATAAAGTTTCAAAAATATCCAAAGAACCAGTTAAAGCTTTTGCATATTGTACTCAAATA
ATAGTTAATAGTATATTACAAGTAATAAATGAAAGAAAAGCTGAGCAGGAACTATTAAAA
AACTATTATACTGATTACACAGAATTAGAATTACGATTGGAACAGAAAGAATATACATGC
TGTTATAAAACTGATGATGAAAATATAAAATATGATGTAGAAATATATCCTATTGTTATT
ATAAATGATAAACTGTATATTGTAGAAGATATTAATAAAAAGTTGAAACTGATTTAAAT
CTTGACACTTCAAAAAGATATTTTATTGTAAATGAAAATATTATTCAATCTAATACACTA
TGGGATATTTTGAAAGATATTGATAATAATAAAACAGTAAAAATGATATATCATCATGAC
TATTTATTAAAAACTGATGAGTATAACAAAATTACTGGGAAAAACTTTAAAACATTAGAT
ATCATGAAGTTTAGAAATATATATGTTCCTAGTTTTCCTAAAAAAGAGAAAAAAGACAGTA
GAAAGTGAGTTAGATATATGGGAAAATTGATAGCTTTAATGGGGGACTTACATTTTGGGT
GTAAAAATTTTGATCATGATATTCTTGAAGTACAATTAAATTCTCTAGAAAAATATAGAG
ACATTTTAAAAGAAAAGGTTGTAGTACAATATATCAATTAGGTGATATGTTTGATAATA
GAAAATTAATTGATTTAAAATTATTACATACTTTATCAACTAGATTTAAAACTATATTTG
AAGGGTTTGATTTTTATACATTTGCTGGAAATCATGATATGTATAACAGAGATAATAGAG
ATATTGTTTCAAGTGAGTTATTTGCTGATTTACTTGGAATAAAATATATTAAAGAACCAT
CATATCATGTTTTTGGCAAACACAAAATAGGAATATCTCCATGGTTATGTGGTGATGAAG
AGTTACTAAAAGAATGTGATATATTACTAGGTCATGCTGAACTAAAAGGATTTAAATATA
ATCATACAAGTATTGCTGAAGAAGGGTTAAACATTGATAATTCAAAATATAAAAAAGTTT
ATATGGGACATTATCATTTTAACCAAAATAATGTTTATATAGGAACACCTTATCAGATGA
CTTTTAATGAGGTTAATTCTATACCTGGTATAATTTTGTTAAATGAAAACTTAGAAGAAG
AGTTTGTAGAAATACTTGGGATAGGCGACATTTTACTGTTACTGTTTTAAAAGATAAAG
TAATCTTGCAGTATAAAGATGAACCTGAGTTATTTACTGGCAACTTTCCTGATTTTTGTA
AAGTAGGAAAAATAATACTTGAAGAAAAAAATGAAAAAGAAGATAAAATATTAGAATATT
TTGGTGCTAGGGCAAGAATAAGCAAGGTATTCTACAAATATGAAGAAGAAAAGTTATATG
AATCTGTTAGTTTAAATAACTCTGTTGCCGAGTCATTAGATTTTATAAAAGAATATATTT
TGAAAGAACATAGGCATTTAGAGTCAGTATTAAATGATGTTATAAATAATTAAGCTTAAA
TTAAGAAAACTGTGATATAATTTTTATAAATCAAAATTAAAGGAGAAACAATGATTATTA
ATGTTGATAAAAATATGTTCCAAGAAAGAATGCAAAACAAGGGCTAAGTTATGGTGCTT
CAGATGTTCTTTTCGACTATATAACACAACTAGAAGATGATATTGGTGAACAGATTGAAT
TTGATCCAATTGCTATTATGTCTGATTTTTCAGTTGCAGAAGGTGAAGATGAGTTAAAAA
ATGAATTGGAAAATCTTGGATATTTTGATATGGAAGATGATGATTCAGATCTAGATGATG
CAAAACAAAAAGCTATAAATGATGGTGTCTTAGTCTATGAAGATGATGATTGTTATGTAT
TTAAAAGCTAAATGAGTGATTAATCACTCATTTTATTTTTGAAAGGAAAGAATTGAATAA
CATTAATTTTAAATCTATAACACTGCAAAATTTTATGAAATATGGAAACAAAAAAACAAA
ATTTGAATTTACTAATGGTATTCATTTGGTAACAGGTAAAAATGGTGCTGGAAAATCAAG
CTTATTTTTAGCATTACATTATTGTCTTTTTGGTAAAACATATAATGGTAAGACAATAGG
ATCACTTGTTAATAATATCAATAAAAAAGGAATGTATGTTGAAGCTGAAATGAATATTAA
TGGAGATGAGTTCACAATTAAAAGAGGGACTAATCCTAGCATTTTTGAAATATACAAAAA
TAATGAATTAATACCATTATTAAGCACAAATTCAGCGTATCAAGAATTTTTAGAAAATAA
TATATTAAAATTTACAGAACAAGCTTTTAGAAATCTTATATATTTAGGTGGAGATTGTT
AAGTCAATCATTTGTAAGGTTATCTAAAAAAGAAAAAGAAGATGTATTTGCTATACTTTC
TGATACTGCTACATTTTAGAACTTACTGAAAAAATAAAACTTTTAAAAAAAGAAAAAAC
TACTATACAAACAAATACATTATTTAAAATAAACACTTTGCAAGATGTTATATCAAAAGC
AAAAATAAAATACGAATATGATTTAAAAGCTTATAATGACTATATAGAAAATAAAAATAA
TAATATTAATGAAATTGAAAATAAAATTAAAGAAGAATCTGGAAAGGTTGAAAAACTAAA
AGAATTAAAAACACAATATGATAGTATATTAACACAGGACCCTTCTAATAAAATAAATGA
TTTGTTAAAAATTATAAATGAGCAAAAATCAGCTTTACAATTAATGGAAAAATATAAAAT
GTGTAAAGGTTGTGAGAAATTAAAACAAATTATTCCAAGCAACATTGATGTTTCTAATCA
TGATGATTTATTAAAACAATTAGAAGTATTACAAAATGAAATGAAGTATATATTAAAAA
CAAAGATGATATATACAAAAATGTTAGAATTAAAACCATCAATAGAAAATAAAAAAGT
ATATGAAGATTTATTAGAAAAAAGCAAAGTAGAACACATAGAAAAACCATCTAATGATGA
```

FIG. 12K. Continuation of (CJLB-7 [organism=Campylobacter phage CJLB-7] complete genome)

```
TATTATTTCAAATGAAAAAGAATTACAAGAAATTGTAAATGAGTATAATGAGATCAATAC
ATATATTTCTAATTTAAATCAACTTGAAATTCTATTGAATAACAATTTAAAAGGTGC
ATTTTTAAATATGCACTTACCATTTATAAACAAAACCATAAACAAATATATAAATATGTT
TGATGAGTTTAATTTTACATTTTTGTTAGATTCAAACTTAAAAGAAACAATTACTAAAGA
TAATAAACCATTTGAATATAAATCTATGAGTAATGGTGAAGCTTTAAGACTAACATTTTC
TATAATGTTGGCTTTTTTAGATATTTGTAGAAATAAGTTTGATGTAAAATGTAATTTACT
TATACTTGATGAAGTTTTAGATAGTTCTTTAGATAGTGTAGGTAAAAATGAGTTATTAAA
AATATTAACAAAGAATACTGACTTAATGAGCATGTATGTTATAAGTCATAATAGTGAAAT
TAAAAATCAATTAGATTATTTTACATCTACTGTTAATATTATTAATGATGGTAAGTTTTC
TGAAATAGAATATAAATAATGTTAAAAAGGGAGATCAGTTAAATGGCATATGGTATAGAT
AATGTATGGTCATTTGTAAATGATTCACAAACTGGCATAGACAAGGTTCCAGTCAATAAA
ATAATATTGCTAAAAGTGAAAATAAATTATATTTAAAAAAACAAGAAGGTGGATTGACA
GCTACATCAACTGTAAATGAAGCAATTCTTAATAATAGTATTGTATCATTATCAAGTGAT
GGCAATTTAGGTGTAGTTGATAGTAATATCAAAGTAATAAATGATCCAGAATTTACCACA
ACTGATAATATCAGTAAAGGTAAAAAAATGTTCAAAATAGCAATTGAACCTGATACAATA
ATTCAAGTTCTGGGATTATATATAGAAAATACTGCAAACTCATCAATAGATGCAGTACCT
TTTGACTACATTATTAAAAATAATAATGTAGTAATATATACTGATAATGATACAATTCCT
ATAAAAAAGATAATTTATTCAAAAACAAAAAGCAGTCAATTAAGTTTAAGTAGTTTACCT
AAACTATTAACAGAGAATCTTGAATGGACTGTTGGTACAAATGGAACATTTTCAAATTTA
GTAGATGCATTACAAGAAGCTTCAAAATATATATCTGTGACAAATTATAAAATTACTATA
ACAATGAAGTCATCGTATAAATTAACTGAAAGTCTTCATATCAATAATGCAAATTTAGGA
CATGTTGTTTTAACATCAGAAGATGATTATGTTGATTTTGATGGAACTATGACACCTAAT
CCCGCTTTTATAAATCAATACGCAGCAAATCCTATTGCAGTTTCATTTACATTTGGAATA
TCTCCAATAATATCGTTTAAACTTAGATTTAGTTCAGTACCTACTATGTTTTCAGTGGCA
TTTGGATTCTTACAAACTAATTTTAAGCTTAATAATTCTGGTGTATATAATGCAAGATGG
GGTGTTGGTAGTGTTGGATGTATAGGATTAGTACAAAACAGTATATTTGAAAATTGTACT
GAATCGGGTGTAGTAGCAGACAATGGTAGTATATTAAATGTGTGGCAAAATAATACATTT
AAAACTTGCAGTGGAAATATACTATGGAGTGCTGATTCAAGTAAAATATATGCTGGAAAT
GTTACATTTGATGGAACATATAATAATGTAGCTGCTAATTGTGGTGTTTCGCATATTGCA
TCTGAATTAGGATTTAATACCCCTATATTTAAAAATATTTCAAACAGTAATTCATATGCT
TTATTTGTTGGTTGGGGTGGGAGTATTTCATGTGGTAGTAATATAGTTGTATCTGGTTTT
AATAAAACTAATGTTGCTGCAAATGTTTTTTCATCTAGTGGTTATATACACTTATATTAG
AAAGGAATCATAAAAATATGATAATTATGGAAATTCAAATATAAAAGAAATAATTAATG
GTAGTGTTAAAATATTAACAGAGAGCAAAAATTATAAAGAAGGAGGAGGGGGGGGAGGTC
TCCAAATTATCAGATGCTTTAGCAAAAGCACTCGAATATATTTCAGTTAAAAATAATTGC
AACATAAATATTATATTAAAATCAGGATATAAATTAAACGAACAAATTATCTTAAGAAAT
GCATTAGCAAATCATATAAATATATTATCAGAAGATGATGAAATATTGCTTGATAATTTT
GATACCGAAAAGTATATCTTTATGTTAAAATTAAGGTTAATGCTATAGGAACTAAAGCAA
AAGGATGGGACTTTAGAGAAAGTTCTGTTACTATGGTTCCTTCAACATCTAATGCATACA
AATATGGTATTAAAAATTGTTATAAAAATGCAGTTTTATCATTATCTTCTAAAATTGTTA
TATCCAAATATAGCTTTACCAACAATGGTAACAATTTAGATGGAACACAAGAGCAATCAT
TATTATATTGTAATGATCAAGGTGAATTAACGGGATTTGATTTAAAATTAGATAATAATG
GTAGTGAAAACTGTAATGGATGGTTATATTATTGTGGATATGGTTCTAAAATGACATTAA
CTAATTCATCAATTACAAATAATAAATCTGCTGCTAATATATTAAATAATAACAATTCTT
ATATGAATCTACAATATCCTAATTTTACAGGTTCAAAAGCAGCAAATTTATTATTATGTT
ATAATGGTGCTCATACAAATATAACAGGTAGAAATGTAACTAATTGTACATGGAGTAAAT
ATGAATTACCATTTGCTACCAATACTGTTACAGCCAATGGAATAATTCATGCTTAAATTT
TGATAGTATTTATAAATACTATCAAAATTTATAAAGGATTTATAATGCTAGAATATGGTA
GTTCCAGTATAAAAGATATTATAGATAATACTCCTGAACTTGCTTATAACTTGGAGTTCA
CTATAGGTAATGGTGGAAATTTTACAAACATACTAGACGCACTTAATTACTGTAAAAGAT
ATATTAATTATCCTAATTATGCAATAACTTTAAAATTATTAAATAATCTTACTATTAATT
ATACTATTAACATTGCAAAGACAGATTTTAGAAATTTAATAATTGATGGGAATGGATTTA
CAATATCAAAATATTGCAATTCACAACTTGATCTGTATTTTATGGTGATATGTCTATTT
ACCCTGTAATTAAAAATCTAACTGTTGAAAATACAAATAACAGGAGTTTTGGTGTAGCAT
TTGCTAATTATCATGGATCCATATTTGCATCACATGCAATTGTAGAAAATAACTTAACTA
TAAAGAATTTTTATAATGGTATTAGACATGCATGTTCATATTTATTTACCCCAGGATTAA
CTTTAGATAATTGTGAATATGGATTATATGCATTTAGGAAATCAGATACTTGTTTAGATG
CCTATGTAAATATTAAAAATTGTGGAACTGGCATAGCTGTTTATAATGGTTCAGAAGTTG
TAGCACAAGGTGTTACTTTTGCTGGCAATACTACAGATTGTAATATAAGTTATAATACAC
CAACTACAAATGGAACTATTTGGAAATAACTTATAAATATAAAATAAGGAGAACTA
TAAAACATGATAATATCTAAAAAAACTCTAGCTGATCAAGGTCAATTGAACAAAAATGTT
ATATTATGGGCAATTGATATAGGATCAGAGTTAGCATTACTAAATAGGCCTATGACAGTT
AGACAAAATTCAGAGAACATGATGGTTGAATATATTGATGACATTACACCTGAAGAAATT
GAGGCTGGAAAACAAGCAATTAAAGAATATTGTATATCAAATAATATTATGGATATATAT
TATGATTTTTTAATAGCAACTACTCAGGAAAGTAATAAATTAGATATCTTAAAAGAGAAG
AAAAGGTATGAGATCCAATCAAATAGAGATAAAGCTCTAGAAAATGGAATTGTATATAAT
```

FIG. 12L. Continuation of (CJLB-7 [organism=Campylobacter phage CJLB-7] complete genome)

```
GGTCATACTTTTCAAACAAGGGAAAAAGATAAACTAAATATTAATGGAGCTGTAACTAAT
TTAATGCTTGATATACAAAGTGGAACTAATTCAGTTTCTGAAATCATTTGGATTGACATA
AATGATGAAAAAGTAACTTTTAACCCACAGGAATTTTTAAAGTTTGTCTCAATGGTTGCA
TATAACACACAAGAGATTACTTTTAAAGCCAATGTTTTAAAAGCAAAAATAGAAGCAGTT
AAAACAATTGAGGAACTGGAAAAAATACAATGGGATGATTCAGTTAAAACAACACAAAAG
AAAAGATAATACATGAAAAGTTTTTCAGATAAAATAAAATACTATTTTTTTATATTTAGA
TGGTTTTTAATTGGCAAATATCACTGTGATATTCCACAGAGATACAAAAGTATTATAAA
ATATCACACAGAATATTATGGTTAAACATTCTATTCTGTGTGATTTATACATGGTGTGAG
CTGATAGGACTTAAATGAATTACCTCCTAGAGTTAAGTCCTATTTTTATTGTTGGACTAA
TTTGTGGTTTATCTAATTATTTGTCTGATGAAGAAGATACTTGTACTGGAAAACATATAA
AATGCATCTTGAAATACATTTTTAACAGTGCTGTTTTATGTACTATAATTTATTGTATTT
TAACTTCACTAGAATTGCCATATCTTACAAAAATAGGTGTAGCAGGTGCAATTACATACT
TAGGTATAGATAAAGCAATGTCACTTATTAAAGAATTTATACATTTAAAAAAATGATTAT
ATGATTTTCATATAATCAAAATTAAGTGTTATATCTAAGGTTATGATATTATTATCAGTT
GTAGAATATTCCAATTCACTTACCTCATCTAATTTACTTTTATAAAATTCAACTTTAAAC
AAAAACTTATTTTTAGAATCATATATTTCTAACCATGATGTAGCTTCAATGCCACATCCA
GTATTTGTAGAAACTTTATTATACTTATTAATTAAATTGACAAAGTTTTTCCACACTTCT
AAATTTTCATCTACTAACAGCGTCAATGTTATTGAATCAAATTTTGCTACTTCACCACCT
AATGTTAAAGTACCAGTTGAATGCCCTACTTTTTGTCCTTCTAAAGATATTCTAGGTAAT
TTAACTTTTTGACAATAATATTGAGTATCATCAGAAATAATAATGTCCTAAAAACTATA
TTTGAGTTTAAAGCAATATTTCTAAAGTTCATATTACACCTTTTTACATTATTTATTTAA
GTATTAATTAAGATAAATATGGTATAATATTTCAAATTAAACTTTTAAAGGAAAATTATG
TATTTTAGTCTCAAAGAAACATTAGAGTTTCTATCAATTAATTCAAAAAATGGTGTTTGG
GAATATGATGATATTTCAGAAGCTGACACAACTGTGTTTTGCTCATATTTTTCAAACAAT
AGTGATGAGAATGACATATATATTGTGTTAAGCAATCCTACTGGTAAATCAGATATAGAT
TTACAAGGTAATGTAACAGATACAGATAATGAAGACGGAATACCTGATAAATTTTCAACT
TGTATTATGAAGGTTAATCTTGCAAAACTAAACATTAGTAATTTTGATGAATTGGGCAAT
GCAATAAAAAGATATAGATTATAATTAAGTTTAATTTAAGGTTTTTCTGGTACCATTACG
GTATCAGAAAATTAAGGTTTATATAAAACCACAAAATGAAAGGAAAGAAAATGAAAAAAG
TTCTATGTAGTGCGGTTATGGTTGCAGGTTTAATGTTTGTAGGTTGTTCAACAACTACTC
CACAACAACAATTTGCTAAACCTATGTTAGAAAAACATGATGATTTACCTAGTTGGGTTA
AAGAGTATGGAGATATTAATACAGCTGTTGGTTCAGCAATGTATATAGGTCAAAATTATA
TTCAACAACAAACAGAAGCTATTGCAGTAGCTAAAATGAACTTAACCCAAAAACTATCTT
CAAAAGTTGATAGTATGATCAAACAATATTACCAAAATAAAGGGATTGTTAAAACTAATA
ATAGCCAAGTTTCAGTACAAGTTAGTTCGTCATTAGTAAAAAATGTAAAAGTAGTTGATA
CTTATGTTGCAGATGATGGTGAGCTATTTGTAAAAATTGAAGCATATAGTACTAATTTAT
TAAAAATTATAAAAAATGATGATAGTGAGTCATTATTTGATGAACTAGATAGAAGAGTTG
GTAATGTTAAATCCAATTAATGTAAAATATTGGGAAATTATTCATAATAAAGAAGATTTA
GGAATACATAAATCTGATGATTATAACTGCAAATGTGATGTTTGCGGTGATTCAAAATAT
AAAAATAAGAAAAGATTACATCTGTATAGAAAAGATTCCTATACAGATGATTCTATAAAA
TGTTTTAATTGTGGTTATACAGCTACTATGTATTCTTACATTAAAACTTTTCATCCAATG
TACCTTAATAATTATTTAAATGAAATAGGTGAAAAATACATAGATGATTTAAATATTCAA
AATATAGCACTGACTAAAAAAGAATCACAAAAACCTGAAGAGTTTTTTAATTTAAACTTA
CCTAAAGCTAGTTGTATAAAAGAGGCAAAAGAATACATTTTAAAAAGAGGTGGAAACCCT
GATGACTTTTATTATTGTAAAGAGTCATTTGTAATAAATGATAAAAAATTTAAATTACCA
AATTTTATAATATATTTAAATACTGTAAATGATAATGCTTTTAGTTTTTATAGTCGTAGT
ATAAATGATAAAATATTCTATATATTTAATTCAGATGATGGTTTTAAAGTTATGAACTAT
TTTAATATTGATCCATCAAAAGAAGTATATGTGTTTGAAGGTTTATTTGATATGTTATGT
ACCTCATTTAAAAATAAAATAGCTATGTTGGGTGCGACTTTACCAAAGAAAATGAAAACT
ATGCCATACATAATATGGTGTTGTGATAATGATGAAACTGGTAGAAAGGAAATGCTAAAA
CATACAAATAATCCAAATCATAAATTTGTTGTATGGTGTGATGATGAAAAATTCAAAAAA
TATAAAGATATAAACGAAATTTATCAAAGTGGTGTTAATATTGAAAATTTTATAAAAGAG
CATACTTTTGATGGATTAATAGCTGAATGCAAATTGAGGATGTGGTGAATGGATACATTT
AAAAGCATATTAATATTGTTGATATCAGCAATAATGTTAAAAGTTTATATCATATTATTT
TTGATAATATCATTAGGGGTTTTATATTATGATTTAATAATAGGTATACCAGTAACAGTT
ATATTAATGTTTATAAGCATATGTTTAGCAAATAAATTTGAAAAGTTTATATCATGATAA
AACTTATAATTGGTCCTATGAGATCAGGGAAAAGTTTGGAGTTATTGAGAGAAGCTGAAA
AACTTCATTTTGGTAGAAAAAAATACATTTTAATTAGACCAGAAATTGATGATAGAGAAT
TTATATCAAGAAGTTATAAAACATTACATAATTTAAATGTAATAAAAACAAATAACATAA
ATGCAATTGTAAATGAGTATGATTATATATTCTGGATGAATTTCAATTTTTTGATAACT
CAATTACTAATATTATAACTGATAACATCAGTAAAAACTGGGTATTATGTGGATTAAACA
TAAATTATGAATCAAATTATTTGAAAACATTATAAATATTTTACCATATGCAGATAGAA
TTTATAAGTTAAGCTCAATTTGTGAAAAATGCGGATCTGAATATGGCAATCATAACATTT
CAAATACAGGTGAAATATGTGTTGGAGATGATTATACAATATTATGTTCTACTTGCAAAT
TACAATTAAAGGGTTAATATGGAAAATATAAACAAAGATCTTATAACAATTTACAGATAT
GGTAACAACTTTGAATTATACAATGATTTTCATTTTATTTTTGACTTTGATGTAACTTCT
```

FIG. 12M. Continuation of (CJLB-7 [organism=Campylobacter phage CJLB-7] complete genome)

```
AAAGGATTTACATTAGAAAAATATTTGGTTGGAAATAATATTATAAGAATACCAAAAGGA
TTTAGAACTGATTTTGGTAGTATTCCACAATTATTTCAATCAATAATATCACCAGTTGGA
AAACCTACTAAAGCTTATGTATTACATGATTTTTTATGTGGAAAATCAAATAAAGGTGAT
ATTCCTAGAGCTCTTGCTGATGAACTATTTTTGGATGCTATGAAATTACTTGGTGTAAAT
GTTATAAAAAGATATGTTGTATGGGCTTGGGTTAGAGTTTATGGTATAGTTTATAAACCA
CTTGCAAAGTTCTTTAAAGACATATGGGATAAACTATGAAATTTATTGAATGTATGCAAA
TATTATTAGGAAAAATAATTCAATAGGTTCTTTATCTTTAGAAAATGATTATATTAAAA
TATATAAAGATAATGGTAAATTAAAAATTGTTGATTCAAAAAATAACAATGTTTTACTTA
ACTCTGAAGATATTAACAATGAAAATTGGGAAATAGATAATAAGTTATTTGAGCTAATAC
CGGGATCAATGTGGATAACTGATGATGATATTGTAACAAAGGTTGAAAACAACTCTTTTT
ATGATAACATTCAATATACAACTTTCAGGAATATGCTAACTAATGAAATAAATATTTTGA
AATCTAATAATTATTATACTAATTATTGCAAAATAAATGGATCCAACCAGAACCATTAA
AAGGTAAAGGAGTTATATGAAAGTATATGATTGTTATCCAACTTATCTTGGGTGTAAAAG
ATCCCTAGCTGTTGATATTGTAAGCAAAATAAAAGAAATGTATCCAAATACTAAAACCAT
AGTAGATGCATTTGGCGGGTCAGGTGCAATATCTATCACTGCTATTCAAATGGGATTGAA
TGCATTATATAATGAAAAGACAGAAAGAGTTGCTAGAGCAATAAAATATTTAGCTAATGG
AAATTTTGATGACATAACAACCTTTATGAGCTATGATGAGTATTGGGATAATATAATATC
TAATAATACTTTAAATGACTCTGATTGTTTTAAAGTCTCATTTATGTATAATTTTACTGG
TAGAGGTAACTGCTATATTATACCAGATGATGAATTTAAAAATTTTAGAATACTTTTACA
GAAATTTGTGTGTAAGGATAGTGATCCACAATTATTATACCCATTTCTTAATGATAATTT
TCATAGTATTATAAATGAACTATATTCTATAGAAAAACCAATAATAGAAAGATATAATGA
TATTATGCCAATAATTAAAAAATTAGTTTTAATTTCAAAACATAATTTGTATCAATATTT
TAATGCTTCTATAGACGAGTTAAAGAAAATATCTTTTAAAATGTTGCAGAATATTGTTGG
TGATGCTGAAGCAGCATACATACTTAAAATGTGTAGAATATACCCTATTGAAAAAATAAC
ATTTTTAAGAAATCATAAACATATTGATTTTTCAAAAATGGAAATAAGCAATAAAGATGC
GTTTGATCTTGATTTATCCAAGTATGATCCTGAGACTACTGTATTATATTTTGATCCACC
ATATAAAAATACAGCTAAATCTGGTAATTATACTGATTTTGATAGTAATACATTACCTCT
TTTGTTTGACAAATTTAAGCAGTTTCCAATATTTCTAAGTGAATATTCTTCAAATATAGA
AGGACTTCAAGAAATATACACCAAAAGTATACCTCATTTTAATGGTAAAGAGTATGCTAA
AGAGGTCCTATACTTTAAGTCACCTTTAAGATAACTTTTGGTATAATACCCCAAAAAGAT
ATAAGGGGTATTGTATTGATGTTTAAATATGAATATGTTTTTGAACATAATTTTAAGCTA
TATGCTAGACTTTATGATGAAGTTACAAAAAACTCAATTATAAAAGAATACAAATCAACT
GAATATGTCCCAGAATTGTTTATTAGAACTAATGAAAAAACAGAATATAAGGACTTCTAT
ACACATGGGTATTTAAAAAGAAAACATTTAAAGCAACATATGAGATATATCAGTATTTA
AAAAATGTATCACCTTCTACACCATTGTATGGTAATATAAACAGACCTCAAAAATATATT
CGTGAAAACTTCAAAGATATAGATTGTAATCATGAATTCAGAACACAATATCTAGATATA
GAAACTAGGGCAATAAATGGTTATGCAAAACCATCAAACCCAACAGAAGAAATATCTTTA
ATACAAGTTTATGATAATTATTTAAATAAATTTATAATTTTTGGTACTAAAGATTTAGAT
ATTAATTTGGAATCAGATATAGGGGAAGTAATTTACAAAAAATGTGATAATGAAATACAA
ATGTTAAAAAAATACTTAACATTTGTAGTTAAAACAAATCCTACTATTATAGCTGGTTTC
AACTCTAATTTATTTGATATCCCTTATATTGTAAATAGAATGATCCATCTTGGCATAGAT
GACTATGTTGAGTTATCACCTATAAAAGCTATAACACATAAAAAATGAAAACTAATGAT
GATATAGAGTATGATGGTGTTAAGATAGAAGGTATAATTCAATTAGATTTGAGAGATTTA
TATATAAAATACACAACTCAAAAACCAAGTAGATTTTCATTGGATGAAATATCCAAACTT
GAATTAGGTGATACTAAAGTAAATTACGATGGTTCAATAGAAGACTTGTATAAAGATTTT
AATAAGTTTGTTTCTTATGGTTTAAAGGATGTTGAGTTACTTATAAAATTAGAACGAAAA
TTAAAATTATTAAAAGTATGTCAATTAGTAGCATATAAGTGTGGTGTAAATGCTGATGAA
GTTTCAGGCACCCTTATGCAATGGGCATCATTAATGTATAATTATGCTTTATCAAAAAAT
GTTATATTACCTTTAAGGCAATTAAAAATAATAAACTATGATCCACCATACCCTGGAGGA
TGGGTTAGAGTTATTGAAGGACTACACAAAAATGTATGTTCATATGACTTTACATCTCTA
TATCCAAATATTATTATCGAGTTTAAAATAGGTTTGGATAATTATATTCCAGTTAGCAAT
ATCCCATATGAGAAAGCTAAATACTTGAAGAAAATAGAGCAAGGTTTATGAATGAGGCA
CCAAATGAAGTTATTTCTACATCATACCAGAAGACCTTAAAGATGACCTTAAACAAATAT
TTTTATTTCTATTCAGAAACCTATAATAAAACTAACAATGATAGTATGGAGGAGTTTTAT
TATTTTAAAAATATTATTGACAATAAGGATGAAATAAAACAGATATGTAAAAAATATGGT
GTTAATGTTACTCCAAATGGATGTTTATACTTTTCAAATGGTACTTCATTATTTGCTGAA
TTAATAGAAAATTTTTTCAAAGATAGATTAAATCATAAGAATTTTTTAAAAAATGATAAT
TTAACTGCTTCTGAAATAGATTACCATGATCTTATGCAATATATGTTTAAAATTCTTATG
AATTCTGCTTATGGCTCAACATCACTAGCAATAAATCCTTTTAGTTTTGGTAAAAAAATG
AGTGAATCAACCACAACAACTGGTAGGTTTTTAAATATGTGGGTTTCATATAAAGTTAAT
AAGTTTTGTAATGAAACATATAATTTAAATATTGATGTTAATAATAGGCCTTTAAGTATT
CAATGTGATACAGACTCTAACTATTTTGAGTTTAAGTTTCTAGAAACACCTAAAGATTTA
CAAGAAAATGCCAAATTTTTGAAAAGTTATTGTGAAACTACAATATCACCTGTTATAGAT
GATGCTATAAGTGAAGCTGTAACAGCTATCAATGGTTTAGATAAAAATAGTAATCTTGGA
ATGGAACAGGAAACAATATGTGATAGATTAATTAGTTGTGCTCGTAAAAGATATGTTGGG
AGATATTTTAATAAAAAGAAATTAAATAAAGGGTTTAAAATAACTGGCCTTCCTATGATT
```

FIG. 12N. Continuation of (CJLB-7 [organism=Campylobacter phage CJLB-7] complete genome)

```
GATAAAACAACTCCAAAATGGACAAAACTAAAATTAAATGAGTGCTTAGATTTAATACTT
GACAGTGATCTACATGGGTTAAGGCAATTTATTAATAACATAAAGGATGAGTTTAAACAA
CAGCTTCTAAGTGATATTTGTATGAATAAAAGTGTAAGTAGCTTATCATATATTGTATCA
AATGGTAAATGGGTTTCATCAATAAATGGTAATCCTTGTCCTATTCAATCTAGAGGTTCA
ATCCATTATAATAATCTTACAAACAAGTATAAACTTAAAAAAATAATGGAAGGTGAAAAA
GTATATATTGTCTATCTGAAAACACCAAATGCCATTACTGGTGATAATGTTATATGTATT
CCTGATGATGAAATTGTAAGAGAAATACCAAGTATCAGTGAATTCGTTGATTATGAAACT
ATGTTTGAAAAATATTTTATACAAAAATTAGATATTATGAGTAAACATATAGGATTTGAT
TATAAAAATATTTTTGTAAATACATTAGATGAATGGTTATAATTTAATTATAGAAAGGAA
ATAAAATGGAGACAAATACATCTGTTGTGGGAACACTTATAGCAATTGTGGCAGTATTAG
TTATAGTATCAGTTAATATTACAACATTTTTATATAGTAAAAGGAAAAAATGATGATTTA
ACTATAAAAAATAAAAATTGTCAATTTCTTTTTGTTTCAGATTTTTTTGAAAATTTGAGA
AATACACGAATTATGAAACATTAAATTGTAAAGACTATGAAAACGACATTAAAACTATA
AATGAAAGGTTAAAATTATGAAACTATTTGAGAAATTAGAAAAATGGTTGAAAGAAAGAC
ATTTAGATAAAAAAGAATATGATCATTTAACTTTGTTAGGTTATCTACATGAAGAGATAG
ATGAAGGTATTAAAAAAAGGGATAGTGAACATGAAAGTATAGATTGGAGATGTGATTGTA
TTGTATTCTTAATTAACAGTTTATATCAAGATGGATACAACCCAAAAAATATGTATGGAT
GAGTGTTTAAAAGAAATTGAAGAAAGAACAGGTGAGTATTCAGAAAGTGAAAGAAAGTTT
AAAAAACATATGGGTGCTTATACTTATGAAGAAGCACTAGATGAAGTAGTAAAAAATTAC
AATTGTAGAAAAGAAGATATTACTCTTCATGGAGATCATAGGGAATTCTGGTATTTTTTG
GTTAATGGTAAACAAATAAAAATAAAGAAATGGTATAAAGCTGATTATTCAAAATCTATA
AGGGATGATATAAGTAATGAAAGACATATCACTAAAGCATATAAATTAGGTAAAAAGATT
ATGTTCAAACAGTTAGATACAAATAATGAATGGCAGCTTTTAAAAGATGGAAACCTTAAT
TTCAAAGAATTTGACTATAAAATTGTAGATTAAGTTTAAATTAAGTATATTTTGATACCG
TAACGGTATCAAAATTGAAAGGACTGAAAATGGAAAATATTAATGAGTTTGTAGAATTAA
AAAGTCAGAAACTAAATGTTACTGATTTTATTGAAAAAAATAGTATTAATGAAGATGAGC
TAGTCAAAAATGCCATGAAACAAATTTTTGATTTAGAGAAACAAAAAGAGAAATTGATG
TTGAAATAAGAGATATTAAAGCAAATTATCCAAAGATGGTATAAATATAACAGAATTTA
ACAGGGTTCTATCTACATTAAAAAATGAACTTAAAATGAGTATCGATAGTTTAAGTGCTA
ATATAAGCATGTATAACTCGATAGTATCCGATAAAGAACTATTACAAAACTTAAAAGATC
AAATTAACGATTAAAGGTGAATTATGAAGTATAGATATTCTTATTCAAGATTAGAGTGTT
TTAGACAATGTAAATTAAAGTTTAAATATTCTTATATTGATAAAATATCTGTACCTAAAG
ATCAAACTGCACTTATTAAAGGAAGTTATATACATTGGCTAATAGAGCAAAGTTTTAAAG
AAGAACCTATCGAAGTAAGTAAATCATATAATAATCCTTTAATAAATGCAGATCAATATA
AAGAATATAATGAGATATTTGAAAAGTTTAAAGAAACAGAAAAATACAAAAATATAAAG
ACTTACCAGCTTTAGGAAATGAAGTAAATTGGGCTTTAGATAATAAGCTAAACCCAACTA
ATTATTATGGTAATGACTATGTCATAAGAGGCACTATTGATTACATTGCTATCAAAAATA
GATGTGCAATAATAATAGATTGGAAAACAGGCAAAACAAAAGATAAAAAATATATACCAG
ATGCAAATCAACTAGCATTATATGCAATATGGGCTGAAAAAGTCTTAAATGTAGATAAAA
TAATATGCCAGTTTGTGTATGTTGAAACTAATGATTTTCACACTTACACTTATACAAGTG
ATGATTTGATACCTATAAAAAAGCAATTTGCTCAAGATATAATGAGTATTGAAAATGAAA
AAGCATTTATAGCTAAGCCAAGTATATTATGTAATTGGTGTGAATTTAAATCAATGTGTG
ATAATTTTAAAAATAGTAGTTATAATAAGGAGTAAATTATATGAATATTGATAAAAACTA
TTTAATTAAAGGTGACAACTTAGAAGTAATGAATAGTATTTTACCTTTTTATAAAGGTAA
AGTGAAATTAATTTATATTGATCCTCCTTATAATACTGGAAATAAAAATTTCCAGTATAA
TGATAATTTTGAATCTATAGATTTAATTATAAAATATTTTAATGTAGATGAAGAAGAAGC
TAAAAAAATAAAATCACAAGATAAATTCATAGGTTCTAAAGTTTGGTTAAAATTTATGAA
AGAAAGATTAGAAGTAGCTAGAGAATTTTTAAAAGATGATGGTGTTATATTCGTTCAATG
TGACGATAACGAGCAAGCGTATTTAAAAGTACTTATGGATGAGATATTTGGTAGAGAGAA
TTTTGTTAATTGTATTGTAGTCAAGATGAACGAATCTAAAGGATTAAAAAATGCTAATTG
TCATAAAAAATTACCGAAAAATAAAGAATACATACTACTTTATAAAAAACAAGATAATAA
ATCTATATTAAAACAAATTAGATTAAAAAAGACACAAAATGAATTATCATCATATATTAA
ATATTATAACAAATACATTCCAAACATTGGAAACGATTAAAGAATGGGAAATAAAATA
TTTTGATCCAAAATTAAATAAACAAGATTATTTTAAAAACTTGATATATTTAGTAAAACC
TGATAATAACATTAATAACATTAATATGGAAGAAGGGACTTTTGAAAAAATAATAAATCC
AAAAGGTAAAACAAATTATTATTATATGAATAATGGTGTAATTATGAAAGTTTTGTTTTT
AAATGAAATCTTGATTATTCTTTAGGTGATTTATGGACAAACATATCTACAATTGGCAT
ATGTAGAGAAGGACTGAAAACAACTTTTAAAAATGGGCAAAAACCTGAATACTTATTAAA
AATAATATTGGATCTTTCTACAAATGAAAATGATCTTGTAATGGACTTTTTTGCAGGAAG
TGGAACTACTTTAGCAGTAGCACATAAAATGAAACGCAAATGGTAGGTATAGAACAAAT
GGATTATATAGAAACTATCACAAAAGAAAGACTTAAAAAAGTTATAGAAGGTGAGCAAGG
TGGTATTAGTAAAGAAGTACAATGGCAAGGTGGTGGAGATTTTGAATACCTAAATAAGGA
ACATGATGATACTAACATTTGATCCTTACTATGATATAAAGAAAGTAATGAGTTTATAA
AAAACTTAAAAGAAAATAAAATAAACTTTAACACATATATTTATCGAAATCACCTTATT
ATTGGTTTTATGAAGTTGCAGACAAATATAAACCTGTTTTCTTAAAGTTTAATGAGGCTA
ACTCAACAGATTTAAGATTTATGCTTCCTAAAATTAAAGAATTAACTCCGAGCGATGAAA
```

FIG. 12O. Continuation of (CJLB-7 [organism=Campylobacter phage CJLB-7] complete genome)

```
ATTATTTAAGAAGAATACCAAAAACACCTAGTGATTTTGAAAGATATGTAAGTCCAAATA
TATTTAAAAAAGCAAAAGATGCTGAATATTTTTGTGTATTTAGGTATAAAAGTATCTCTG
AGATAAATAAGATCACTGAAACATTAGGTATAAAAGTTTATATTTTACCAAAAAAAGTAA
GAGAATGGAATATAGCTTTCACTTTTAACAAAATGATAAGAAACTTTGTATTTGGACATT
ATATTTACTTGAAAAGACTAAAAAAACACAATTTAACAAAGTTGGTGAAATAGAATTAT
ACTTAAATAATAAAGTATTTGTTACAGATAAAATGAAGTTTAAAACAAGAGATTTACCAT
TTAGTGAAGATGGTACATATTATCCTCTTAAATTTCAAATAAAACAATAATTAAGGAAGT
CTTAAGGTTATTGTGATACGATTACGAATATAAAAATTAAGTAAGGGCGAGTAGCTCAAT
GGAGCAACCGGCTCATAACCGGTTGGTTATAGGTTCGATTCCTATTTCGCCCACCATTTT
TAAACACAATTAAGATTTTTTAAGGAAGTTTTAATTGTGTTTATTCGATTATATTGTGAG
AGTATCGGTTTAATTCCGATCCCAAATGGCAGTTTGGGAAGTTTTTGAGTAAAAACACAC
AATATAAGATTAGATACCACAACTTCAATAACTCTAATCTATTGAAGTTGTAGTGAATAA
ACACAATAATTATTGCAGATTAGCACAGCGGTAGTGCAATCGACTGTTAATCGATGGGTC
AGAGGTTCGAATCCTCTATCTGCAGCCATTTATAATTATAATAAATGTAGAAGTAGGATA
ATTGGTAATCCACCAGACTGTAAATCGGCGTCTTTTGGCATTGATGGTTCAAATCCATC
CTTCTACACCATTTTAAACACAATTAAGTTTTCAATGAAGATTTAATTGTGTTTAAAATA
AACACAAGTAAATGGTACTAACAGCAAAGTTTTAAGGACATTACTGATAATGATGAATTC
TCTAAAAAGTACCATGATTAAAAAGGGTATTTACAGCAAATTAATATTTTATGATTTTAT
GTGCTTAGTGATTTTCAGTATATCTGAATTTTTAAATACCCTGATTTTTATAAAGGAAAG
AAAATGAAATTTGTTAATTCTCTATCAAACTTATCTTATACAGAAAATGGTGCTTTAACA
TTAAGCTCTTCATTAAATATAGCCCTAGATTTATTTTTTATTATAGGAACAACTAATGAA
AATAATATTGACAATGTTTTTGAAAAAGTAAAAGAATCATTTAATATTGATAAGGAATTA
ACTTCTAGAATATTGTTATGGACAAGAGATGCAAGAGAAGGTGCAGGAAGAAGAAATA
TTTAAAAGATTTTTAGATTTTATTGCAGAAAATGATAAGGAAATTTATAAAAGAATAATT
AGAAAAGTTCCTGAATTAGGCAGGTTTGATGATTTAATAACTGATAAACAATTAGACTTA
GTAGGAAATGAATTAATTAAAATACTAGATTTTAATAATCAATTATGTGCTAAGTGGATG
CCTAGAGAAAAATCAAGTAAATCTAAATTAGCCAAAAAATTGATGAAATTATTAAAATTA
AATGCTAAAGATTATAGAAAGTTATTGTCTTCTAATACTTGTGTTGTTGAAAATAAAATG
TGTTCTAAAGAATGGAACTTAATAGAATATGAAAAAATTCCTTCAAAAGCAATGGCTAAG
TATAATGATGCCTTTGAAAGAAATGATAAAGAAAGATTTGAAAATTATCAAGAATCATTG
ATAAAAGGTGAATCAAAAGTAAATACTTCCGCAATATATCCTTATGAAATAATTAAATTA
ATGTTTAAAAATGATATTTTAGCAAATGAAATGTGGAAAAATCAAAAGAATTGGATGGAA
GGTTCTAAGAAAACTCTATTCCCTATAATTGATGTTTCTGGAAGTATGTATACAGGAGTT
CAAGGAAGTATAACTGCTTTAAATATAGCAATTCTTTAGGTATGTATTTAAGTGAAAGA
AATGGTAAAGGTTTTAAAGATTATTTTATAACTTTTTCCGCAAATCCTGAAATGGTAAAG
ATAGAAGGAAATAATTTAAGAGAAAAATATAAATCCATAAAAAAATCTAATTGGGGTATG
AATACTAATTTCGCTAAAACTTTTGATTTAATTCTAAATAGAGCAAAAGCTGATAATTTG
TCACAAGAAGATTTACCTGATGCTCTAGTTATTTTAAGTGATATGGAATTTGACGAAGCT
CAACAAGGTAAAACAAATTTTGAATATATAAGAGATTCTTTTAAAAATAGTGGTTATAAA
ATGCCTGAATTAATTTTTTGGAATATTTATGGGAGAAGTGGAAATATACCTGTAAGAAAA
GATGAAAATGGAACTTGTTTAATATCAGGGTTTAGTCCTTCAATAGTAAAAGGTTTATTA
ACTAATGATTTAAACCCTGAAAAAATAATGTTTGAAACTATAAACAAGAACGATATGAC
TTTTAATAATATTGCCTATTTTTGAGGGGATTGATAGTTAAGACAACGGTAAATGTAATC
GAGAATGAGATTATAGACCTAAGAGCTTCCTCGTAGCTCAAACCTCAAAGATGGGTTATA
GTTAAGTTTATCTTAAGATACATTATGATATAATTCCTCTAAATTAAAGGATTAAAA
ATGCTAAAAAAATTATGTTTTATAATAACTCTAGCTTCAAGTTTATTTGCATATAATTAT
ATGGATTCAACTGTAATTGAAGATAAAGGTAATATTGTTATAGAGCTATCATTCTGTACT
AAGGATCTTGATTCAGAAAAAGAGTATATTATCGACCATTTTAATAATCAAATTGATGGT
CTAGAACAGCAACAAGTAAATCTGAAGTTTATCAATACAGAGGAAAACAATATGTTTTC
AATAAAGGTAAAAATGTAAAATATAACAAACCAATTGTTACATTTGTGCCAACTTCTACT
AATGGATGCTATATAGCAACAGCTTTATATAAAATAAAACATGATGATATTAAAACATCT
GTAAATAATAAATATGAATCATATTTTAATGGCTTTATAACTAAAAACACATCTACAAAA
AATGAAGTTGAAAATGAAATTAGACAAAATCTTGAAAAGAAAAGAAAATATTATT
ATAAAACCTGAACAGATTAAAAATAGTCACGAAACATTTGTGGAAGTACCAAAATATTTG
TATGCACAAACAAAAGAAAACTATTATATTAATATTATATGTGAAGTAACAAATTCTGAT
AATGAATTTATATATAATTTTGAAATAAAAGATTATAAAAAACCTTTAATAGTTAAAGGA
AAAATATGGGGTGATTTAACACCATATTTTAACACAAACTGTAAAGTTGAACTAGTAGGT
AAATGATATGACAATAGATGATTTGAAAAGTTTCCATAAAAAAATAATAGAAGAATATGA
CATGGATTCAAACTGGAATCCATCAACTATAAAGCATCATTTAACAACATTATCAGGTAC
AATTGCTAAATATCTAAATTATTGGAGTAGATTAAAACATATTATAATCAAATAGATGA
AGAATACAATGAAAAATATATGATGCTTTATTCACATTATAGAGAAAACTCTAATATTAA
TTACACAGTTACAGAAATTAAAGATTTAATTTCTAAAGACAATGAATTATGTAATATTCG
TGTAAAAAAATCAACAGCTATATTAATAATGGAGTATATTGAAAAATGTGTAGATAATTT
AAACAAAACAAGATATGATTTATCAAATTATATTGAAATAGAAAAATTTTTAAATGGTAA
AGGGTAAATTAAAGAATATAATTATTTAAAATTGAAAGGATTTGAATTGATAAAAATAGA
AAAACTAAACGAATCAGCTTACAAAATAATTTCTGAAACACAATTATATTTAGATGAAAT
```

FIG. 12P. Continuation of (CJLB-7 [organism=Campylobacter phage CJLB-7] complete genome)

```
AAAACAACTATGCTCAGCTAAAATACCAAATGCCCAATTCTTACCAGCTGTAAGGATGGG
ATATTCTGATGGTATTAAATATTTTTATAAAGATTGTGGAGATTATCTAATTGTCCCTAA
AGGTTTTATAAAGGGTATTATAAAACGATTAAATGAAAAATATAAACTTGAGTTATCTTT
TGATGATGAAATAGAAAAAATTACTGAAGAAGAATTTAATAAGTTTGTAAAATCACTTAA
ACTACCTTTTGAACCTTATGACTTTCAATTAAAAGCTGCTTTTGATAGTATTAATACTGG
AAACAATATATGTGTAATGGCAACTGGTAGTGGTAAATCATTAACTATTTACGTTTTATG
TAGATGGTTCATTGAAAATATAAAATACAGATGACAAATTTTGATAATAGTTCCATC
AGTAGTGTTATTAAACCAAATGTATTCTGATTTCAAAGAGTATGGTTTTACAGATATAGA
CAAATATGTTGATAGATTAGGTGGTGATTTTAAGGTAGTGTCTTTTGTAAAAAAATTAAA
CATATCAACATGGCAAAGTTTGTATAGAAATGTTTCATTGTTTAAAGATATAGCTGTTAT
AGTTGAAGATGAGTGTCATACAGCTGCCAGTGATGTTCATGAAAGTATAATATTTCCATC
CGCTACAAACGCAAAGTACAGATTTGGATTTACGGGACATTGCCTCAAAATTATTGTGA
TAAATTATCTTTAATGGCTGTTTTAGGTACTGCTAAACATATGTTACACCAAGAGAGTT
AATTGATATGGGGTTAGCTACTGAAATGGAGATTAAACCTATAATACTAAAATATAATGA
TGCTACAAGTTCTATTGTTAGGACCATTAAAAATTACCAGCAAGAAGTATCATTTTTTCT
TGGAATACCTGAAAGAGATGACATTATAGCTAAAATAATATGCAAAGTTTCACAAAAAGG
AAATAGTATAGTGTTATTTACAAGAGTTTCTAATGGTGAAAACTTAGCTAGAAAAGTGTG
TAAATTAAAACATGGTGTTGATGTTGAAATTAGTGAATTACGAAAATTAAACAAATATAA
CATATTTTTTGTAAGTGGTGAAACAAAAGCTAGTGATAGAGAATCTATAAGACAGATTAT
GGAAAGTTGTGATGATGCTATTATTTTTGGTACTACTTCTATTATGAGTACTGGGGTTAA
TATTAGAAAATTAAAAAATCTTGTATCCACAATGCCTGGTAAAAGTTATATTAAAATTAA
TCAAAGTATAGGGAGAATGCTACGAAAACATGAAACCAAAAATAATATTGTATATTTGTA
TGATATAGTTGATGACGCTAGAGGAAGATATGCAAAGAAAACTATATGTTTAAACATTA
TGAAGAGAGATTAAAATATTATAATGAAAATCAATATGTTATAGACGAGGTAGTTGTTAA
TATATAATTAAGTTAAATCTAAGCTACAATATTGTACAATAACAATTTATAGAAGGGGCA
TTTATGAAGTATATATTTACAATAATTGACAACACATCAAAAACTAAAGTATTAAAAACT
AATATCGATAATAAAGTTAATTTTAGAAATGTTATATGCCCTTCTATAAACTCATTTGCA
CAACTTATTGAGTCAAATTTTATTCTAAGTCGCCCTATTCATTCAAATGGATTGTTTGAA
AGAAAACGAGAAAACATGGATTACTTGCACGACTGTGGGTATATTATACTCGATCTTGAT
AAAGTTACTAAAGATAATTTTCAAAAAATAATTGATTATTTTAAGAATACAAAATGGGAG
TGTTTAATTTGTAATTCAAGGTCATATAATTTTGTTGATAATTTCAATTTAAAAGTTATA
TGCAAGATAGACTACAAATCTACTGACGAAAACATCAGAAACACTTTATTATTCTTTAAA
GAACAGTTAAAAGGATTATGTTCAATAGATGAATCAGCCACAAGACATTCTAGTTATCAA
GCACCATCTTTAAAAGTATCAGTATTTTACAAGAATGAAAACGATATAGGTATCCCATTT
TCAATTCTACCAAAATCACAATCTAAAACAACATCAATAAACTGTTCTAATAAACAAGTA
GAATGGTGTTTAAATTATATAAAAACTAAGTTAAAAGGAAATATAAAAGAGTATGTTGGT
TATTATTCAATAAATTTGCCTTCAGAAAAAAAGTCAAAATATTCATATTGTTTGTATGAA
ACAAACCCTTTTGTTATATTTCATCCAAACCCATCAAAAAATATAAACATATTACAAGAG
TATTTGAAAACAAAAGATGGTAAAGCATTTCTACAAGAAAAACAAAGTAAAATAATATTG
TCATCACTTAAATACACACCTGATATACACATAAACCAAAAATTTCTGAAAAATATTGAT
ATTCCTGATACTAGAGTAGTTTGTATTAAATCACCTATGGGTAGTGGTAAATCAAATATC
ATAAATCAATATATTAAAGATAAATCAAAAATATTATTCATTAGTGTTAGGCAAACTCTT
GCAAAAGATATATCATTAAAATATGGATGTAAATATTATCTAGAAGATAAAAAAATATTA
TATGGTGAAAATTATGTATGCCAAATAAACTCGTTACACAAATAAATCTAGACTACTTT
GATTATGTAATATTAGATGAGTTTGAAACATTATTAATGTATATTGTAACTAGTATAGAG
GATTCACCATATGCGTTAAATATACTTAGAAAATTCTACAATATATTAAACTCAAAATAC
CTTTTAATATTAGATGCATTTTTAAGTGATCATTCTAATATTTTAAGTGATGTATGCAGA
ATAAAAAACCATTATAAAGACCAAACAAATGTTAGCCTTTATACAAAAAAGAATACATTC
TTTTCAGTATTAGAATATGTTTGTAAAAACAAAAATAGAAATGAAGTTGTTACAATGTCA
TTTTCTACATTATCTGAGTTTAAAACGGTTGAGAGTCTTTTAATTAAAAGTAATTTAAAA
GTAATATCTATAAACAGTAATACAAACAGATTCATTAGAGATAATATATTTACAGAATAT
TTTAAAAGAAATATGTTAATTATGATTGTATTTATTTCGCCTAGCATTACAGTAGGT
GTTTCTATTATGAATAACATAAGTCATCATTTTCACTTTGATAATAGTGCTAGTATAGAT
GCTATCACATCTATTCAAATGGTAAAAAGATCAAGATTAGCATCGAATATTCATATTTTT
GTTGAAGGTTCTACAAATATGATTACTCCACTTGAAGTTGAAAAGAATATTATTGATTCT
TTTGAAATCGATGACTTAGAATATTTAAGTGAGTTTATAACAAATTATGTTATTATTAT
GAAACTATTGAATTAAACCATAAGATGTCATTTGTTTATTATTACAAGATCAGTTTAGT
AATATAAACATAGTTGATAGTATTGTAAATTATAATATAGTTCAAGCTGATATATCTAAG
GAAATAGAGTTAAATGAATTTGAAAACAGTAAAATTAAAGATGAATTGATTTGTGCTATC
AAAAAGGATAAAAATTATTTAAATTATATTCGCAATTTAAATTTTATACGCTAAATAAA
AATAAAAATGAATTCCTGGAAAACTATTTGCTGAATAATCCATCTAATTTGCTTGAATTA
TCTCATAGAGCTAAGTTTCTAAAATATTGTGTAACATATCCAGATATTAGATTAAAAGAT
ATTTTTACATATAATGACATACAAAATATAAAATATACAACAGATTACTTTTCATTTACA
AATTTTCTAAAAGAACTAGGATATAAAAAAATGAATGGTAATTATTATCTGCCATTACAA
TATATTAAACATTTAAGTAAGATATAAATATTTCGCATAAAACATTAAGGAGAAAATATG
GTAGAAATTATGATTTCATTTTTTGCAGGCGGATTAATAGGTTTTGTTGCTGGATATTTT
```

FIG. 12Q. Continuation of (CJLB-7 [organism=Campylobacter phage CJLB-7] complete genome)

```
GTTTATCATAACAATAAGGAAAAAGCTTCTGAAATTGGTGATAAAATAGAATCAGTAAAA
GATGAAATAATTAAAAAATAGCTAGGAATAATATCCTAGCTTACAAGGATATTAATGTAT
TATAGTAATGTTGTATTTCCACTAAATGAAGTTATTCCTGGTTTTACATATAATGTAAAA
AAGTCTAAATCAAATGTCTATATTAGATTTGTTGCTTATGGTTACTCAATAGATGATCTT
GAAATAGTTTATAATAATAGCATCATAACAATTTCGACTATTAAAGATTATCATGAAGTA
AAAACAGACCCAAAATTTTCAAATAATTTTCCACAGCAGGATAAATTTTATATTCAATTT
TGGTGTCCAAAAATAAGCGGAATCAACGCAGAATATAGTGGTAATTTTATAAAATTAAAC
TGTTCACTAGGTGATATTAGTGTTAATTTAGGAGTAGTTCCTATTAAATTTATAAATGAA
GATAATGATGTTGATATATTAGAAAATACTTCTGATGATACCATGAATATAATCCAATTA
AATGGATTTATGGATGAATTAGAAGGCATAAAAGATGATTTTTATAGTGAAATAACAAAC
AATAAGGATTAAATATGGCAAAATTAATATTACAAAGAAATAAAGAATATACAGGTATAA
AGTGGCAAAATAGTGATAAAATAGAAGGTTCTACCATTGGTGAATTATCATTATTAGATG
ATAACGATAATGTTATCTTTAAGTGTGCTAGTTGTGAAAATATAGGTCCTAGTACTGATG
AGTCTGGAACTGATAAGAGAATAGTAGCTAGAGAGTATAAATTAAAATGGTGCAATTCAA
GTAAAAATGGATTATTAGCTAAAAAATATCCAGAATGGAAAGCAGATAATGGATCAAATA
TTGCAATATGGGTTGTTTCTGATGAGGTAGAAGGATTTAATAATGACTTATCGTATCC
ATACAGGAAATGCACCACAGCATACTGAAGGTTGTATATTACCAGGTTCTGATTTAAATA
ATGGCACAGTTGGTAGTAGTGTAGACATAACAAATGAGTTATTTACAAAAATAAAAGAGT
TAGGAATTGAAAATATAGTTTTTGAAATAAAAGAAATAGATTAAGGTGTTTTTAAGCGTA
AGTGTTATACACTTACGCAAAATTAATGAAAGGAAGATTATGGATAACTTTGATGTAAAT
TCATTTAAAATTGTTCATCCACATGATGTTTTGTTAGAAGTTACATATCCATCTGAGATA
AAATCAGAAAGTGGCATTGTTGTAACTGTGCACCCATCACTTATTGATGATAGACAAACA
CAAGGAAAAGTATTACAAATAGGATCAGAAGTTAAAGATATTGAAATAGGTGATACAGTT
GTTTTTGGAAAACAACATGGTATTGATTTATGCAAAAGCGATAAAGTAAAATAAATATGCTT
ATTCGTGATGAGTCTTTAATGGGAATATTAAAATAAAGGAGTGATAATGGCTAAATCGTT
AAGAGAATGGTGCAGAACACATGTAAAAAACATGGCTGATAGTTTTGAAGACTTTGAAAT
TTTTAGAACTCAGTTTTATAGGAATCCACATAGAGCAATTATAAAGGATTCAAGTTCCTT
TAAAAGCCCAGCTGATGGTGTTATAATTAATCAAACCCAAGTAAATGATATTGATGATGA
AGTCCTTAAAATAAAAGGGAAAAAATATACCTTACGAAATGCGTTAGGAAATAACGAAGA
AATGCTTAATTTAATAAAAGAGCGTGGTGGTGCGTTAGTTATTGATGTGTTTATGACTTA
TTATGATGTTCATTATAACCGTATTCCAACAGATGGTTTTTTAACATACGAAAAATTATT
ACCAACAGAAAGCTATAATAATGAGAGTATGTTAGCTGTTGAAGAAGGTTTATTTGCAAA
TAACTTTAAAAAAGCACTAACAGAGTTAGGCTATATGTTTTGTAACGAAAGGTTATTAAA
TATTATATATTCACCTGTATTGCAAGAAAAATATGCTGTAGTCCAAATAGCTGACGAGCA
AATTAATTGTATTCAAACAGCATGGGTTCCAGCAAGAGGGGAACCAAATACCCATTTATA
TCAACAAGGGGATATTTTTGGGAATATTAGAAAAGGTAGCCAATGCACAATAGTAATACC
ATTTAGTAATAAATGGAATTATGTTCCTATTTTAGAACCTAGTTTCCATGTAGAGGCTGG
TATTGATGAACTTGTTAGAGTTGAACCAAAATAAAATTAATATGTTAAAAGAATGGGGAT
TCACCCCCATTTCTTCTAATTTAAATTATGGGTTAGAAGTAAAATGTGATAAATGTGGTT
CTAATATAAAAAGAAGTTGGAACCAAATGCTTAAGTACAATAAATGTTTATCATGTGATG
ATAATAAATTATTATTAGAGTTAAATAATTTAGGTTATGTTGTAACGGATATACGATTAT
CTAAATTAGAGATACAATGTAAAAATAACCATATATTTAATAGAAATAAAGCAGACTTTA
AAAGGGGTATAATATCATGCCCAGAATGTGACGAATTAGAAAAACTAGAATTTATTAAAT
CATGTGGTTTTACAAAAATTGATGTAAATCATATGAGATGTAACAAATGCAATAATATAG
TTAAAAAGAGTTATCCAACTCTAAAAAGTGGGATAACATTTTGTAAATTTTGTGATGAAA
ATGATAAGAAATCGCTATTGAATAATATAAGTTTAGAGATGGTTGATAAAAATATTTTA
AATGTAACAAAGGACATACATTTTATAGAACTTATGATAATTTAATAAAATCAAATAATT
TATGTCCTGAGTGTTATCCAAATAATACAATGTTTGAAAAGAATTAAAAGAAATACTCC
CAAAATGTATAGAAAATGACTACTCGATTCTAGGTGATAAAGAACTAGACTTCTACTTAC
CAGACTATAACTTAGCCATAGAATGTAATGGTGTTTATTGGCACTCAGATAAATTTAAAG
ATAAAAACTATCATTTAAATAAAACAGAAAAGTGTAAAGAGAAAGGTATTCAGCTTTTAC
ATATATTCGAATCATCTTGGATAGAGAAAAAAGATATATGGAAGTCAATTATAAACAATA
AATTAGGAAAGTCAGAGAGAATAATGGCTAGAAAATGTATTCCTAAAACAAGTATCTAAAG
CAGAAGAGAAAGAGTTTTTGGATGAAAATCATCTCCAAGGATTTACTGTTTAATAATGAA
CTAGTTTGTTTAATGTCATTTGGAAAACCAAGGTTTACTAACAAATATAATTGGGAGCTA
ATTAGATTATGTACTAAAATGGGTGTGAATGTTATAGGTGGTGCATCTAAATTACTTTGT
TATTTCCATAAAAATAATCCTGGATCATTAATAAGTTACTCTGATAGGTTATATTCTAAT
GGTGAAATCTATAAACAATTAGGATTCGAATTTAGTCATTTTTCTAAACCTGGCTACATG
TATACAAAAAATGGTAGAACGCTCAATAGACAACAATTTATGAAACACAAACTTAAAGAT
AAGTTAGAAAATTTGATCCAAACTTAACTGAATCAGAGAATATGAGTATTAATGGATAT
TATAAAATATGGGATTGTGGACAAGGGGTATGGGTTAAATCATAACCCCACTATTCCTGT
AACAGCATCTATAATAGATTCTGTTTCTTTTTTGTATACATAATGTGTATATCCAAATGT
TACGCTAAATTCATTAATTGTTTCTGTTTGATCATCTTGCATATCACTTCCGGTCACATC
AATAGGAAAGATATTTTTATATGTATAACTTCCAACAGCATTACCACTATAATTTAATAA
GGTTAATTTCAATTCACCAGTCATATTAATATCAGTATTACCACTTACACCTTTATTTAT
ACCTAGGAAACTATTAACAGCATTACCAACAATTGGTATATCACTTGTAATATCAGATAT
```

FIG. 12R. Continuation of (CJLB-7 [organism=Campylobacter phage CJLB-7] complete genome)

```
AAAACCTGCTCCAATGTTAGCAACTGATCCTATAATATTAGCAACACCAGCACCAGGAAC
TGATGGTGTTTCTTCATTTGCGGTTATACCTGAATCAATACAAAAAGTCCAGTACTCTAA
TATACGCCTTACACTTGATTTTTCATCTATAAAAAATGTCATATTTGTAGTGTTATCAAG
TTTCATTAATGTTGGTATATTTATAGTTCTACCATCTAAACCAACAGGTGTAGTTAATAT
AGAAGGTGCTGGTAAAGTAGCACCCTTGCATAATATATTAACTGCATTGTCATATAACGC
ACCTGATATTTTTGTTATTTTAGCAGGTAAATTTAATGACACTTTATATCTAAAAGGTCT
TTGTCCAGAACTTAAAACATAATCAACAGAATCAAACTTGTTTAAACCCATTATTATGAC
TTTCTTCTTAATTTAGCTACTAATTTCATGGTTCTTCTTAGTTTTGGATCTTTTCTAACA
TATCCTCTCTTTTTAGAAGACCATGACATATTTTCGTAAGGAGCTTTTGCGTTTTTTTA
GCTCTTATTTTTAGTTTTCTTTTAACTTTTGGTTGTTTTCTATATCTTTTTTGTGCTATT
CTATCAGCTACACTCATATGTTTAATAGGTGGCATCTTAATAATCCTTTTTTAAGATATT
TATATTAATCATCAAAAATACCGTAAATGATGAAGTACCATCATCAAAAAATCCCATTT
GTAAATATTTTACATCACCATCAGTTGTTTCAGAATCACCGTTTATTTTATTTAAAAATA
CATTATAATCAACTATATTATTTAAATCTAACAAAGGTACAAACAAAAGACTTAATGCCA
TAACATAATCATCATGGGCCTTTGAGTTTTGTGCTTGGTATTTTCCATTAACATTACAAA
ATGTCAGCAACTCTTTAACAGTTGGTTCATCTTGTAATATTAGTTTGTTATTTTCAATAA
AAAGTTTCATGTTACTAAGATTTTTACTTCTATTGCTTTTAGTTGTCCTGACTCCTAACC
ATTTTTTATCTGGCTCTTGATATATATTTTCATATTCATACATTTGGAATAGTAAATCAA
CCACGCTTGTACCAGCACCCTCATTATTTTCACATACAAACATAGCCTCATTATATGTTC
TTAAAATATTATAAAAAATAGGTGGTGCCATCAAATAAGATTCTGGTATTTTTCCTGACG
CTACTTGTTTAAAAGGAATATTTGTTACATCTATTACATGAAATACAAAACCATCTATTG
CACCTTTTGCAGCATCAGCTAGAACCATATATTTGTGATTTATTTGTGGGGCTTCATATA
CTCTTATTGTTTCACCAAAATTTGGTTCTCTTAAAATATTTCCAAATTTAATATTAGATA
AAACGGTCATATCAACAAGAGTATCAGAACTTCCTATAAATTCACATGCATACTCTTGGT
TCCAGGTTCTAATACCTCCCTCGAGAGTTTTTATCATAAGTTCTTTATAATTTTCATCTC
TGCCTGGTACTTTCCACCATTCAACTTTAAAAGGTTTATATGAGCTCTTGCCTTCAACAG
CATCTGACCACATTTTATACCAATGATTTAACCCTACTGGTGTAGAAGCTGCTATTATTT
GTGATTTTTTAGATGCGGATATTGTAGGTATTACAGAGTTACTAAATTCTGACCATTTAT
CTATAAACGCACAATTGTGTGAAACAAAATGATTTGTATAATACTCGTTATTTTTATGTA
CATTAATTAAGTCATATACATATTCTACTCCAACATAATCTATTGAAACAATTTTTGAAA
ACTTATTTTTATATTTTATCAAATCATTAATTTTAAGATGTTTTAATTGTTTAAAACCAT
TAGGTGTTTCAAATTTATGACCTTTTGTTACTTTTATAAAATCATCTTCTGTTATTACTT
TATATACATCTTTTTTTTCTCTTGATATATCATCAAAATCACTAAATCCATTTGGTGTTA
GCACTTCATACATGTTTCTCCTTTATCATATTAAGAGGATTAACCTCTTAATAATGGAAG
TGGTTCACAATAGTTTTCTAGTAATACTGTTTCTAATCTTTCTAATTCAGTATTTGCTTC
TTGTATAATTCTTTCATAATTAGCTTTAATACCACCTATTAACGGTGCATCATATTTTCC
TATATTTGAACCCCAAGTTCTTTTGCATAAGTTTAAAGCATATTCTTTAACCCATGGTTG
CTCGTATATCCCATCTTCTTCTCTGGTATATACTTATATCTGACTTCTAACAAAACCTT
TTCAGAGTTTATGTCTTCAAAAAACTCTAACATATTTGTAAATGGATTAAAAGCATAATT
TGGTATTATTGTAAAATATGTATCAAGTATAGACATATTTGCTAATACAGAATATATGTT
TTGCATACTAAAGTTACCTTGTACTGTTCCACCAAATAGCATTGCTTGCATTTCAGTTGG
TGTTATTACTAAACCACCTGGAATACTTAACCCTAAAAAACCTCCGCCACTTGGATATAT
TCGTAATGTTATAACCTCAGAAATTTTAGGGTCTAATTTAATTTTTCTCACACCTTTAGG
TAGGTCAATTAATAGTGTGCCTTTTAACTTACCATACATAGCAAACTCAGAAAACTTTTG
TATAGTAAAGTTAATATTCTCATCTATTTGGAAATCAGTAAGTTCCACAGTAATAACTGG
GGAACCTAACATTCCAAAAATATAATCTTTGAGACTTTGCCTAGTAGCCATTATCAACCA
CCCATAGTGTTAACAGTTACATTAAGAGTTTTTGATATTTGATTTCCACCATCAGCTTGT
GCTTTAACTGTGATTGTAAATGATCCAGTTTTACTTGCTTTTGGTGTTACTTGAATCTTA
TTACCTGATTTAACAGCTTGTATATTTTGACTATTAAATTCTAATGTAAAATCTGAAGCA
TTAGTTGTAACTGTTACTTCTTGCATTGGAGCACTTGCATTAGCGAAAGTTAAATTATCA
GGTGAAAGAGTTAAAGTTGTTACTACTGTTGCTTTTGTAACAGTTAAAGGTAATTCTTTC
ATAGCTGTTCTACCTTTATCATCTGTAAGTTCAAATATAGCTTTACCTGAACCTTCTTCA
TTTCCTGTAAATGTTTTGTCACCTTCATTCCATGTAGCTAAATCACTTGGTTCTACTGTT
ACAACAGCTGATGTAATTGATGACCCATCGGTAGCTGTATAAGTTATTGCTTGTGACTTT
TTACCGTCTTCAAAAGTTAAACTATCAGGTGTTAAAGTTACTTGTAAATCGGATAAAAA
ACATTATCTTTACCACCAAAAATTGTGGAAATTTAACTGCTACATCTGATGGATATTCA
AATCCAGGTAAAATATAGTTAGTTGTACCATTAATATCTATATATTTAGGTTTATCTTCT
GTATAAGCGAATTTATTTTGTTTTGGTATATTAGTCATGAGTATCCTTTATAAATATTTG
ATATTATTTATAAAGGAAATTGATGGCAAATATGTTTAATGGTCTAGTTGAATCTGTCAA
AAAAACCTTTCTAAAAGTAGAAAATAAGGAAGGTTCTATTAAATCAGATGACCCACATAA
AGAAGCCAACCTTACAAGAGATGATATTGTATTAGGTTATTTTGATGAAGGGAATTATAG
ATATAATAATTTTGAGACGGATATAATTAGTGATGTATCAAAACAAGCAAGCTTAATAAA
AGAATACAGAAGAATAGCAGCATATCCTGAAGTCGCAGATGCTATTGATGAAATAACGAA
TGAAATGTCATTTGTACCCAACAATATTGATTGTTGCTATTTAGGGTTCAAAGATAATAT
ATTATCTGATAATTTGAAAGAAGCATTCCAATCGTTATTTGATATGTCATGTGAAATATT
GCAGTTAAATGAAAACATAGATGTTTTGTGTAGAAGATTCTATATAGATGGGCAATTAAT
```

FIG. 12S. Continuation of (CJLB-7 [organism=Campylobacter phage CJLB-7] complete genome)

```
AATAGGTTTATCTTACGATGATAACAATAATATACTTGATGCAGTTATAATGAACCCATC
AGGGTTATATTTTAATAAATCAACAAACAAATGGCAGTATTTTAATAATAGCAATAATTA
TGGAGTAACAGATGACACTTCTAAAGTATATGACCCAGAAGAAATTATAAGAATTGATTC
AGGATTATACTCTGATAATTTAATATTATCTCATTTGCATAGTGTTATAAAAATCGTAAA
TCAACTACAAACATTAGAAGACCTTATGATACCGTTAAGATATTCAAGATCTGTGTCTCG
TAGAGTATTTAATATTGATGTCGGTAATCTTGGGTACGAAAAAGCAATTGCAGCCGTTGA
AGATATTAAAAATAAATTTAAATATAAAAAATATTATAATACAGAAACCGGTAGTATATC
AAATGGTGCATCAATCCAGTCTATGGTAGAGGATTATTATTTTCCAAATAGAGGTGGTAC
AAAAGGAACTCAAGTAGATGTTTTAGATGAAACTGGAAATTTAGGTGAAACTGGAGATTT
AGATTACTTTAAAAATAAACTATATAATGCTTTAAAAGTTCCAACATCACGATTAATGGG
TGAAAATAAAACTGTATTTGACTTTAGCTCAACATCAATAGAATCAACCGAGATTAAGTT
TTTTGCTTTTATTAACAGATTAAGACAAAGATTTAATGTTTTATTAATTGAAATTATGAA
ACGTATATGCCATAACAAATAATATTCTTACAGAAGATGAATTTGATAATTATTCAAAATA
TATTTTTATAGGTTGGGAAAAAGAATCCAATTTCTTAGAAAGACAAAACTTAGATATATT
AAAACAGAGGCTAGATCTTTATACTGAATTTAAAGAATATGAAGGTGATATATTTAGCAA
ATCATATTTACTAAAAAATGTTTTAAAAATGACTGATGAAGAAATAGACCAAATGAGAGA
GGAAATTCTTCAAGAAGGTAGTCAAACAACTCCAGGTGAAGATGAATTTGGTAATGAAAT
CACAGATGATGAAGATAATTTTAAGAATGATATTGAAGATGAACCTGAAGATGAACTCTC
TAGATAATATAGAAAGTAAAAACTTAAAAATTAAAGATGATATATCTGATAATAAAAGAA
ATATAATTAAAAAAGCTACAAAATTAGGTATACCTAAAAATATTATAAATCAAAAAATTA
AAAAAGCTACAAAATTAATAAAAGGAGAATAAATGTATAATTATGTAAAATATGTTGAAA
GAAAAGACATGGATGGACTTTCTAATGTAATTCAAAAAAAGCTTCAACAAGAATATAATA
ATCATCCAAAAGTTGTAAATCACATTGAAACTATTAAGAAAAATGAAGCTTTAATTAAAG
TATTAAAGGAGTATAAATGAAACTAATTATAGAAGAACCGGTAAAAATAAAAGGTTCAGT
AGAACTAAACGAGTCTAGAGGTGAAAAAAATTATTATATACAAGGTATATTTGCAACTAT
AAATCAACAAAATATAAATGGTAGAGTATATCCAAGACCTATTTGGGAAAGTGCTGTTAA
TTCATACCAGCATCATATAACTACCCCTACTACAAGTTCTTTAATGGAATATCAACATCC
AAATAGACAATATGTTGATCCACTTGAAGCTGTAGCAAAATAGTAGATCTTAGAATTGA
AGGTGATTATGTTATGGGGAAAGCAAATTGCTTGATAATCCAAAAGCAAATCAACTAAA
GAACCTAATTGATGAAGGTATATCTATAGGTGTTTCTAGCAGGGGTTGTGGTGAGCTAAT
GAATGGAACAGTTACAGAATATGAATTAATTACATTTGATATAGTGCCAAATCCGTCTGA
TAGAAATGCACACTAAAGGTCTAAATGAATCTTTTGATAATGGTATATTAAAAGATAA
AAATTATATTAAAGATAAAAATGGTATACTTGTAGAGGCAGATGAAAGTAATATAAATAA
CAAGAGTATAACTTCTCAGTTTGTCGATTTATTTTCACAATTATAAAGGAATTATCATGG
AAGAACTTTTAAGTAAACTTGATAAAAATGTTTTTACACCTGAAGTTGTTGGTGAAATAA
AAGAATTATTTGAAGCAGCTGTTGATAATAAAGTTGAAGCTGCTTTAAAAATCGCTGATA
TTCACGCAATTGAAGTTGATAAACATTATGAAAAACAAGTTAAAATGCTAAAAGAAAGTG
CTGAAATGTATAAACAACAGGTTAATAAAAATAACCAAAAAGTTATACATAATGCCATTA
ATAGAGTAAAAAAACATTACAATAAGCTAGTTGAAAATATTATTAAGGATAAAGTTGATG
AATTTGTTAAAAAAGGATCAATGAACCTTGAAATACTAGTTGAAAGTAGTAACAAAAAAG
TAGTTGATGCATGTGCTAGAACCGCTGACAAAGTAGGTGGTCCTATAAACGCATTGAAAA
GAATTAATGAAAGTGTTAAAAAAGAAAAAAACGTTAAAAAATTAGAAGAAAAAAATAAAA
AACTTCAGATGAAACTAGAAGAGGCTCAAAAAAATAATATATATAACAATATAAGAAATA
CAGTAAGCATTGGAAATAGAGATATATTTGATACACTTGCTGAAAGTGTAGCATATACTG
GTGATATTTCTTATGAATCAAACCTTAAATCTATTGCCAATAAAATAGAATTAAAGTCAA
AAACTATTAGCAGAAAAAGTACAGGTGGAAAGCAACACTTTCTGAGTCACAAAATAATA
CCACTTATGGTAATTTTTTATAAATAATACATATTAACCAAAGGAGAAAATACTATGGCT
GACAAATATTTGTTAGATGAATCAACAAAAGAAAAATTTATTACAAGCAACTTATATCCT
AATCTCAATGAATCTGAGAAAAATATAATGAGAACTGTGCTTGAAAACCAAGGAAACGAA
GTAAAAATGCTTATGGAAAGCACTGTAACTGGTGATATTGCAAAATTTACACCAATCTTA
GTTCCAGTAATTCGTAGAGCATTACCTAGTTTGATTGGTACTGAAATAGCTGGTGTTCAA
GCACTTAAAACTCCAACTGCTTATTTGTATGCAATGGTTCCACACTATGTAGGTGATGGT
AATAATAGTGTTAGTCCAACAAAAAATGCTATTGTTTTAAAACTTAAAACAGAATCTGGA
AATAAAAATGACTTTAATTATACTGGAACTCCTATTGAAGTTTCATTTAAGACAGCTACA
ACTGTTAAAGGTAAAATAGTATATAGTGAGAAACAAGCAGGTACAGATGATGTGGTAAAT
GTATTACTTCGCTTAGAATCTAACTCAACTGGTTCTGTTGCTATTGGTGATGAAATGGAT
AAAGCAGCTTCATTTGCTACTAAAAAAGCAACTGTTGAGGCTGTATATACAAATGAAGCT
TTATGGTTAAAAGTTCTTAAAAACTATACTGGTCCTTATGCAACAGCAGCTGGTGAAGCT
CTTGGTAAAGACATGAAAGAAATGGGTATTAGTGTTCAAAGAGTGTTAGCTGAAGCTAAA
ACTAGAAAAGTAAAAGGTACTTATACTATTGAAATGTTACAAGACTTAAAAGCACAACAC
GGAATAAATGCTGAAAAAGAACTAGCTGATATTTTAAGTGCAGAAGTTGCTCTTGAAATT
GACAGAACTATCATTGAAAAAGCAAATGAAGTTGCTACTGTATGTACTGATTTTGATGTT
AATAGTGCAGATGGTAGATGGTTTATTGAAAAAGCAAGAGGTTTAAGTATGAGAATTAGC
AATGAAGCTAGAGAAATCGGTCGCCAAACTAGAAAGGTGGTGGTAATAAATTAATCGTT
TCTCCAAAAGTTGCTACAATTCTTGACGAAATTGGATCATTTGTTTTATCTCCAGCAGGA
AGTAAGATTGATGCTATTAACAGTGGTATTAAACCAAATGTTGGTAAATTCGATAATCGT
```

FIG. 12T. Continuation of (CJLB-7 [organism=Campylobacter phage CJLB-7] complete genome)

```
TACGATGTAATTGTTGATAACTTTGCTGAATTTGATTATTGTACTGTTGCTTATAAAGGA
GCATCAAACTTTGATGCTGGTATTTTCTTTGCACCATATACATTACATTACAACAAAAT
TTAACAGATCCAGTAAGTGGGCAACCTGCTATGATTTTAAATAACAGATATGATGTTGTT
GCTACTCCATTACACCCAGAAGCATTCATCAGAACATTTGCTGTTAATTTAAATAACTAC
ATAATCTCTTAGTAGATAACTCGGACTTTGTAAGTCCGAGTCACATTAATTAAGCCCCTC
TTAAGCTACATTATTATATACTCCCCAAAAAATCATAATGGATTATTAATGGATAGAATA
GAATATCTTAAATCACTTGGATATACACCTGTATCATCTAATTTAGCAAACAATCTTGAG
GTATTATGCCATAAATGTAATAATACTTTTAAAAGATCATTTTATACATTTAAAAATGGT
TCAGTAGATTGTCCTAATTGTCAAAATATAGAAAGACTAAACTATCTTAAAAGTATTGGG
TTTGAAGCTGTTGATTTATATAATGTAAAATGTCTAAAAGGACACATTTTTAAAAGACGA
TTCAGTGAATTTAAAAATGGTGCTACTACTTGTCCAATATGTATAGACAACGAAAAACAA
GAGTTTATTAAAGGTTTAGGATATATTATAAAAGACATTAAAGGGGATAATTTTACAGTA
GAATGTCAAAAGGTCATGTTTTTAATAGAGTATATTCTAGCTTCAGGTTAAAAAATATA
ATATTTTGCCCTGAGTGTAAAAATAACGAAAAAACACTATTCTTAAACAGTGTGGGATTA
AAGAAAATAAAATCAGCTGGAGATAGAATGACATTACAGTGCTCCAAAGGGCATACTTTT
GTTAGAAGATATTGTGATATCAAAAGAGGTAGTGTAAATTGTCCAGAGTGTATTATTAAT
ATTAAAGAGGAATACTTAAAGTCAATAGGATTACTCTGATTAAAACAAATGTTGTAAAA
TGTTCCAAAGGTCATATTTTCAATAGAAGTTATTCCGATTTGTTAATGGTAGTATTGCC
TGTCCTACATGTCAAAGGAAAACATATTAAATTTTATAGAATCAAATGGTTTGCAACTG
GTATCATTAGGTAAGAGTATAAAACTAAATGTCAAAATGATCACATTTTTACCAGGGCC
TTCAATACATTAAAAGTTAATACAACATGTCCTATTTGTGACAAAGAGAAAAGAAAATTT
TTTATAGAGTCCTTTGGTATTAAATTATTAAAAGACGGGAATAGGTTACAATTACAATGT
AGTAAAGGGCATGTTTTTGAGCGTGAATATTGTAATTTTAAGAAATGCACATTATGCCCA
GTATGCAATCCTTCTACTAGCTCATTTGAAAAAGAAATATCAGAGTTATTAACAAACTAT
AACAAAAATGACAGAAACATACTAGATGGCAAAGAACTTGATTTTTATCTGCCAGAATAT
AATCTAGCTATTGAATGTAATGGAGATTATTGGCATTCTGAGAGTAATGGAAAAGATAAA
AATTATCACCTCAATAAGACTAACAAATGTCTAGAAAGAGGCATACAATTACTACATATA
TTTGAGTCATCTTGGATAGAGAAAAAAGATATATGGACTAGTATTATAAACAATAAACTA
GGGAAGTCTAAGAAGATAATGGCTAGGAAATGTATTTTGAAAAAAGTTGATAAAGCAGAA
GAGAAAGAGTTCCTAGATACAAATCACCTCCAAGGATTTACTGGATCAACTGTATGTTAT
GGATTATATTATAAAGATGAGTTAGTTTGCTTAATGTCATTTGGAAAACCTAGATTTACA
GATAAGTATGACTGGGAGTTGATCAGATTATGTACTAAAATGGGATTAAATATAATGGGT
GGTGCTTCTAAATTGTTGAAACATTTCCACAAACATAACCCTGGGTCATTAATAAGTTAC
TCTGATAGGTTATATTCTGATGGAAGTATATATTTGAAGCTTGGATTCACATTTAGCCAT
TATTCTAAGCCAGGTTACTATTATTTTAAGAATGGAATAAAATATTCAAGACAACAATTT
ATGAAACACAAACTTAAAGACAAATTAGAAATATTTGATCCAAATAAGACAGAATATGAA
AATATGATTGAAAATGGATACTATAGAATATGGGACTGCGGTCAAGGGGTATGGGTTAAG
GAAAGTTTAAGTAAAAATATTGTATAATATAAATAATATTAAAGGAAGTGAGATGAATGA
AATAAATGTAGTAAAAACCTATACAAATGGTGAAATTGCATTATGTAATCTTGCCAGTAT
AAACTTGCACGAGTATGATTTATTAAGTGATACAGAAAAATATAATCTAATATATGATAT
AGTAAGTACAATGGATAATACAATTGATCTGGCTTATTATATGGTCAAAGATGCACAAAC
AGCTAACAAAAAATATCGCTATTTAGGAATAGGTGTATCTAACTTAGCTGTTTTATTAGC
AAAACATAAAATTATTATTGATTCACAAGAAAGTTTAGAATTTCAAGCAAACTTTTTGA
TGAATTATTATATAATTGTGTAAAAGCTAGTATGCAGTTAGCCATTGAAAAGGAAGAGC
AGAAGGTTTTAATGAAACAAAATGGGCCAAAGGTTTATATCCTTATTTAATAGGAAATAA
AAAGGCAAAAAAATTGATAAAATTTAAACCTGATGAAAACAAGTGGAATAAACTGATGGA
AGATGTTAAGAAGTATGGGATGAGAAATTGCGCACTAATGGCCATAGCTCCAACAGCAAC
ATCAGGAAGATCTATTAATGCATCAGAAAGTATAGAACCTATTCAAAAGCTTTTATATAA
AGAAGATGGAAATATAAACATTAAAACATTAGCACCTATGTTTAAAGAATATAATCAATA
TTATAAGTTAGCTCAGGAATGTGATCCTATGATGTTAATAAAAGCTGCAGCTGTTCGTCA
ATTATTTTTGGATCAGAGTCAAAGTGTAAATATGTATTCTTATACATTTAATGGTGAATT
AAATTATATTCAAAAGAGTTCTCACAAACTATCTCTGCTGCATATGTATGCACATCAGTT
AGGATTAAAGACTTTATATTATTTTAAGTCTGAAAAAGATAATGGTGTAGAACACGAATG
TGAGTCATGTTCATAATATAGATGGATAAAGTATTATTTTTAAATGACCTGGGATATAAA
CCTATATCCCAGAGTATGTCAAAAGATTTAGAAGTAGAATGTAAAAATGGTCATATTTTT
AAAAGACCATTTAGTGATTTTAAAAGAGGTAGAGTAAATTGTCCTAAATGCGAAGTTCAA
GCAAAAATAGAATTATTGAATAATTTAGGTATATGAAATTATCTCAAACAATTTAGGAAAT
GACTTAGAGGTAAGATGTAAAAATGGTCATATATTCAAGAAACATTTAGTTATTTCAAA
ACAGGTTGTGCTAAATGACCTGTATGTGAAAAAACAGAAAAACACACTTTTTAAATAAT
GTAGGATAAAAAGTATTTCTGAAAATTTAGCAGACCATTTAAAAGTAGAATGTCAAAAT
GGTCATACTTTTAAAAGACCATTTAGTGATTTTAAAAAAGGTGTTATTAGATGCCTTAAA
TGTGAAGAACAAGGAAAATAAACTTTTTACACAATTTAGGATATGAAATTATAACAGAT
AATTTAAATAAGAGTATGATAGTTAAATGTAAAAATAAACATACTTTTAAAGAGACTTT
GATACATTTAAAAAAGGTTTTACAAACTGTCCAGAATGTGAAAAACAAGAAAAAATATTA
TTCTTAGAGAACTTAAAATATACAGTAATTTCAAATAATCTTTCAAAAAATCTAGTTGTA
CAATGTAAACATGGACACACATTTAAAAGAGATTTTATCACATTTAAACAAGGTTCAATA
```

FIG. 12U. Continuation of (CJLB-7 [organism=Campylobacter phage CJLB-7] complete genome)

```
AACTGTCCAGAATGTGAAAAGCAAGAAAAAATAAACTTTTTACACAATTTAGGATATGAA
ATACTCTCAGAAAACTTATCAGATAAGCTAATTGTAAAATGCAAAAAAGGTCATACTTTT
ACAAGAAATTATGGTAGCTTTAAAGAAGGTATCACTATTTGCCTTGAATGTGAAAAAGAT
AATAAAATATCATATTTGAGTACGCTAGGATATGAAATAGTTTCTGATAACATGGCTGAT
AATTTACAAGTAAATGCAATAAAGGGCATGTTTTTAATAGAACTTATAGTAATTTTAAA
AAGGGACAAACGATATGTCCTATTTGTGACCCTTTTAACAGTTCATTTGAGAATGAAGTA
TCAAACATTTTGAATAATTATATTAAAGGAAATAGAAGTATATTAGATGGCAAAGAACTT
GACTTCTATTTACCAGAACATAACTTAGCTATAGAATGTAATGGAGATTACTGGCATTCT
GAGCAAATGGGTAAAAATAATAGTTATCATTTGAATAAAACAGAGAAATGTGAATCTAAG
GGGATCCAGTTATTACATGTATTCGAATCATCATGGAATGAAAAGAAAGACATATGGACT
AGTATTATTAGTAATAAATTAGGAAAGTCTAAGAAAATAATGGCTAGGAAATGTATTTTA
AGAGAGGTATCTAAAACAGAAGAGAAAGAATTTCTGAAAGAAAATCATCTCCAAGGATTT
ACTGGTAGTTCTATCTGCTATGGGTTGTATTCAAAGATGAGTTAATGTGCCTAATGAGC
TTTGGTAAGCCAAGATTCACTAATAGTTATGATTGGGAATTGATAAGATTATGCACAAAA
ATGGGTGTGAATGTAATAGGTGGTGCATCTAAATTACTTAGTTACTTCCATAAACATAAT
AAAGGAAGTCTTATTAGTTACTCTGATAGACTTTATTCAAATGGGGAGATATACAAAAG
CTAGGATTGACATTTAGTCACTAATCAAAACAAGGTTACTTTTATTTTAAGAATATATTC
AAGACAACAATTTATGAAACATAAGCTTAAAGATAAATTAGAGAAGTTTGATCCAAACTT
GACTGAATCAGAGAATATGGTGGAAAATGGATATCATAAAGTATGGGACTGCGGTCAAGG
TGTTTGGGTCAAAATGATTTAACCCAAACATTATATCCGCAATTATATACTTTTAGTGTG
TTCTGAAATATTTCAAAATTAGGTTCAACATTATCAATAAGCTTGTAACCTAGTTTTGGG
AATATTAATTGATTTCACAAGAAATATCAGATATAACTTTATTAGGATATCTTTTAATT
GTACCATTAATGTGATTTTTATTAAATCTATATAAAATTGTTTGTTAGAACGCCATTTA
CTTTCAAATATATGAATTAGATATATTCCTTTATTAATACACTTTAAACTTTTTCTAAA
TGATAACTTTTATCCTTACCCATTTGCTTAGAATGCCAATAATCTCCATTACACTCAATA
GCTAGATTATATTCTGGCAGATAAAAATCTAGCTCTTTACCATCTAATACAGTTCTGTTA
TTTACAATTACATTTTTAGGTAGAATATTCTTTACTTCCTTTTCAAATGAGCTACTTTTT
GGATAACATATAGGGCATAATGTACTTCCTCTTTTGAATGAACCATATGTTCTATTAAAA
ATATGGTTTTTCTTACATTTAGCAGTTATCTTACCTTTATCAAAAGTTATTAATTCTAAA
TTTATGAATTTAAAAAATGTTTCTCTTTGCTCATGTTCACAATATGGACAAGATATAAAT
CCATTTTTTAGTGAGTTATATGCTCTACTGAAAATATGATTATGATTACATTGTATCTTT
ATATATCCTCTTGACTCAAAATCAACAACATTATATCCTAGTGATTGTATATATTCTATT
TTATTATTAGTTTCACAATAATTACATGTAATTTTACCTTGCTTAAAATTACAGTATTCT
TTTGAAAATATAGTATTGCATGTTTTGCATTTAACTTCTACTTTTCTACCGTTTATACTA
ATAAGGGAATAATTTATGCTATCTAAAAATTGTTTTCTATTTTCTATTTCACATTCTGGA
CATGGTGTATTTCTGATTTTAAATGATGCAAAAGCCCGTCTAAACATGTGTTTATTTTTA
CATTCAACTTTTACATAAGAGCCTTCAACAGACAATAAATTATAACCTAATGATTTCAAA
TACTCTATCTTATCCATATAATTATTTATAAATATTTTGGTTAAGTTAAATTTAAACCAA
AATGTTGTATAATTTTATAAATAATTTGGAAAATCTAATCAAAAGGAATATAATGGTAAC
ATATGAAGAAATCCAACAGCTTATCAGGAACTGTTTAGATGTTGGTATTAAGGCACCAGC
TAGTGCGTATTCAAAATTATTAAGACATGGTTATTGTGTTATGTATGGTGGTGATGCTAA
ATTTAACAAGTTAGAAGAGCTTGAAGACAACTTCGATGTGAAACAATTTGATCGCGATAC
TTGGGTAATCAAAGAATATAAAAAAGAACTTACTCCTGAAGAATGGAAAGATGTTAATTC
ACAAGCATTATATAACGGTGGAACACCTGATCAAATTGCAAAAGATATAGAAGACGGTGA
AAAGAATCCTATAGTAGAAAATGCTTTTAATAAGTTAGATGAAGCCAAACTAAAGCAAAT
TTCTAAAGATGATTTAAAAAACATATGGAATGAGAATGATTTAGAAACTAAAAGGGAAAA
GACACTTAAACTTATTAGTGAATTAAAATATAAATCACCATCTCTAGAAAAAATTATAGA
TATAATAAAACAACTAAAGATAAAAATAAAATTGATCAAATTATCACAAATATAATGTT
TGTTGGTACAGGCGACAAAGTAATCAAAATATAAAGGATGTTAAATGAAAAAAGGTATTA
CATTAAATGAAGCAGTTAAAAGAAGGCTAAAAATATGGATAAAAGCAAAGGTATTACTT
TAAATGAAGCTGCAGAAAAAGGATATTTTAAATATATCAAAAGAAAAGTTTCTATAAATG
AGTCAGAAATAAATGGTTTAAAAGATGCTTTAGAAAACATGGAAGAATTCTCTGATGAAA
ATATAATGGGTTCTGTTGTTGGAAAAGATTATGTTATATCAATTTTTGAAAAAGTATGCA
TCATATTAGTAAATGGTACTACACCCTTTCTTAATAGAAAGAGAAGATATTACCGAAGACG
AACAAACTCTTATAGATGATGTTTTGAAACTTTAAATCTTGAGTTAGATGATGATATAG
ATGATGATTTGGACAACATGGATGACAATTCAGATGATGGTGATTTAGATAATAATCTAG
ATGATGATTTAGATGATAACTCAATAAATGAAAGTAGAAAAATTGATAAGAAAATAGGAT
TATATTTTTATAATAGTAAACCAATCAAAGATGGGAATACTGTTGTAAGTGTAGATGATA
AAGGCAATACAGAAGTAAGATTACACGATAATTTAATAGCTGTTAAAAATAAAAATGGTG
ATGAAAAATATTCATTAGCAGGTTATAATTCACAAACAACTAGAGCTAGATTAAATGGTC
TTGGGTTTAATGTTGTCCAACGAAAAGGCAAATTATTTGTTGATGATAACGAAATAAATG
CTAATGACTGGTATGATATTTTTGGAAATAAAGTAAATTGGTAAAAAAGGTGCGTTTGCA
CCTTTTCCCATGTACTTTTAAGGTTGTCTTAAGTCTATTTTGGTACCATTACGGTATAAA
AATTAGGGATTAAAGAATCCCAGATGAAAGGACAGAAAATGAAGTACAATTTATAATT
CAAAAGAGTTATCAGCAAATGTTGTTTCTACGAAAAACCTACACAAATTAAATCGCAAAA
TATTAGTTCCTGGTGTTATTGATATTTCAGGTACTATATACTTAACATCACCTTCTAAAG
```

FIG. 12V. Continuation of (CJLB-7 [organism=Campylobacter phage CJLB-7] complete genome)

```
AGTTACCAACTATTAAAGTAGAGATGGACGCTGTTTTAAATGTGGTGAATGTTCATCAT
TTAAAATCAAACATTATGTAGTCAATAAGAAAGTATATGGCAGTAATTCTGAAATATATG
ATGGGATTTCAAAATTCTTAAGAAAATATGCAAAACTTATATTAGTATCAAAAGACGAAA
CTATATTTTTAATTATACATATACTGGTTTTGCAAAATATTTTAAAAATAAATAACCTA
AAAAGGTTATTTATGGCTAATAAAAGCAAGTCTAAAGGTAATACTTTTGAACGAACAGTT
GCAAAAATGTTATCAGATAATTATGCTGATGTATTTAATGTTGCTCAATCATTTCAAAGA
AATATATCTAGTGGTTCTGTGTTTGGTGGTAGTAACAGCTATCGTGGTATGAATGTTTTA
AATGAGCATACTTTCTACGCAGGTGATATAATATGCCCATCCGAGTTTAAATATACTATT
GAATGTAAACATTATGCAACTGCACCATCTTTTAACTCTTTAATTATCCAGGAATGTGCA
CAATGGGATAAATGGATATTACAAGTTGAAGCTGATTGTGAGATATCAAATAAATTACCT
ATGCTAGTTGTAAAATATGATAATATAAAACCATTTGTTTTTATAAAACACAATTTTGAA
GGTTTTATATTTAAATATAAAGATTATTATGCGTATAATTTTGAGATATTTATAAAAAAA
CATAAAAAGGAGCTAATTAATAATGTACACTAAATATTTATATGAATCAAGTTTAGATCT
TCAATTTGAAGTAACAGATCAGAATTTTGACAAGTCTTTTTTAAATTTTAGTAAAGAACT
ACCAGTTAGTTTATCTGAAACATTAAAATTAAAATATGATATCAAATTATCACTTAAGTT
TCAATCAAAATATGATGATATAGGTATAATAGTGAAGTTAAATGATGATGGTAAATATAT
TGTGTATTCAAATTCTATGGAAAACATAGACAAATTCATTATTTTTGTTGATACTTTAAA
CCAAAATAAAGGTAATTTATGACAACTTCAGGTGATATAGCTACCACACCTTCTAGACTT
ACATTAAAGAGAGGTAAAATTAAGCCGAAAATTATAAAATATAAACAAACCAAAACTTTA
ACCCTAAAAAAATTAAGTAAAAATTAAGGGGTTTTATGATACAATACCTTCAATAAAATT
GAAAGGTATTGCATGTTAGTAGATATAATTAACAGCTTAAAAAATGAGAATACAGATGCA
GGCAAAATTACAATAATTAAAAATAATAAAGATAATCAAAGTTTTATCAAACTTTTAGAT
ATAGTATATAATCCAAAAACTAGATTAGGAATAACCGATTTTGAATTACCATCTGAAACA
GGTAATAATAATATTAGATGTATATAATATCATCACTTGACCATTTACAAAACGGTATATAC
AGAGGTAATGATGCTGAAACTTTTGTAATTAAACTTGCAAAACAATTAGATTACGAAAAT
CAATTACTTCTACAAAAAGTAATAAGAAAGAATCTTCAAGCTGACTTAGGTATTAAAACA
ATCAATAGTGCTATCCCTAATTTTGTAAAAAAACCACCTTATATGAGATGTGCGTTATTA
AATGAAAAACATCATCAAAAATAAAATATCCTGCATATATTCAAGAAAAACTAGATGGT
CAATTTTGTAATGTAATTGTTACTAAAAACAATATTCAGTTTGTATCTAGAGCAGGAACA
GAATATAAATTTAAAAGAGATTTTTCAAACTTACAACAGCTAATATATTATACTCTTGGT
GAATGTGTAATAATGGGTGAATTATTATGTGCTGAAAATGGCAATATACTCCCAAGAGAA
ATTGGAAATGGTATTATTAACAAAAGTAGTGAAACAAACCAAACTATAACAGAAGAAGAA
TCAAATAAAGTTATCTTAAAAGCATGGGATTGTATTCCTTATAGTGATTATTTGGAAAGA
AAATGCAATATACCTTATGAAACACGATTTAACAATGTTCGTAAAATTACTGAAACACCT
AATGGGTTTATATATCCAATTGTATATAATATGGTAAACAATATGGAAGAAATAATGGAA
CATTATAAAAATCTTGTTTCACAAGACCAAGAAGGTGTTATTATTAAAAATAAATTTGCA
ACTTGGGGTGACAAAACATCAAATGACCAGCTTAAATTAAAAATTAAGTTTCAAGTAGAT
TTAAGAATAAAGGGTTATCAATGTGGTAAATCTGGTACATCTTGTGAAAATACATTAGGA
GCTTTAGTATGTGAAAGCGATGAAGGTTTATTAGAAGTATGTGTTGGAACTGGTTTTAAA
GAGAGTGATAGAGATTTCTTTTGGAATAATAATATGATAGGTAAAATTGTTACAGTAGAA
GCACATAGAGCAATGGAAAAAAACGGCAAATATTCTTTAATATTACCTGTTTTTATTGAA
TTAAGATACGATAAAGACGAAGCAGATAATATTGAAAAAATACTAGAGCAAGAAAAATCA
GCAAAATATAAATAAAATAAACTTGAAAGGATGATTATATGAATACATCAACATTATATA
ATGACAAAGGTAAGGTTGTTTTACAATGGGTAAAAAATGCACCAAAATCAATACCATCTG
AAGAGGTTATTGAAAGTATAAAACTTGCTTCTAAAAAGTTTAAAAAATATTCACTTAAGA
ATGTATCTAAATTAAAATCTTTAGATACTAATTCATTAACGCTTTACAATATTTCTGATA
TGCATTTTGGTATGTTAGCTTTAAAAGAAGAAACTAATGACAGTGATTGGAATTTAGATA
TAGCATCAAAAACATTAGACCAATTATCAACAGAGCTAATAAATGGTGCTGATAAGACAG
AAGAGTGTATTATATGTAATTTAGGTGATTTAATTGATATTAATGACTTTACACATAAAA
CACCAAGAAGTGGGAATGTACTTGATGTTGATAAAAAATTCCCACAAATATTATCAGTTG
CTTATAATTCAATTATAAACATGATCTATAAGGCACTTGGAAAACATAAATATGTGTACT
ATATCAATATTCCAGGTAATCACGATATATTACCATCTATGGCTGTTCAATATATTATAA
AAGAACATTTTGCTGGTAATAAAAGAGTTATTTGTGATGAGTCTTTGATGAAATACAAAT
ATCACTCATTTGGAAATGTATTAATGGCTTTTACTCATGGTGATAACATAAAGATGAAAG
ATGTGGGACAAATTATTGCATTTGACAATAAAGAGAACTTTGTACATTCTAAATATGTAT
ATGCATATTTTGGGCATTATCATGTTGATAAAGTAATAGATACACCATTATGTAGATGTG
AGAGTTTTAGAAATTTAGCACCATTAAATAAATGGGCTTCTAATAGTGGTTTTAGAAGAG
GAATTGGTACAATTAATTCTATAACAATTCACAAATCATATGGTGAAATTAATAGAAGAA
CTTATAATATGGGTATGATAAATGGAAACTAAACTATTAAATATACTTTTAAATATAGGT
AAAAAATATGGGATTTATTTTAAACAGAATCCAATAGAGATGAACATAATTAGTAGAATA
TTATTATGGACTAAAGAATCTTCAGAATCATGGGATAAAGTTATAAAAGATATAAAAACA
GAACTTCTTGTTAGCTTTACAAGAAACATAAAAATATCATCTTGGGGTAAAAACTCTGTA
AACATTAAGATGAAACTTGATAGACTATATCAAGTAAATATACTATATAACTTAGAAGAG
CCCAAACTAAACATAACAATATTATATTCCAAAATAATTAATGAATCTGCCTATGATAAC
TTTTTATAAATAGATATTAGAAAACAGTATTTATTTAAAATAACTATATATTGCTAACTG
TTTCAGAAGATGATAGTTATACTAAGTAATATATAGGTTTAATTTTATTTCCTTTAATAA
```

FIG. 12W. Continuation of (CJLB-7 [organism=Campylobacter phage CJLB-7] complete genome)

```
ACTTAAAAATTTTAAATATACTGTTTTGAGATTTATTTAAAGGAAAGAAAATGGCTTTAC
TAAGTCCAGGTGTAGAAGTTAAAGAAATTGACTTATCTCTTACGGTTTCAAGTGCTTCAT
CTAGTTTTGGGGCGTTTTGTGGTATTTTTCCAAAAGGTCCATGTGATGGTGCAGTTTTCA
TAAATGATATTCCAACACTTGAAAGTGTATTTGGAAAACCTACAAACTCAAATTATAATG
ATTTTTTTCAAGCGTATTGTTTTTTAAGAAGAGCAGGTAGTTTATATGTTGTAAGAGCTA
TTGATAAACTTGGAAAATCTACAAGAAAAGATTCAGGTTTAACAATAAATGCTGTATTAG
GTGAAAAAGCAACAGAAATAGCTTTAACAGATACAACAGGTTTATATGTTGGCCAACAAA
TTATGTTTGGTGAAAAAACTGATGCTAATGTTTATACTATTGCTAGTATTCAAGCTAATA
CTAAAATAACTTTCACTCCAGAAATACAAACAGGTGATGGTACTGGTAACTCTTCAAAAA
TTTATATTTGTCACCCATCAATGAATGCAATAGGTGAAGTTTTAAAAACTGGTTTAAGTA
ATACTATAACAGATGCCAAACTAAAAGAAACTCTTAAAATAATTCCTAATAATGATGTTT
ATGAAACTTTAGAGCCTTCTATTAAATTTAGTGATACTGAAACAAAATTAAAGTTTATTG
CTAAATCAGTTGGTTCTTGGGGAAATAATATCAAAGTAGCAGTTGCAACAAAAGCTGATT
TTGGAGCAAAGAAAAATATTATTAGTGGTATTCCATTAGATGATAACTTTGAATATATTC
CAGATACAGATCAAGTTGCTGTAGTTGTATTAGAAAACAACGAAATAAAAGAAACATATA
TGGTTTCAATTAAAGAAGGCGCTAAAGATTATAATAATAAATCTAATTATATTGAAGATG
TTATTAATAGACAATCATCTTATGTCTATTGTAAAAATAACACTACAATAACTGATTTAC
CAAAATCCGCTTTGGATTCTGAAATCATAACACTTAAATTTGGTGAAGATGGAGCTCCAA
CAAAAGCTGATATTATTAGTGGTTATACAGATAATTTTAGTTCAAAAGAAGAAATAGACA
TTGATATTGTTATTGCAAATGAAATGGCTAACAAAGAATGTGCTGATTTTGTGTAACTC
GTGGTGATGTTATAGGTTATGGTGGTGTTCCATTTAGTGAAGTTGTTGGTTTAAAAGCTG
AAGATTGTGTTAAAAATCTTTTAGAGTATAGAAGCACTGGTGAAATGAATATTGATAATA
AGTATTTTTCATTTATAGGAAATTATGGTTATATATATGATAAGTATAATGACAAATATA
GATGGATCAACTTAGCCGGTGCAACAGCAGGATTAAGAGCTTATACAAATCAAGCAAGAC
AGCCATGGTTTGCTGCAGCTGGTTTAAATCAAGGACAATATTTAGATATTATCAAGCTGG
CATTTAATCCTAATAATGGACAAAGAGATCTTTTGTATAAGAGTGCTATAAATCCTGTTG
TTAGCTTTCCAAGTTTAGGAATTTGTTTATGGGGACAAAAAACTTGTACTCAAAAACCTA
GTGCATTTGATAGAGTAAATGTTAGAATGTTGTTTAATTATCTTGAAAGAAACATAGCTA
ACTCAGCTAGGTATGTTGTGTTTGAGCAAAATGACACTCACACTCAAAATATGTTTGTAA
GTATGTGTTCTCCGTTATTAACTCAAGTTCAAGCGGGTCGCGGTATAGATGCATTTAAAA
TAGTATGTGATGATAGCAATAACACGCCTTTGGTTAAATCCAACAATCAGTTTATTGCAT
CTTTCATGATCAAACCGACTTACGCAATAGAATTTATCACACTTAATTTCGTCGCTGTTG
GTGCTACAATTAGTTTTGAAGAAGCAATAGGCTCAATTTAAATATTAAAGGTAGCTCAAA
TGCCACCTTTAACCCAAACACCCTGCCCACAATCCCACACTCTATTATATCCATTAATAC
TCATATTCTCTGCTTCAGTCAGGTTTGGATCAAACTTTTCTAATTTACTACTAAGTTTAT
GCTTCATAAATTGTTGTCTGTCATAAGTCATACCATTCTTATAGTAAAAATAACCTGGAC
TAGATGTGTGACTAAACTCAAACCCTAATGTATTGTATATTTTACCATTAGAATATAAGT
TGTTAGAATAAGATAATAAGGTCTGGTTTGGATAATTGTTTTCAAATATCTTCAATAACC
TAGATGCACCACCTATTACATTAACATTTATTTTAGTGCATAATCTTATCAATTCCCATG
ATATGTTTTTATTAAATCTTGATCTACCAAATGACATAAGTTCAACAAGTTCATTTTGGT
AATATAGTCCATAACAAACAGTAGAACCAGTAAATCCTTGCAAATGGTTTTTATTAAGAA
ATTCTTTTTCCTCTATTTATTAACTTCTTTAATTTCACATTTTCTAGCATATATTTTAA
AGCTTAACCCTAATTTATTTTTAATAATAGATTCCCAAATGTTTCTATTCTTTATCCAGT
TACTTTCAAATATGTGTAATAATTGTATTCCTTGTGAATTACACTTCAGAGTTTTATTTA
AATGGTATTTTTTATCACTAATAACACTATCCGAATTGCCAGTAATCTCCATTACATTCAA
TTGCTAGATTATAATCTGGTAAATAAAAATCTAATTCTAACCCATCTAACATATTTCTGT
CATTTTGGATATATTTTATACATAATTCTGTTAAGAAATTTTTAACCTCTATCTCAAAGT
TTGAGGTTCTAGGGTAACAAATAGGGCATTTTGTTGGTTTTTGTTTTCTACAACAGTGA
AAGGTCTTTCAAAAACATGTCCCTTATTACATTTGAAAGTATATTTTGAAGTAATATTTT
CATTTATGATATCCAATCCATATGACTTTACTAAACTTATTCTACTAAGTTGCTTACAGT
TATAGCATTCATTATTTCCTCTTGATGTGAAACTTGACCACCCTCTTTTAAATGTTGCAT
TACATTTATCACATATAAATTCTCTTGTGTCATTACCACATTTTGTGTCAGTGAGAGTAA
ATCCATGTTTTTTAGCTAGGTTTTTCTTTTCTATTTCTATAAATAGGACATGTTGTAT
GTTTTCTATTATAAAAGCCATTCCAGTCTCTAGTAAAAATATGATTACATTTATTGCATT
TCACATTAAATATTTACTATTATGTTCAATAATAGTAAAATTAAGATTCCTTATATACT
CTTTTCTGTATTCTACTTCACACTGATAACATCCAACTTCTTTAATAATTTCTGCTATAC
ATTGTTAAAAATATGACCATTTTTACATTGTAATGTATAATTACCTTGTATATCAGAAA
TGTATGACACTTTCATGTTATTTAAATGGGAATTTATGTTATTCCATCTTTCTGCTTCAA
CACATTCAGGGCACTTTGTGTTTTTACGAGTATTAAAAGCATACCAAGTTCTATTAAAAA
TGTGATTACATTTATCACATTTTACAGTGCATTTATTAATAAAGGTGTAA
ATCCAAGTTCCATTAGTGTTTTTTCTTTAGACATAACAACACATTTATCACAAATTATAT
TTGTGTTTGGTATGATATTACTTACTTTCTTGTTAAAAACATGCCCATAATTACATTGTA
ATGTTATGCTATTAGACTTATGTGCAATAATATCAAACCCAACACTTTTAATAAACTCCA
TTTTCTCATCTAATGTCATTTTTTCTCCTTCACTCTATTTAACCCAAACACCCTGACCAC
AATCCCATACTTTGTGATACCCATTTAGTCTCATATTCTCCGATTCAGTCAAGTTTGGAT
CAAATTTTCTAATTTATCCTTAAGCTTATGTTTCATAAATTGTTGTCTTGAATACTTAC
```

FIG. 12X. Continuation of (CJLB-7 [organism=Campylobacter phage CJLB-7] complete genome)

```
TACCACCTTTAACATAAAAGTATCCAGGTGCTGAATAATGGCTAAAAGAAAATCCTAATT
GTTTATAAATTGATCCATTAGAATATAATCTATCTGAATAGCTTATTAATGAGCCCATAG
TCTTATCAATTCCCAATCATAACTATTAGTGAATCTTGGCTTACCAAAACTCATTAGGCA
CATTAACTCATCTTTGTAATACAACCCATAGCAGATAGAACTACCAGTAAATCCTTGGAG
ATGATTACTTTCTAAAAATCCAAATGATAGTCTTTACCTTTTCCATTGCTGTCTGAATGC
CAGTAGTCTCCATTACATTTTATGGCTAAATTTATTATTATTGTTTTAATAATTCTATTC
TCTCATTTCTTTGACAAATCCATTTTTACATTTTACTTCTAAATTATTTCCTAAATTTTC
TGACACTACTTCATATCCTAAATCATTTAAAAACTTTAACTTTTCAGTTACATTCATAAT
GTCCTTTCAAGTAATTTCAGTAATATTATATACAATTTTTACTTAAATTCTGCTTAGTTA
GTTTAAGATAATTTTAAGCGGTTTTGTTATACAATAAAAAGAGTATGAGTAAAAATTTAT
AATTTTAAAAATTTAATTGTTAGAAAAAACTTAGTTAAAAAAAATCAGATATTGTATTCA
TGAAAAACATAGAAGTAAAATTATTACATCATACACCATTAGAAATAACAATAGACGCTA
TAAGAACTTGTTGGGATAGTGGATGCAAAAAAGACAGTGTTTATGAAGATGGTAGATTAG
TTTTAGGTAATCAAGATAAAGCATTATTAGATAGGATTGTTAATCATCACAAGCACCTTA
GTACAATAGAACATGTATATTATAACTTTTTTATAAAAGGTATTAGTAGAGCGTGTCTCC
AAGAGTTAGCTAGGCATAGACATGCAAGTCTTAGCGTAGAGAGTACTAGATATACTTTGA
AAAAACATCTAAAAAATGAAGAAGGATTCAAATATGAACAAGACTTTGATAGAGCTTCTA
AATATGTAGTTTTGACTGAAGATTTAGAATCTAATTTACAAATATTATCTAATTTGGATA
ATTTATTAAGATTAGTAAAACAAATAAGAGTAATGATATTGTAAAATATGCTTTACCTG
AAGCATTTAGGACAAATTTACACTGGACTATAAATGCTAGAAGTTTAAGAAACTTCTTAG
AGTTAAGGTCGTCTAATCATGCTTTACATGAAATAAGAATATTAGCTAATAAAGTTTATG
AGTCTTTGCCAGACTTACATAAGCAGACTTTGTTTAAAAATATTATAAAGGAGTAATAAT
GAGTAAAATAAAATCAAAAGATTTTGCCAATTTCTTACTTTTTAACTCTAAGAAAGATCT
AAGTAATTTAGAATTACAATTACTAATAAATTTAATTTCAATAGATTATGAAAATAAATT
TTATAGAAAATTATTAGAAGACGAACTAACCAATTTTAAATCATATTCTTTTAAAATATC
AGAAGATGTTTATTGGGATTTTAGAAATTATGGAGCTAATTCAATAAATAAACCTGACAA
GGAAATTAAGTTAAATTTATCTAAAGGAAAAGTTAGGTTTATAATTAACAGACTTGAGTA
CTATAACGAAAATGGTTATTTTAATAATGTTAGCATTATACAAAAACATTATCAAGAAGA
AAGAAAGTTAGAAAAATTAGCTGAAACTCACGCAAAAACTTTTATGAGTGCTGTTTGGTT
ATGTATTCCTATATTTACTTTGTTAGCTTTATTAAAATATATATTTGGATAACTTTATAA
GGATTATATTTTATGGTTGAAGATATTCAGCAGTTAAAAGATGATAAAATAAGCTATTTA
AATAAACTGTTGCCACAGGATGAAAACGGATATTTTTAGATATTAGTAACCAGAAAGTT
AGCTATGGTAATAATCCTCAACTTTCATATATTAATACTAAATTACCTTTGAAAGAAGAA
CATATAATAGAGATTCAAAAATGTAGTACAGATATTATCTATTTTGTGGAAAATTATGTT
AAAATAAGAAGTCTTGATGAAGGTTTAGTTTATCCTGACTTAAGAGATTATCAAAAAGAA
TTAATACAACAATATTATGAAAATAGATTCAATGTTGTATTAGCAGGAAGACAAAGTGGT
AAATCTGTTACAACTTTATTATACATATTATGGAAATTATGTTTTTGCCCTGATACCATT
GTTGGTATTTGTGCTAATAAATTTACTATGGCTGCTGAGAACTTACAAAGACTAATGGAC
ATGTATGCTGATTTACCGATATGGTTAAAGCCATCCGTGAAAGTTTATAACAAAGAGTCA
TTTGTTAATGAAATAGGATGTAAGGCATACATTAGTGCAACTACACCAGATGCTTTTAGG
GGTCTTAGTATCAATTTAATTTTTATTGATGAATGTGTAGCTGGTGACACAAAAATTACA
GTTAGAAATAAAAAACAGGTGTTATTGAAGATATAACAATGGAAGAATTATATAACAGA
ATAGGATAAACTTGCAATCTTAATAAAACAATAAAAAGAACGAAAATTGGAAAAAGCGTT
AAAAAACTATAATAAATAAACATGCCAAATTATTTTTCCAGTAGTAAGCCAGGTTCTAAT
CAGTCTAATATAGTAGATAGTACAAAACCTGGTTTTGTGTCATCTTATCAAAAAAAGACA
AAAGAAACACAAGCTATAAGTGAAGAAGCAAAAAATATAAACACTGGCAAAAAGTAATA
AAAGATACAGTTGATGACGCTTTAAAAGAAAAAACTACAAAAGAGCAGGAAAAAGCTGCC
CTTGATATAGTTAAACAACTAATGAAAAAAGGCACTCGTAATTTAAAGCAGAAGACTTT
AGATTTAGCAACATGATCTTTATGCAATATGATGCAAAGTTTAAAGATGAGGTATATGAT
AAAACACCTTTAATTTTAGTATTAAGTACATCAAGAAGTTATGTTTTAGGTTTAAATTTA
CATTGGACTCCAGTACCACTTCGTATAGCTTTGATAAAAATATTGTTTAAAATGAATAAA
GCTGCAATTCAAAAAAATAAACAATTAAAAATAACATATAAAATGGTTAAACCACTTTTA
TCTGCACTGCATTTAGGACCAGTTATAAGATTATATATTAAGAAAAGAATATAAGAAAA
GGTATTATAATTCCACAAGACTTATGGTTGGTAGCTGCTAGACTAAGAGCCGAATCATTT
AGTGGTGGATATTCTGCTGATAAGTTATATGCAAAAGCAATTCAAAACTATAAAAAATCA
AAATCTAAAAATATTCGTAAAAATAGAAAAATGTTTTAAGTTGATTTTAAGGATAAAATAT
TATATAATATTAGTAAATTATTAATGCTAAGAGAATATTATGACAGTTAATGACAAAATA
GAATTTTTAAATGATCTTGGGTATGAAACTATATCGGATAGTTTAGGACATGACTTAGAA
GTAAAATGTAAAATGGGCATGTTTTAAAAGAGCATTTAGAGTATTTAAAAAAGGTTAT
ACAACTTGCCCAGGATGCATAATAGGTGAAAAAACTAAGTTTCTAGAGGATTTAGGTTAT
AAAATTATATCATACACTTTGGGTGACAATTTAGAACTAAAATGTAAAAATGGACATGTT
TTTAAAAGAACATATAGTAACTCTAAAGAAATGTATGACAGACTGTCCAGAATGTACAAA
AGAACACAAAATTAAGTTTATGGCAAACCTTGAGTATGAGATTATATCGGATAACTTAGG
TCATGATTTAGAAGTGAAATGCAAAAATGGTCATATTTTTAAACGACCATTTGGTAATTT
TAAAATGGGTAATATAGACTGTCCTGAATGTATAGCACATACTAAAACTAAGTTTTTAAA
AAATTTAGGTTATGAAGTTGTATCAGAAAATTTGTCAGATTATCTAGAAGTTAAATGCTC
```

FIG. 12Y. Continuation of (CJLB-7 [organism=Campylobacter phage CJLB-7] complete genome)

```
CAAAGGACATATTTTTAAAAGAACATTTAAAACATTTGAAAAAGGTGCTGCAGATTGTCC
TGTGTGTATGGAACATGAAAAAACTAAAGTTTTAAACAGCCTAGGATATAAAACTATATC
ATGTAGTAATGTACAATGTAAAAATGGGCATATTTTTAAAAGGGCATTTAGTTTGTTTAG
ACAAGGTGTTATAACTTGTCCAGAATGTACAAAAGAACAGAAAACTAAGTGTTTAAGTAG
TCTAAAATAGAAAACCATTTCTGAAAACCTAGCAGACAACCTAGAAGTAGAAAGCAATAA
TGGGCACATTTTCAAGCGAGCATTTGATAATTTTAAAAGGGGTGTAACTTTATGCCCAAT
ATGTTATCCAAGTACAAGCTCATTTTAAAAAGAAATGTCTAAGATATTAAGTAATTACAT
AAACAATGATTACTCTATATTAGGTAATAAAGAATTAGACTTCTACTTACCAGACCATAA
CTTAGCCATAGAATGTAATGGAGATTACTGGCATTCTGAGAGTAATGGAAAAGATAAGAA
CTATCATTTGAATAAAACAGAGAGATGTAAGGAAAAAGGTATACATCTACTCCATATTTT
TGAACATTCTTGGATTGAAAAGAAAGAAATATGGACTAGTATTATTAACAATAAACTAGG
AAAATCTGACAAAATAATGGCTAGGAAATGTGTTTTGAGGAAAGTTGATAAAGTAGAAGA
GAAAGAGTTCCTAGACACAAACCATCTCCAAGGATTTACTGGTAGTTCAATTTGTTATGG
ACTTTATTATCAAGATGAGTTAGTTTGCCTAATGTCTTTTGGAAAACCTAGATTTACAGA
TAAGTATGACTGGGAGTTAATCAGGCTATGTACTAAAATGGGAATAAATATAATAGGTGG
TGCTTCTAAATTATTGAAACATTTCCACAAACATAATCCTGGGTCATTAATAAGTTATTC
TGACAGATTATATTCTAATGGTGAAATATACAAGCAGTTAGGATTTACATTTAGTCACTA
CTCAAAACCAGGTTACTTTTACTTTAAAAATGGAATAAAATATTCAAGACAACAATTTAT
GAAACATAAGCTTAAGGATAAACTAGAGAAATTTAATCCAAACTTGACTGAATCAGAAAA
TATGGAATTAAATGGGTATCATAAAGTATGGGATTGTGGTCAGGGTGTTTGGATTAAATT
AAGTTGATTTTAAGGATAAATATTATATAATTTCATATATCTAAAAGATATGGGATTTTT
GGCTATTGTTGATTAATTTATTAATCTTATTTTCAGCTATTTTTAAAGGAAATTATTATG
AATGAATTTGACATTTTAACAGGATTTTCAGGTGCAGATTTAATGCAAAAAATGCCACAA
AATATTGGTCAAAAAAGTTATGTTGATAACAGATTTTGGAAGTTGTCCAAAAACAAAGAG
GGCAATGGTGCTGCTATGATCAGGTTAATAACAGATCGCAATAAAGTACCTTTCGTTCAC
ATGTATCACTATAACTCTAAAAAGAATGTAGGTGGCAAAGATCGCTGGTTAATAGCAAAT
AGTCCAAGTACAATTGGATTACCTTGTCCTATTCAAGAAGAGTATTTTGAAGTATTAAAT
AGTGGTGATGAAAAACTGGCAAAATCACTATATGGTAGAAAGGTAAAATACTACACTAAC
ATTTTAGTTGTAAAAGATCCAGCTAATCCTGAAAATGAAGGTAAAGTGTTTCTATTTGAA
TTTGGAAGTAAGTTAAAAGAAAAGTTCCTAGCTTGGATTAATCCAGATGAAACACAAAGG
TCTCTAGGACATACAGAAAAAGAACTATATAACCCTATAAATGGTTATAATATAGAGCTA
ACTATTAAAAAAGATCCACAATCAGGTTTCTTCAATTATGATAACACAAGTTTAGCACCA
TCACCTTCAAAGTTAGGCGGGTTAGAAAAAAATGAAGATATTATAGACATAATTCTTAAT
AAAACTTACGATTAAGTGAGTTTACAAAACCTGAGTATTTCCTTCTTATGAAGAATTA
AAAGAAAAACTAGAAAGGTTTAAAAATCCTTTTGGCACTAAAACTTCAAGTGTTCCATCA
GTGGTTGAAAAAACAAATGATAACCCACCATTTGAAACACAAGAATCAAAACCACAACCT
CAACAACAAGTGGTTCAACAACAAAAACCTAAACAAGAAAACAGTCAGGATGATGACTGG
TTAAATAATCTTTAAGGTATAAAATGCTACAATTGTAAAAATAATTGTAGCATTTAAGGA
AAATAAATGAATATAACACATTCACAATATGAGGTTATGGTTTCTGCGTATAAAAAAGAC
TTTATACCTAACAAAAATGAAATGAATTTATTAAACTCGTTTATGTTATGTAGATGGATG
AGTAATGATATTCATTCTGTTGAGTTGCTAATTTTATTAACAATCATACCGATATACCT
ATAAATGTTCAGTATTGGTTTGCACGCTCAATAATGAATAAGGTAACTTATATGGGTAGA
CCTCCAAAAGAGGATAAACTAAATGAATACGAAGAAGCTGTTAGCAAATACTATAATATA
TCTTTTAATGTAGCCAAACAGTATTGTAGCATTCTACCTAAAGAAAAACAAGAAGAAATT
TTAAATATGTTTAAAGGAGGGAGGATAAAATGAAACAGATGAATCCATTATAAAGTCAT
TTAAAAGGGAAATAAATCTACAGACAAGATTTATTAAAAATAAAACAAAATATACACGAA
AAGAAAAACATAAGAAAGGGGCTATAAATGGTTTTAATTGATTTTATGCATTTAGCTTTT
AAAAGTTTATATGTAGCTGTTGGAAAAGATATGTATAGCAAACAGAAACTTAGTTTTGAA
AAATATCATGGTATGTTTGTGCATTTAGTATTTAATTATTTAAAATTAGTCCAAACAGAG
TATGCAAGAGATTATGGAAATGAAATTGTCCTTGCTTTGGAAGGATCTAATTCATGGAGA
AAGTCATATTATCCTGAATATAAGACAAACAGAAAGTTATCGGATGTTTTTGATTGGGAA
AACGAAGTATTTCCAGCTGTTAATGAGATTATTGATGTTATTAAAAAATCACTACCATAT
AAAGTTTTAAGAGTAAAAGGTGCTGAAGGTGATGACATTTGCTGTATTAGCAAATCAT
ACTGCTAAACCTGTATTAGTTGTTTCTGAAGATAAAGATTTTATGCAGTTGCTAATAAAC
AAACATATAACTTTGTTTAAACCTATTAAGAAAGAGTTCTTTAGAAATATAGAAGAATCA
GAAATAACAAAACATTAACTATGCATATTTTACTTGGTGACAAAGCAGATAATATTCCA
TCAATAATGGAAGGCACAACTTTCACACCTGACTTTATAAAGTTTCTTGAAAATAATGGT
ATTTTTGAAACAGATGTAAATGATTTCAATAAATTAGAAATATCAAAAACATTATATGAT
TTATATTCTAAGCAGTCTGAAAAATCACCTTTTAAACCAGCTTATTTTGGTGAAGTAGGG
GCTAAGAAATTCTTAGAAAACTTAAATGAAAATCTTGAAAAAACAAGCTTGTTTTATGAT
AATTTTGTCAGAAATAAAACATTAATTGATTTTAGAGAAATACCTGACAACATTAAAGA
AGCATTATAGAACAGTATAATATGGAAAAGCCAACAATAGATCTCAATAATCTTCTTAAG
TTTTTCTTAAAATATAATTGTAAAAAACACAGTGATAGTATAGCTTCATTTAACAGTAAC
ATGGGTACTTCTTTATTTGATGATTGGATGTAATATTAGCAGTCTTATAAATATCTATAA
ATTAGATATTATAGGACTGTGTTATGATAGAACCAAAAAGAGAGCCTACACAAGACTTTT
TTGTATGTTTATTAAAAGAACCTAGATGGGTTAGTACTGATGATCTATATGCTATTTTGT
```

FIG. 12Z. Continuation of (CJLB-7 [organism=Campylobacter phage CJLB-7] complete genome)

```
TATCACCAGGAGTTACATATCCAGCCGAAATAGCTATGATGCATCCTGATTTTTTCGGTG
GTGATGATGTTGTATTTAAGCCTGAACCTCCAATTGATCCAGATAATCCTGATTTATCTA
ACTATTATACAAAACCAGAAACAAATAATTTATTGGATCAGAAAGCAGATAAAATTCATA
CACATGTTGTAGCTGATATAACAGATTTAAATTTGGATAAATTTGCTACAAAAGAAGAAA
CATATACTAAACAAGAGATAGATGATAAAATAGACGAAATAGTACCACCTGAAATTGATT
TAACTGATTATGCAAAGAAAGATGCAGTTAATATTTTTACAAAAGCTAATACTTTTACAG
AAGCACCTTCAGTAGAAGTAGATGCAACACTAGATAATCATGTTATTAGAAAGAAACAGT
TTGACAATAACATAAAAGAAGTTAAAGATCTACTATCTAATGTATTTTCATATAAAGGAT
CAAAACCTACATATACAGAAATAGAAGCCATTGTTGATAAAAAGATAGGTGATGTATGGT
ATGCTGAAGATACTGGATATATGTATATATGGAATGGTAAAACTTGGTATGATTTAGGTA
AATCTTTTGATGCTAGTAAATTTGTTGATATAACTTCAGACCAAGTAGCAATAAATGGTA
TTAAAAAATTCACAGGAAAATTAAAAGCATTAACACCTGTTGATTCTGATGATGTGGCTA
TTTTGAGCTGGACAACAAAACAAATAAATGATAAAGTTGAATCTGTTGTTGGTGATTTAA
ATTCATTAAATAATGAAGTTTCTAAAGATAATTTAGTTAATGCTATAAATAGTGTAGATG
ATAAGTTTAAAACAACAGCTAAAACCAATAAATCAAATACATTTACAGGTGATCAAACTT
ATGTAGATCATATTTTACTAGAATCTGTTCCTTCTGAAAGAAATCATGCAGTTAATTTGG
GATACATTTTAGATAATCCTGGAGGTATAAAACTTCCTGATCATACAGCACTTACACAAA
ATTCTGTTACAGAAATAACTTTTGGATATGCAAATCCAGTATCATATTCTGCACAACAAT
TAAAAAATGTATTCCTAAAAGATATAGTAGGCAATGAATATAAAGCTATAATGGCAGATA
AACATCATTTACAGAAAATCCTTCAAAAGAAATGGTTGTTATACTTTCTAGAACTGATT
ATGACAAAAAATATAGATAGTTAAGTTTGATATAACTAAAACAGTTGATGAGCTTAAACA
ATATGAGCTTAAAGAAGGAGAAGTTAGAGTTATACTATCTTATGATACTGTATCTGTTTA
TTCTAGTGGATATGGTTATGGAGCCATGTTTGCTAGAAACGCTAATAAAAAAGACGGAGA
CTTAATATATGATTATTATACTGGAAGTCAAAATGATATAACAAATAATAGAAAAGTATC
TATAAAAATAGATAAACTTGGTATTAATACTCCAGATATTGTAAGTATATCTATGACTAC
AAATGGTTCTGAAAAATTAACTGTAAAAACAGATACACTAGATCCTGTAGAAAATACATA
CGAATCTGCGGATATGACTTATATTCATACTCCTGTCAGCAAAATTGTAGGAGATGTTCT
GTATAGTAATATATCTCAAGCAATAAAATCAATACATTTATTAGAAAATAATATATGTTC
TTTAAAGCCTGCAAGTATGGAATTACAACTTGTAAGACTCAAAGAACTTAATCAAACAAT
AAATAACATGTTGCAATCTATGTTTGATGAGAGTCCTATAGCACTAGAAAATGGAGATTA
CATAGATGTTTCATTTAGTGGTAGTGCAAGTTATGGAACAGGATATTGTGGGTATGTTAA
TATAAAAGATACTATAAGAGATATTACATATAAAGCTTATAAAGTATCTTCAAATGCTTT
TAATACAACTAGTGGAACTAAAGTTATTGCAGTTCTCACTTCTGATAACAGTAAAACAAA
TGTAACTTATTCCGATAGTGTATCAACATTAGAATCTTATGAAGTAGCAGAAAATGAGAT
ATTATTAGAAATATCATTTTCAACTGCTAAGCAATATTCTGCTAAATACGGATATGGAGC
TATGCTAGAATATTGGGGTTCTGTATCTGATTTATGTTATGATTATTATATGGGTTCAAA
CCTAGATATGAACTGTCCATTTAAAATAACAATACTAAAACTAGGAAGTTCTGTTAAAGC
TGATACTATACAAATAGGTGCTCCTACTTTTGCAGGATCATTAGTTATGCACCTAAGAAA
AAATACAAACGATGTTATTAATTTCCTTGTATCTACAGGTATGAATGTAACAGGAAGAGA
TGGGACTGAAAGTGGATCAGTATATAATTTAGTAGAAAAATCATTGAAACCATTAAAAGT
TCTAACATCTGAAGCACATCAATCTATAAATGGTATAACTACTTTTAATAATAAAGTGTA
TATGAATATAGAAATGAAAGAATTACAGACAACAAACAACTAATACATAAAGAATACCT
AGATAAAAATATTACAGATAATGTAGCATATAATATTAGTAATACTCCATTAATACCTTA
CACTGATGTTAGTTCTTTAAACAAAAAAAAAATATCTGTAAGAATATCTGCGACAACTAA
TAACTCTAATTATTCATCTGGTGATACAGTAGTAGTTAGTAATTTCAAGATAAAACTTAA
AGGAGATGATGAGTACCTTAAACCTTATGGGGTTGAAGTTATTGATAGAGAAAATAATAA
AATAGGTTTAAATTTAATAGGAGATGATACAGTATATAATGATAATGATGCTTTATTATC
TACAAGACCTTCTGATTTTAATTCATCTAGTGTAGATCTTTCTAGTGGAAGTAACGCCTT
AGTAACTGTTAAAACTAATGGAGCTTATGATTATAGTGGAGTTTATGATATACCAAATCC
TTTTAGAGAATATAATAAAAAATACTCTTTATTCTTAAGTAATGATGGGTTAAAAAATCC
TTATTACCAAGTTGATATAAATAGCTCCAAACAAGTTGATAATATATCTTTTCAATTATT
TGGAACTAGTGCTACAAATCCTTTTTTATATTCTAAAGACTGTAAAATTGAATTATTTAT
AGAAAATACTGTTGTAAAAACCTTCAATGTTAAAGGAAGCTCTGACAATAATCCTGT
AAATATTAATATAGATTATAAAGATGGTATGTTCTTGATATCTGTTCTTGATTCTATAAA
TTACATAAATAATAGAATTAATAAAAATGCAGAATTACTTACAGGGTCAGGCAAACCTAA
TTTTTCATTAAACCCTAACAAAATAGGTTCTCTATACTCTGATACAACTAATAAAGCTGT
ATATATGTATAGACAATGCTTTTGGTGCTAATAAATGGGTGAATATAGTAACAGGGGA
TGAAATTAAACCAAGCCTTAGAAAAATAGAGATCACTTGTAATGTAAAATTAAGAAGTGG
CCAATACGGTGGTTGTATGAGCGGTGTTAAAATAGGATTTGATAACGGGTATGCTTCTAC
AAAACAAATAGTTAAAGGGTTAAATAGCGGTCAAATATTGCTATCTCTAGATGGGTTGGG
TAACCTTTCTGGGTATTCTGAAGTTAGTTCTTTAACTCCTAGCGGTCAAGATATAAAAGT
TGATGTGGATACTACTGGGATATATAATGACCCTTCATATCATTGCGTTACTAATATATT
TAAAGAATACCTTGGCAATGCTGATCAATGTTCGCTATGGTCTGATGCTAGTGTTAAACA
GCTTAAAATAACGTTATTGTCTGAAAAGATTCCTACCAAAATATTATATGTAGGAAACGG
ATATTATGGTCAAACATCTGTTTCTGATGTAAAAGCTGTATGGTATTATGTAAATGATAG
CGGAGACAAAATAGAAGGTAATGTAGATAATGATTTAAAGGTAAGTAATAATGTTTCTGA
```

FIG. 12AA. Continuation of (CJLB-7 [organism=Campylobacter phage CJLB-7] complete genome)

```
AACAAACGATAGTTCTTATATATATGCGTTCAATATAAATTAAATGCATAGGATTATATT
AATGATAGAGCCAAAATAATATAGATAACACTAAAGGTGAAAAGATATTATAAATAAAGA
TGGAAATAAGAGCTACTATTTGGAACATCATTTATATAAGTAAACCTTAAGAATTTCTAT
GATATACTATCATAGAAATTATAAAGGAAATATTATGATAGTATGTAATTATAATGTAGT
ACCAATTATAATAAGTTTATATAAAAATAATTTTAACACGCAAGAGGTTAAAATATGTGG
TTATAATCAACTTAATGAATATATTAAAGATGATTCAAATAAGTTTGAAATAATAGGATT
TAATACTGATTCTATCAATTTACCAAAGAATATAGTAAATCTTGAAATAAATTTTGAAAA
TATACCAAAATATTTACAAAACCCATTAAAATCATATTATGAATGGGATAAAAATAATCA
AAGGGATTTTTTATTTGGATATTATTTAGATTTATATTTTAAGAAAAAATAAACTGCCAGC
ATTAGCTGATTTGCTTAAAAATAATACAGAAGAAAATAACATTTATAATATTGTTAAGAA
TAATTTTGTATCAATGGAATATTCTTTACAGCAAAATATTATTAAAGAAAAAATTATTAA
TGATATATATATTATGAAAGGTAATTATAATTCCTTTGTATATAAAATGGTAACATCACA
GTATAAGACATATATACTAGATGACGATTTAGGCAAGCTAATAATATTTTCAGGTGATCT
TAAGATAATTTATGATAGAATATCTCATTTAAAAATTGATATTATTAAAACAGAAAATTG
TATTATATTAAATGATATTGATAATAAACAACAGATAGTAAAATTAATGTTAGGATTATA
ATGATTAGTGGATTAATTTTAAAAAGTCTTATTAATGATGAAATATATTTTGATAAAGTA
TATTCAATTTTAAAACCTGAGCATTTTATTGGCGTAGATTCTGATATTTACAAAACAATA
CAAAAACTTGTAAAAGAGTATAATAAAAAACCTACACCTAAAGAAGTAGCTTTAAAGTTA
AAAGATAATTTTAAAGATGAGCAACAAGAAAACTGTATAAACAGGTTTAAAGAGATTATG
TTAGATAAACAAATGTATCTCCAGAGTTTCTTAATAATGAAACAGCAGAATTTATAAAA
CAAGCTGAAATGAGATCTTGTATTATACAAGGTGCAAAACTTATACAAGAAAAAAAGGAC
ATTGGCAAGATATATGAAAGGTTAGGGCAAGCTATATCATTTACAATGGATACTGACATA
GGTATGAAAGATATTGATGCACAAGAAAGGGATATATTAAGAAGAGAAACCAAAATTGGT
ATTTCCACAGGTGTTGAAATATTAGATGAAGTTTTAGCAGGTGGTTACATGCCTAGCACA
CTTAATTTCATATGTTCTGTTACACATGGTGGTAAATCAATGTTTTTGTCACATTTTGT
GCAAATGCTATGTTAAAAGGGTATAACTGCCTTTATATAACATTAGAAATGCCTTCAATA
AAAATTTGGGATAGAATAGAAAGTAATATTTTTAATATTGATATTAGTGAACTAAGAAAT
TATAATGTTTCAGAAGGATATAAAAGTTTACCAAACTTAGGAAGATGTGTTGTAAAAGAA
TATGGTGCTGGTAGTTTTGATGTTTTACAATTAAAATCATTAGTTCAAAAAGTAGAGTCA
TCTTTAGAAATAAATTTAAATTGTATAATAATAGATTACTTAGCACTTATGGCTTCGTAT
GCTTTACAACCTAGTGTAGGTTTATATTCTTATTATAAAAAAATTGCAGAAGAACTACAT
GCTTATGCTAAAGAAAGTAAAAAAATGTGTTTTAAGTGCAGCACAACTTAATAGAAATGCT
TATAATAATTCAAATGCTGATACTAGCACCATAGCAGAATCATTAGGTATAGCTCAAACA
GCTGATACTATTGCAATGCTGCATAGATCACCAGAATTAGATGAATTAGGTCAGGCCATT
GTATCATTCACTAAAAACAGAAATAGTGGTAATTTATCTCAAAAATATGTTGGTATAAAC
TTTAAACAATCAAGATTTTTTGATATAGATCAACCAGATTAAGGAGGGACTAAGCATAAT
ATAGTATAATTACATTATATTTATTTTTGTAAATATAAAATAAAATTACTAAAGGAGTAA
AAATGTTACAGAACTTTGTAGGAAATAGTAGTCATACCATCAGTGTTAATGGCTGCACCA
TATGGTATAATTGATTCAACACCAAATAACAAATGGATGGAAGATTTAAAAAAAGATGGT
AAATTTACACCAAATATTAAAAAAATTGAAAAGCAGTTTTTTGAGTTGCAAAAAACAATC
AGCTCGGTAGCATCAATTTATACAATACCAGCTGAAAAAGGTTTACAGGATTTAGCCTAT
GTTGCTAATTTAGGTATGATTTTCCCACATTTAAATCCAAATGAAGATCGTAGAGTATTA
GTTAGTAATTTTAAGTCAGAACCACGCAAAGGTGAAACAAAAGTAGGTTATGAGTACTTT
AAAAAACTTGGATTTGACCCTATTATTATGCCTGATGTTAATGAAAAAGGTGAACCTATG
TATTTTGAAGGTGAAGCAGACTTAAAATGGTTATATGGTAATGTGTATGTAGGTGCTGAT
GGTAATAGAACTAACGGTGCAGCTTTAGATTGGATTGCAAAAACATTCAACTGTGAAATT
ATAAAATTCCCTAGTTTTGATGAGTATTTGTATCATTTAGATTGTAATGTATTCCCATTA
GGACCGGATACAGAGGCATGCTTGGTTAATACATATAATCTTGATAAAGATATTATTAAA
GAACTTGAAAAACATGTTGAGGTAATTCCATTAGGTGTTGATAGTCATGATGACCCAGAT
CAATATGATTTTGCATTAGCAGGAACTACAAATAGTGTATTATTACCTGGTGGTATAGTT
ATTACGCCATCTGATATTTCAGAGTTAAATAAGAAATCTGATAAAGATTTATATGAAATG
GAAAAAGATAAAATTGAGTTTATGGATGAAATCTGTTCTGAGTTAGGATTACAGTTAGTA
GTTCAAAATATATCAGGCTATTATGTTAGTGGTGCTTCATTAAGCTGCAATGTAATGCAT
CTTAATCAAAGAGGTTATTTAAATTAATCTTAAAGTGGTATTATACCACTTTACTTTATA
AGAAAGGAATATAATGTTACTTAATAGTAAAACTATTGCACTAGTAAATTCATTACAGCT
AATTAATGAATCAATTATATTTTCATCAAAATTAACAGGTATAAAAGATAGTGCTGGTAG
CATCATTGCTTTTATTGACTTGGAAAAGCTTGAAAATAAACCATTTCCTAAAGATTTTGG
TATTCTAAAAATTAAAGAGTTTATGGATTTATTAAAAATAATTGGTGAAGATGCAAACAT
AACAATGGATGATAAAAATATTATTCATATTTCAAAAGATGGGATGAGTTGTAAATATCT
TACTACAAATGTTGAAGCATTATCTAATGCTTGTGGTGTAAAGCCAACAATACTTGAAAA
TGTTAATAATGCTGAGCTAGTATCTTCTTTTGAGTTAGATATGACAGTTTCGGATAAGAT
TAAGAAAGCTGCTACATTATTAGGATTTGATGATATGGTATTAAATATTGACGATATTAT
TACTGTTTCTACTTCTGAACAAGGTATAAATGGTAATGAATTTTCATTAAATGTAACACC
AAATGTAATAAATTCAAAGGCAATATTTTCATAAGTATTAAAAATTTAAAAAGAATACC
AACAACAGATTATATTGTATCGGTACATAAACATACATCAAGGCAAGATACATATTTGCT
TAAATTAATTCCAAAAAATAATGATGCACTTATAATCCTGATCCCATCCAAAGTTGTAAA
```

FIG. 12AB. Continuation of (CJLB-7 [organism=Campylobacter phage CJLB-7] complete genome)

```
ATAATACTATAAATAACCTTAAAAGGTTATTTATAGTGATACAATACAAAGATATAAATC
CGAAAAATATTGAAAAGATATAGTAAATGTTGATCTTTTTATGTGTCATTAAAAAATA
TTGTAAGCACTACTATTGGGGATATAGCTGGATTTCCAGAGTTTTCAAATAATGCTCAGC
TATTATTTGATCAATATAGCTCAGTTGCATTGGATGCTTATAAGACATCTTTAAAAACAT
CAATTCAAAAATTTGATTATCGCATTATAGTTGATAATATAAATATTTCAAAAGGAAACT
CTGATAATAGTGTATATATTGAAATAAAATATAGAGTTAAAGACACAACTATATCAGATA
CAGCTAGCATAAAGGTTGGATAATGGCGGATAATATTTTAATTCCATATAATTATGATGA
TATAAAGATGAAGTAATAAAATTACTTAAAAATAAAGGATATAGTGCTGATGTAAAAAG
TTCAAATGCAAATCTATTAGCAGATATATTATCTTATTTAGCTTATAGTATAAATGTAAA
TACCTCTTTTCAAGCAGGTGAAATGCTATTATCAACTGCTCAATATAGGAAAAATATACT
TATGGGTGCTAGACAATTAGGATATGAAGCATCAAGAAAAGTATCTTATGTTTATTCTTT
GGAATAAAACCTTTGAAAGATGATACAAAGATGATGATAACGAAGATAAAAGAGTTTA
TTCAATACCCAAATATACAATGTTTAATAGTGGTTCAAATACATATTATTATATGGGAAG
TGATATTGAAGTTGAATTATCTAATAAAGATATAACTACTGGAAAAGCATCCACTATAAC
AATAGATGTAAAGGAAGGAGTTTTACATAAGTGGGACAAAAATAAAGACACACAAGTTTT
TACTATTAAAGCTATTGAACAAAATAGAAGTATAAAATCTTCAAATAAAATATCATTATA
TCAAGACAACATAGAAGAAAATGGGTTTGAGGTTTTTGTAACTTATATTGATATCGAAAC
TGGAGATAGTAAAGTTGATGAGTATTGGGAAAAGTCAGATCAATTTATGATAGATGCAGA
TAGTGATACAAATAAAAAATATTTTGTTTTAAATAACATAGATTATAGTGGTGTTGATAT
CTATTTTTCAATATCAGGTATAGGTACAAATTTATTACCAGGAAGTACCGTAAAAGTTAC
ATATTTAGAATCTAAAGGAAGTAGTGGTAAGTGTGGGGATAATTTTTCATTTTCACAAAA
TACATATCCTTTTAATCTCATGGAAATTGATAAATTTGAAACAAAAATAGTTGGCACTGA
TGAAGAAACCAATAGTTCAATAAAAGAAAATGCTCCCATATTTCATAATTCAGCAAACAG
GGCAGTTACAGTAAGAGATTATATTGCAATCTGTAATAGATATACAAATATATATCAAAC
CCAAGTGTGGGGTGGGGATGAAGAGCAAGTTGTACAACTAGGACACATTTGGTTTTCATT
TATCCCTGAATACCGTAATCAAGATTTTTCATTAGATGAAACAACACAAACATATTCATT
AGTAAACAAAAATGATTCATATTATTTAAAACAAAGTGAGCTAAGATCTAATACATTAGA
TAAAAATGGATATTTAGTAAATAAAGGTATATTTGATGAGTTAGATTCTTATAAAATAAT
GACTATGGAATTACACAATAGATATCCTATATATATGGATTTGATTATGAAATAAGGAT
AATCAAACAAAATATTGTAGTTTCGAAAAATGAAACACAGGATAAACTATTTAATATTTT
AAAAGATTATTTTAAATCAGATATATAGAAAGTTTTGAATCTTCTTATTTTCATTCAAGTGT
TATAAAAAGGTTAGGGACAGAATTATATGATTTATCAGGTATACAAGTAGATGTTAGTAT
GAATATACCTTTATATTTAAGAAATAAAGAACCAAACAAAGATATTTTATATATTTATCT
GGCTATACCTTTTGAGCAAATAATAACTAAAACACAGGATGATCAAAATGAATTACATGT
TAACTTATTACCACAAATAAGTTCAGATGACTTTGGTGGAAAATTAGAAGTTGATTTTAA
AAATCCTATAAAAGGATTTACAATTATAGGAAGTTCTAATGCTATAATAGGTACTTTTGA
TGTAGGAAATGGTCAATCAGCAGTTTTCAATGGTAAAAATGTTGTCACTTCAGATGGATT
AATTATAAAGAATACTAATATAAGTTTCAATATATTTGCAAATGGAACAATAATAGGAAC
TTATAAAATAATATATGATAATAGAAGAAGGTTTATAGTTATAGAAATAACAGATAGTAT
AGTTTTAAGCAGTCTTGATAATATAACTCCAAAATATATAAGGGTAAAATATTCTGATGA
TAACCTATCATTTTATAAAAATACAATAGCTAGATTATCTTCAGTAAAATTTGTAAGTGA
AAGTGATGTTATATGATAGATCGTGTTGATTTGCCCAACATTTATAATGAAATAAACTG
CATAAAGATAGTGTGGAAGCTCTATATGAGGTTTTAGATGAGTTAAATCCATATTCATTA
GATATATATAACATATTTAAAAGACCTAATAATAACATAACAGAAAATATTGTTAAAATA
TATGCAGAATCATTATATTATGGTATGCAAAAAGCATTGCAAAATCCAGTTGTAATTCAG
AGAATGAAAGAAAAAATAGGTACAACTGATAATTATCAACCATTTGATATAAAAGAATTT
TATAAAAAATTATTAAAAGATTATTTTGTTAATTTTACAAGTTTTAAAGAAAAAAAAGGT
CTTGATGTAGCAATAGAATATGCTTACAATATTATATTTACATCAGGACTTCAACCTGGT
TTAGATGTAAATGGTTCAAGTGGTTTTAATTTAAAATGGGGTACAGAAGATAACCCTGAT
GAGCCGTTTTTCATAAGAATAGAAGGCCTACTAGATCCTATATTATATGAAGGTAGTGTT
AAGTCAATAGCACATCCAGTTGGTTTTGGTTATAACTATGTTATAAGTCTTGTTTTAGAA
TTTATAGAGTATATAGATGATTTAATTAACTTCAATGTAAAAACATTAGAAATTGTTTCA
ACAAACTATAGAAAAGAGTTTATAAAGATAAAGTAGAAGATATCTATACCTCTAAAAAT
ATACAAAACCAAGAAAGAATAGTTATAACATTTAATGATGGGAAACAATTAATAAAAGAT
TTTAATGGTTCTATAACATATAATGAAAAGATGGTAGCGTAATAGAAAACTGGAATAAT
ACATACATATTAAAATTAGATTATGATATTTCTCTAAAATTTAGATTAAAAGATGAATTT
GATAATTCCGAAACAACCTTATAGTATATGATTGTGTATGGAATAGATTAAACAGTTTT
GATACGCCTATTATAGGGAAGCCATTGTAAATAAATTTAGAGTAGCTGATAAATATTAT
TCATCTCTTGTAATTGGTAAAATTGATGATAATACTATTTATACATTACCTGATGATCCT
ACCAAATATACTCCAGATAAAATGCCATTATTTCTTACAAATGCTATAAATAGAGGTTTA
TTTGAACATATACATGATGATATGGATATATATTCAACTAATGATTTTATAGATAATGCT
GTAAATGAAAAAGGTATTAGTAATACCGTTGGAAATAAAATAATAGTGGGATCTTTTAAA
GTTGGATCACAATCTGAAAACCCAGAAGGAGGTGCAGTTCTTGATGATTCATTTAGTATT
GAAAGAGAGATAATCCCAACAGAATATTCTGAAACTGTTACAAAAAATCTTAAAACTAAT
TTTTATACAACTATATTGGATAACTTTGATGAAAAAGTTGTTAATGATGATATAAAAATA
ACAGTTGGTTCGTTTAAAGTAGGTAATATAAATATAGGAGCAGAACATATTGATAATGGT
```

FIG. 12AC. Continuation of (CJLB-7 [organism=Campylobacter phage CJLB-7] complete genome)

```
GTTATATTAGATGACGCTTTTGATATAAATATTTTAAAAATAAGGAAAAATAATGGTAGA
ATCAATTAATCCACCAAAAGGATATTTTAAAATTGAATTATTAGATAAAAATAGAAATGT
TATAGATACTTTTGAAAAACATAACTTAGTTGTAAATGGATCAAGACCTGTTCTAGCTTC
ACACATGGCTGGTAGAAGTACAACTCCAGTAAATAAACTTGTTTTAGGGACTAGAGGACA
TATTGGTAATAACCTGATGATGCCAAAAACAGCTAATGAAGGTTTTACAGCTGCTAGAAC
TCAATTATTTGCTGAAGAAGAAGGTGAGTTTTGTTATCATGTTAATTTTACACCACCACA
ATCTGATGGACAAGCTGTTGTTACAGAAGATGATGTAGGTGCTGGATCAACAGTTGAAGT
TACTAATAGCAACAATACAATTACATATAGAATAGAGCTTTCAACAACAGCTGGTAATGG
AACATCAGGTGCTGTTGGTTATACAGAAGCAGGTTTATATGCAGGTAATGATTTATTTTG
TATGAGAACCTTTGCTGTTAGAAGTAAAGATGTTTCATCTATATTAAGAATTACTTGGAC
ATTAATATTCTAATATGTCTTTATATAATATTGATAGACTAAGAAGCTCCCTTAAACAAG
GGGGTGCCATCAATTCAAAATATAAAATTGACATAAAAATACCTACCCTATTGAGGTCTC
TACCGTTTTTAAAACAGTAAATATATCAGGTGAATATTTAAGTATAATGGCTAATAGAA
CATCTATTCCAGGTAAGTCTATGAGTACTGTAAAAGTGTATCATCGTGGGCAACCATTTG
TTATAAGAGGTGCAGCACAATTTAATAATACACATAAAATAACATTTTATAATACACCTG
ATATGGATATTCATCAATTATTTAGTGATTGGATTTATAGAATTGATAGTTTTGATAGTG
CAATTACACAATCAATATTCTTAGGTAACTATGTTGGTTTTAATAGTGTAGGTGCTGGTT
ATATGAGTGATATAATAGTATCACAATTATCATCTGATGGTAAAACTGAAACTAAATTTA
AACTATGTTATACTTTTCCTATTGATATAGCTGAAGTTGAATTAAGTGCTTCTGGAAAAG
AAATATCATCAACAGAAGTCACATTTGCCTATACATATTGGGAAAGAGTATAAATAATAA
TAAAAATGGAGATAATTAAAATGCCTTTATATACAGTTGATAAATTAGCAAATGCTCTTA
AAGGTGGAGCAAAAAGTGATAAATATTTTATAGAAATAGGTACTCCGTTAGGTGCTCCAG
AAGTAGCATTTACAGAAGAGGATATTATATTATGTAAAACTGCTAGTTTCCCAGAAAGAA
CTCTTGGAGAAGTTGAAGCATTTGTCCAAGGTAGGAAATTAAAATTACCAGGTGATTCAA
CATTTGATGCAGCTTGGAGCCCAGTATTTTATCAAACACCTGATCATAATATTAGAGCGA
AATTTTTAACATGGATTGATAAAATTGATGTATACAAAAACAATTATCATACTTGTGATC
CATATAGTTTAATGGTTACAGCTAAGGTTCACCAAGTTAATTGTAATGGTGAACCTGTTG
CAACTTATGAGTTTTTTAATGTATGGCCATCAAAAGTTGGTGAAATAGAAGTAGCAGCAG
ATAAAACCAATTCTATACAAGAATTTACAGTTGATTTTACATACTCACATTGGGAAAAGA
TAGCTTAATTAAATAAGGTATTTAATGGGGCTTGAAAGTGGTGAGTTAAGAAATGAAGCA
CAAGGTGGATACAATCCACCTTTTGAGTTATCTACTTATAAACACCAAGTAAAATTTACA
CCACCTAATAATTTTGAAAGTTATATAAAATGGGAATTATTAGGTGATATTCCTTTACAT
TTAAAAATAGATGAAAAAACTGGTTTAATAACTGGTGATATAGAACTTCTTAGCAAACAA
CCTTCAGCAAAAAATGCTATATATGAATATCAATTAATGAAAATAGATGGTAGTAATTGG
AGGCATTTAGGTTTATTAAAAAATGGGCAAACTTTTACATTTAATTTTCAAGTCAAACTT
ACTTATACAGTACAAGTAAATTCAGGAGGTTCTAGATTAGGTAATACAGTAACAGAAGTA
AGCGATGTTACTATTACCATATTGCAAGACAATGATATAATAAGCACTTTATTTTGCAAA
AATTATATTGATGAAGCAAAATTTCCTTTAAAAATCGGAGATAAAGTATATACTGATGCT
GTTGAGTTTATGAAAAATCATCCTAATAAAAACAATTTTAAAATAAATTTGGTTTAAGTT
TATTTTAAGTACATTATGATATAATATTGATAAATTAATATTGAAAGGATAAAATTATGG
AAAAAAATTACAATATTTTTTTAAGAACAAAAAGTGTTACAATATTAAACTTAATGATGA
TCTGAAAGATAAACTTAAAGATACAATAGAAACATAAATGATTATGATATTATTAAAAT
TAAATTAGGTAGAACATTTTTTAATCAGAAAAGATACTATAAAATATATGCTAGAAAAAA
ACTTGGTTTTTATAAAACATTACTTTCAGAAAATGATGATTCATACTTCTTTATGGAAAA
CACATCAAAAATTATACGCAGAGTATTTAATGAGTATGATGTAAATTGTTATAATCTATA
TCCTAGTAAAAAATACAGGTATGGTCTTAGTATATTTATGCTTATTTGCTGTAGTATAAT
TTTAATAGTTTTATTATTAGGTATAAGTGCTTTATCATATATTTTTAAAGGCTATTTTTT
AGCATTTGGTTTAAGTTTATTTTAAACAGGTAACAAATGGATAAAATAAAGTTTTTAAAT
AATTTAGGTTATAAAGTTGTATCTGAAGACTTAGTTAGAAACTTGTATGTAAAATGTAAA
GATAATCATATTTTTAAAAGAGAATTTGGTGATTTCAAAAAAGGATATATAAAATGTCCT
AAGTGTGAAGAAGAACAAAAATTAGAATTTATAAAAGGATTAGGTTATGAAGTTGTTACT
ATGGATGAAAAAGGAAAGTTATTACTTAAATGTAAAAATGGACACATTATAAAAAAGGAT
TTTGGTAACTTTAAAAAGGGAACTACTACATGTAATGATGTATAAAGAAGAGAAAAATT
AAATTTATTAGAAGTTGTGGTTATGAGCCAGCGTCAGAAAATTTAGCACATGACTTATTC
ATAAAATGCAAAAACGGGCATATTTTAAAAGAGAATATAATGATTTAAAAAAAGGATAC
ATCAGTTGCCCAAAATGTAATGAAGAAGATAAGATAAAACTTATAACTAGTTTTGGTTAT
ACCATAATAAATCAATATAACTCAGAAGAATTAGAACTCATGTGCAAAAATGGTCACATA
TCCAAAAGAATATTCCATAATTTTAAAAAATTCCCATTATGTAGTGAATGTGTTGAAGAT
AAAAGAACATCATTTATAAAAGAATTAGGTTATAAAGTAGTTGGAAAAAACTTATTTGAA
TGTAAAAATGGACATACTTTTAGCAGAGAAGTAAAGGTTTTAGAAAAGGATGTGTATAT
TGCCCAATATGTAACCCTTCTACTAGCTCATTTGAAAAAGAAATATCTGAATTACTAGAT
AACTATATAGAAAATGATTATTCAGTTTTGGGTGATAAAGAATTAGACTTTTATTTACCA
AACCATAACTTAGCTATAGAATGTAATGGAGACTACTGGCATTCTGAGCAAATGGGTAAA
GATAAGAACTATCATTTAGATAAGACTAATAAATGCTTAGAAAAAGGTATTCAGCTTTTA
CAAATATTCGAGTCATCTTGGATAGAGAAAAAGATATATGGAAGTCAATTATAAACAAT
AAACTAGGAAAATCAGAGAAAATAATGGCTAGAAAATGTATTCTAAAAGAAGTATCTAAA
```

FIG. 12AD. Continuation of (CJLB-7 [organism=Campylobacter phage CJLB-7] complete genome)

```
ACAGAAGAGAAAGAGTTTCTAGAAAGAAATCATCTCCAAGGATTTACTGGATCAACTGTG
TGTTATGGACTCTATTACCAAGATAAGTTAGTCTGCTTAATGTCTTTTGGAAAACCTAGA
TTTACAGACCAATATGACTGGGAATTAATAAGATTATGTACTAAAATGGGACTAAATATT
GTAGGTGGTGCTTCTAAATTATTGAAACATTTTGAAAAAGAAAATGAAGGTTCATTAATA
AGCTACTCAGATAGATTATACTCTGATGGATCAATTTATAAACAATTAGGATTCGAATTT
AGCCATTATTCTAAGCCAGGTTACTTTTACTATAAGAATGGGACTAAATACTCTAGACAA
CAATTTATGAAACACAAACTTAAAGATAAACTAGAAAAATTTGATCCAAACTTGACTGAA
TCAGAGAATATGAGTATAAACGGGTATTATAAAGTATGGGATTGTGGGCAAGGTGTTTGG
ATAAAGAATAGGAAAGGGATATTATGCCACCAGTAACTAGATTAGGAGATATAGCATTAG
GACATAGTTGTTATCCACCTTCTCCTACAATAGAAGCAAGTTCTAATGTTTTTGCAAATT
CAATAGCTGTTCATAGATTAGGTGATAAAATACAACCACACGCATGTCCTGACACACCAC
CTCATGGTAGAAATAGTTCAAGTGGTAGCACAAGTGTTTTTACAAATTCAAAAGCTACTT
GTGGTATAGGGGATGCTGTTAATTGTGGAGGTATAATCGCTCAAGGGAGTAATAATGTTT
TTAGAGGATGATAATAAACCGCTTTCAAAAGTTTTAAACGATAATATTATTATAAAAGAA
GATGAAAAAAATATTTACATTAAGTTTAAAAAGAATATAATAATAGAATCTGATAACAAT
GTTATTTTTTAGCAAAAGACTACATTGTTAATTCAGCTAAAGAAATTCATTTAAATCCA
GATGTAAAAATATCCGCTGATGATAATGTTGATGATATTGTTAAAAAGATAGATGATAAG
AAAAATGAAATTAGTATCAGTAGTATTGGAAAATTAACACATAATCACAAACATTGTAAA
ATTAAATGTTTTTTAAAAAATTATTTAATTTAAATTAATATTTGATGCTTTAATATTAG
CATTTCCAGTAACTGTAATATTACATTCGCCTTTAATTGTAATATTACAGTCTTTATCAA
TACTTATGGTGTTATTTCCTTTAATATTTGTTGTATTATCTTTATCAACAGTTAAGTTTT
TATTTTCTTTTATATGTGTTGTATCATTCTTATCTATAATAGAAGTTTGGTTTTCTTTAA
CATTTAAGTTTCTATCTTTTACAACATTTATTGTTACTGTACCTTCTTTATCAATTAGAA
CTTCTGTACCAGTTTTATGAAATATATGTATTCTTCATCCCCATTTGAATCATCAAATT
CCATATAATGCCCTGATTCTGTTTCAAATACTTGATTTTTTAAGTATTTTTCACCTTTTG
ATTTATTGTTTGTATCAGGTTGATTTTTATAATCATTTAAAGGATATTGACCTGTAGGAT
CTTTAAATGATTGTAATTCTTCATTTTGATTATTAACACCTTTTAAAACACCTATTATAA
TAGGTTGATTTCTATCATTTTGAAACAAATGAACTAATACATAAGCACCTTTTTTTATAA
AACTTGTAAAACCCATACCAGAAAATAAAGAAAAATCCAATGAAGTAGCCCAAGGTAAAG
TTTCAGTAGGTATAGTTTCATCATCTATACCAATAATTCTTACTCTATATCTTTGTGATT
CTAAAGGATCTTTATCATCTTCAATTACACCTTTATAAAAAGGTAGGGTTTGTGTTAATA
TTTTAAAATTCTTTTCATTTACTCTCATACAGAACCTATTCTTCCTAATGTTATTGTTTG
TGTAAAAACATTACCAGATGATATATGATCAATTATTTTAGTTATAAAATATTCACCAGT
AACATAAGGCATTTTTGATTTTAATGTTTCAATAGATGAATTTGCATCAAAACTCACTTT
ACACATTAAATTATGGTTAAACATGCCAGCCACATTAATATTTATAGCAGAACTTTCTAA
TATTTCAGTATTATATATTGAATCAACTATATTATGTAAGTATGGGAATATTTTTATACC
TTGAATGCCATCTTTGTCATTTATTGTTAAACTTGTTTTTAAACCACTTTTACCATGCGA
TATTTTTGTATTGTGTTCTTCTTTAGTAATTCTTTTTGAATCAACTTGATAAGTTTATAGA
CGGTGGTAAAATTGCATTTTGAGTTAACATATCACCTTGTGTATTAATGTAAAGTCTTTAAC
AGAATAAGGTGAGTATTCTTGTGTTTGAGTTGGTGAAAACTTTACTACTTTTGATAGATC
AGGTGCTAACTTACCTATATTATCAGTAGGCATAATAACAATACCTTTTCTAGTATTAAT
AATAAGTAAATCATCAAATTTTTGCATATTATTTAGAAGATATAATAGATTTTTATTACC
TTGTATTACATAATTCTCATAGGTATTTTTAGGTGTATCTTTTATAATAACATTTAATGG
TGTTGAAATTAAATCAGATTTTGTACTAAAAATATCTTTAATAACATCTGTTGACTTTAC
ATTATTGTACCCTTTTGAAATAAAAGTATTAGCAAACATATTATAATATTCATCAACTAA
CTCAAATTTTATAGTGGCAATAGATTGACCTTCAAAATCTCTGTCTATTTTTGTTACCTT
AAATACTCTTTCAAATTTAATATTAAAGTGATCTTTTAATGAAACTTTAAAACATATTCC
GTTATGTGGTGGTAAAAGTTCTGTTATTTTTTGGGTATCATTAAAAATAACATAACCTTC
AACGCATAAATCATTATAATCCCAGATTATTGTAAAATCTGATATATTAGCTGGGTCTAG
TGGTAATTCAGATTTTTTATTGTTTGAATATAAAAGTATTGCATAATATGCTTCAGGCAT
AATTTTAAAATCAGAAAACATTTAACATATCCTTTATGGATTCTTTAAACTGAGGTATAA
ACTGCCTTTTTATAAAAATAACTTTCCTTCTTGATTCATTCTTTTTTGTATTTTGATA
GTATTTGATTATATAGATCTTCAGGTTTAAAATTAGGTGAAAAATATTCTTGTTTGTTCTT
TATATTGATTTTCAGCATTATCACTTACCCAAGTATCGCCTTTAGCAAAATTAAGAATAC
CATTTTCACCAAAGTTTAAAATCATCAAAATATCCCATAAAGATGAATCATTATATTCTC
TTAATGCTAATACTTCAAATCTAACATTATCATTCATTTCTTTAACATAAAACATTGATA
AATTATTTTCATAAATTCTCTTAATTTTGGTATATTTACTGAATATGTAGGAGATAATG
AAAATCCATTGAAATCAACCATTATTTTATTATTCAAAACAGAATTTTTCATAACTTGCC
CTTGTATTATAAATTAACTATTTTCATCTTGTGAATATTTATAATTTAGTTCCTCTTCTG
TTAGCCCTATATTAGGTTCTGATATTTTTTCATTCCCATTTGAATTTGATGTATCAGTTG
TTTCAACAATATCTGATGTCATTCTTAAAGGTCGTTTTTCTTCAAATTGTAACGCAATAG
ATAAATCTCTTGGTAATCCGTTTCCATATAAAGCAGATGCCTGACCCATGTAATTAATAT
TACACATTTTAAGATTTAATTCAGTTTCTCCGTTTTCTTCATGATTTAATTGTAAGAGTT
TATTTAATGTTTTTTTAAGCTGTTCACCTTTAGCTGGATCTTTAGATCCAAATTCTATTG
TAAAAACATAATCTTGTGATATCAATAATCCAGTTTTATCTGTACCCAATTGAGTCCCAG
TCATTATTGATTTCAACTGTAATAACGCCTTAACAATATCCTCTGCATGCTTTGCATTAT
```

FIG. 12AE. Continuation of (CJLB-7 [organism=Campylobacter phage CJLB-7] complete genome)

```
TAGGTAAAAGAATAGTTTCAAAATTAAAGACCCTATTTGGTGTCCCATTATATGTATTAA
TAATATGAGGGTCAGTCCTGATATTATTCCGTTTTAGTAGATTATACCCAAAAGGTAATG
CTGCACCCAGTTGCCATTCCAACTATAGCACCACCTTTTTTAATTTTACCTTTAACTGTAG
ACATTTTATTAGGTTTTGGTTTAGTTCCACTAGGCTTTATTGTATGTGGTGGTACTTCTG
TATTATGTACTTTTTTAGAACCCTTGTTAAAAAATTCACAAATGATCTTATAGATGCCA
TAATTTATTGTCCTATCATATCACCTATTGGATCTATTTCATCTTGATTAAATTCATGGC
TAAATGCTTCTGCTAAAGATGATGGTATAGGTAATATCCAATGTATTCACATGGCACAC
CAGGTTTTAATCTAGGTCCTGCCTCCCAGTTAGATGGGTTTATAATATTTGAAATATTAT
TCTCTGCCATGTTTAAGATATTATCAAATACTTTTGATGGATCATCATCTAAAATATCAT
TAATGCTATCTTTTATACCCGATACATCACTTCCTATTTTATAAGCTTTTATAGCAATAT
AATCTCTAGCTTGTGAGTCACATATTAAATCAAATATTTGAATAGTTTGTGTATCATTCA
TAAAATTGCATCCTTTCTATTCTTTATAAATATCATCTTCTTTTAAAGAAGTTTCTGATT
TACCTTGATCGTTATATAGGCTATTTATTTTCTTTTCCCAATCATCTCTCCATAAAGGTT
TCCTTTCAACAAATTGAATACTCAGAGAAAATTCAGTCGGGTTACCATCATGTCTTAGCA
TTAGTTGCCTTGATCCTATATTAGTATTTATTAAAGATATAAAAAAACCTTCTGTAATAT
CTCTTGAAGCACTTAATAAGTTTGAAACTAAAGGTGTTTTATCATTTTGCAGTGAAATAA
TTTCTATACAAAAAATGTATTTCATAATCAAAAAATTCATAGGTATTATATTTCCTACAC
TACCTAAAGTAATAGGATTCCTTTTAGCTTTTGTCCAGTTTTTTAACTTACTTATTTGAG
CAACATAAGCGTCATATTGTTTTCTTGATTTGGTATTATATTCCAAGACATATCTATAT
TTCTAGGATTTGATGACCTATATATTGATAAATGTTAGGATCTAGTTGAATACCACTTC
TTTTTAATGCTTGTTCAGATATATTTTTTATAGAAGTTTGACCTGCATAACTACTTGCTT
TTGAAATAGCACTACCTAACAAGTTCATAGACTGTACTTCATATGATTGTACATATTGGT
CTGATAATGAGTTTGGCAGAGGGAAATAGAATGTCCCAGCAGCATCTGTTGATATAACAG
CAGAATCTCTATCAATCATTAGCTCAACTGTGCGTTTTAATATATTACTTGAAGTTTCGG
ATAGCTGATCTATAGATGAGTACTCTCCTTCTGAGTTAATATCAGTTGATCCGCTTTCAT
CAACTTTTTTATCAAATCATCCCAGGAATCCATAACTTCCTTCCCTATACCTAAATTAT
CAATATCGTAAGCTGTTATTTTAACTAAATATTTTTCATTATCTAATCAGGTATATTAA
TTACTTCAGCCATGTTATAATCCTAATTTCTTTGTAATTTCAACTGATTTGACAGCATCA
ACAGAAGGTTTATCACCGTCTCCATTAGTAGAAGATTGTTTATTATTTATTAAATTAATA
CCTTTTTGAAATTGATCCTTTGATAATCCTGACATTTCAGTAAATTGTTCGTCTGTATCA
TTTTGTAACATATTTTCTGTTAATTCAAGACCAGTATTTGTTAAATAATAATCTTCTTTA
GTTCCATCATCATATGTTCTTGTTTTCTTGGTAATAAAATTACCATCTGATGTATAATAG
GTATTATCATCTTTTCCTTTTTATAAGTTATATTTTTGCTTTTGGGTTTTAACATCA
TAAGAAGTTGCTATTTTTTTCTCCTCATAACCTATATCTCCAGGAATAGATACGCCATTA
CCAGTATTTTTGTAACCTATATCCCCAGGGATAGATACGCCATTACCAGCATTTTTGTAT
CCTATATCTCCAGGAATAGATGCACCCTTTATTATTTTTTGGTGCAAACTCATCACCCAAT
CTTTTTACTTCTTTATTAATTTCAATTGTGTCCTCTGGAGCGTACTTTTTTGATGTATTA
TTAGAATAATTAATAGGTTCTGTTTTCATATCTGTTATAACTTTATTTGCAGTTGGTTCA
ATAGTCTTTACATTTGTTATAACTTTATTTGTGGTTTGTTTAACATCTCTTGTATTTGCT
TTTATAGGTTTTTCTTGTTTTATATTAGAAACATACATAGATCTACCTATATTTATAGAA
TAATATTTACCAGAAGTAGAAACTATTGTACTTGTAGATAATTGTTTTTTTACATTTGTA
TTAATTGGAGTAATAGTAGTACTTATAGGTTTTGTCTTTTGCAATGTATTTGCTTGTTTC
TTTTTAGTTTCAATGATATCAGCTTCAAGCATACCATCACCGTTTTATCAGTAATGTTT
TTTGGTTGAACATGCCAAGGTTCCTTATTTGGTATAGGCCTCCAAAAACCATGTTTTGAA
AGCATTCCACTAGAATCTAATTTTATTGCATCTGCACTATTAATATCTACTGCCATACCA
TATTCATGTAATGAATATCCAGGTCTGTTTGCAGGACTACCCTTACCATTTATAAAATTA
TTATATAGTTTTTGCTGTGATTCTATACTCCTATAACCAGAAGTTACAGTAAATTGTTTT
TTATATATATTAAAGTAATCATAAGCCATTAGATTTAAATTGTATAAAAGGTTTGAATCT
AATTTTCCTATACCAGTATTAAATGGTTCACTACCACTATATGAAAAATAATATTTAGAT
GGATCAAAACCTTCTAAAGTAAGACTTGACTTTGTTGTAGTAATACCATATTTTTTAACA
TGAGCAACTCCTTCTGCTGTCAATTTTGCCCTACCTACATGTTTTTGTAATACAGAACTT
ACTCTTCCTATTACAGTAGATGGTGTTGAAACATTTGTATTTTTTCCATTTTCTGTGGT
TCTATATCAAATTGACTCAAAACTGTCTGATTTTGAAGTTTTTTGTTTACATTAAAAAAT
TGTGCTTTTGTTAACCTGTTAAGATCTTGTACATCTCCAATGTTATAACTTTGTGAGGCA
CTTTTATCATATACTACTTTATATAATTTATCTCCAAATAGTGATGTTTTTGTTTCCCT
TTTTTGTCTTTTAATGGTTCTAAAGAATTGTCCAAAATCATTTTTTAAAATCATTTAAT
ATATTAGATGGTAGGACATCATCTATATTATCATTAAAATCATCATATGTTACTTCATAA
GAATTTGAAAAATAATACATTGCGTTGTGTACAAGCCTTATAAATCCTTGTCTTACATGT
TGTTTTCCAAATATTGAATTCTTTACCATTGAATATAGTTTTGGATCTTTTTCCTTCATT
AAGCTTAAAGATTCAAAATAATAATTATCAACAAATTTATTAGTTTTAGCTTGAGTTGTG
ATGTATTCAAAAATAATTAATAAATCAGGTCTTAATTTATCGTAAGTTTCTGAATTTTTT
GATAATAAAGTTGGATCCATGTTATCAAGATCTGTATATAAGTATATAGGTAATCCATTA
ACTAAAACACTTCCATCTTTTTTTATTTTTTCAGCTATACCTAAACTTAATTTCATTATA
CCATCTTTAGCCATTTTAAAAGTACTAACTATAATATCTTCAAATACAAACACAATTGCA
TTTTTAAGCATAGTTTCAAGTGTATATAGCTCATTATTTTCTTCTGTTTTTAAAGCTGCA
CCAGCAGATATTAATGTAACATTGACCAATCCACCTTTACTAAATACTAATTTTGGTACA
```

FIG. 12AF. Continuation of (CJLB-7 [organism=Campylobacter phage CJLB-7] complete genome)

```
ACAGTAATAACTCTAGAACCTGATCCTACTAACCTTACAGGTGGGAATAACATTGCAACA
GCACCTAATGTCTTTAGAATGTTTATTCCCATTTGCTTATATAAAGACTCATTATTAAAT
CTTCCATATAAAATCATATAATAAGGTATTCCATTATTAGACATATAATCTAGCAAAGGT
TTAAATGTATCTTCAGTATAATTTAATATTTTAGTAATAGTTTCAATAGAAGCATCTTTT
AAAGAATCTGCATCTAATGAAACCATTTGGCCATCTATTTTAATAATATCACTCATTTTT
ATCCTCGTTTGTTAACAATTCAATTTCAAAAGGATATAAACTATCAAAATCTGTTTTACT
AAAACCTAATTGTGATATAAAATATTTAAGTGTAGAATAATACCATTCTAAATCAAGCAT
TATAACATAATTTTCAAATAAATCTTTTAATTCTCTTACAGCTAAAACATCATTATTACA
CATAATACATTTTACTTTAGCACATAATTTTAAATCACCATCATCATTTAATTGATTTAA
AATAGAGTTATAATCTTTTAATGGTAACTCATTACATAGCTCAATATTTTGTTTTGAAAT
AGTATGTTTTTTATTGTTAATTTCAACTTCAACAGTTTTTGGAGGTATAAATTCTAAATT
CTCTCTTATGCTTATTCTTGTATCAATAGGATTGCCACAATGTGGACAAGTTAGTAATAT
ATCACTATAATCACCATTAGCATAAGACGATAAGACTATCATGGTATATAATCTTGAAAT
ATAATCCAAATCTTTTGTTTGTGGTATTAATATATCAGCTATTTATTTATTTGATCTTC
TAATGGTAGTTCAATCCAATCAATAAATTGATGTAATATACCTATTTCATCTTTTATCTT
CCATACATTTAAATAGTAATGTTTGTTATTAATAACAATGTCTTTTATCAAAATAAGTTC
CTTCTAACAGATTCAGGTAATTCTTTTAATTCAACATTTATTTCACTATTACAATTTTTA
CAAGAGCAACTTTTAATAATACTATGTTTTGGTATAGAATCTCTAAAATAATCAAATACT
CTATTAAAACATGATAATGGGAGTTCATTAATATATTTTTCAAATATAATATGATTACCT
CTTAATTCTTCACCATTTATAGAAATATAATCAATCATATAATATAATTCTAATAATCTT
TTCTCGTGGTCTATCATGTTTTTTGTTTCTGCAATAAGACATAAAGAGTCATCTTGTGAT
AATTCTTTTTTAAAATAAATTGTAACAATAATATTATCTACATTTATTTCAATAGGTTCT
AACGAGTATTCGGTTATAGAGATATCATCATCAGTAAATTTTATGTTATTCATTTCATTA
CAGTATGGGCATTTAAAACTAGAATCTATTTCACTACATACTTCAGAGAAATATTTCTTA
AAAAATAGAAATCTAGCCTCATCATTTGTAATATATTTAGGTTGGTTTAGGCATTTATAT
ACTAAAACATCAATAATATCGCTGTCATAAACATAATTATTATCATTATATAATTTATTT
AATAAAACAGAATGTTTTCCTTTCCAAACTTCTAATTCCATAGTTTCCTCTCTATAAATA TTAC
```

FIG. 13A. (CJLB-10 [organism=Campylobacter phage CJLB-10] complete genome)

```
GCTAGTAGAAGGATTGCATACTGGGCATAAGATATTCCCTCTTTTAAAATGTCCGAAACT
TCTTTGAAAAATGTGGCCTTCTGGGCATTCAACGGTTAAATATTTTGCTAAGTTTTCTGA
TGTAATTTTGTAACCTAATTCATTTATAACTAGCATTTTTTCATTATCTTTGCATTTTGG
ACAATATGTTACATTTTTACCAAAAAAATTGCTGAATGTTCTTTGAAAAATATGTCCTTT
TGGACATTTAACTTCTAAACTATGCCCTAAAGACTCAGACTGAATTGTAAATCCCAACTT
ACTTAAATATATTTCTTTTTTGTTTTATCACATTCAGGACATGTAACTATACCTTTCTC
AAAGGTATAATATGTCCTTTTAAAAATATGTCCTTTTGGGCATTTAACCATTAAATTATA
GGTTAAATCATCAGAAACAGCTTCATAACCGCATTTCCTTAGAAAGTCTAGTTTATTCTG
TTTATTACAATCTGGACATATAATATGACCATCAGTAAATTTGCTAAATTGTCGCTTAAA
AGTGTGCCCACTTGGACATTCTACTAAATTATCAGATTTATATTTAAATCCTAAATTATG
AAGATGGTTTATCTTACTTTCAAGTTCACATTTTGGACATGAATATGTTCCTTTTTTAAA
AACACTAAGTGCTCTTTTAAAAATATGTCCATGTTTACATTCTACTTCAAAGTAATCACT
TTTATCTTTTGATAGTATATTATATCCTAAATTATTTAAAAATTGTGTTTTTCTTCATC
TTTACAGTTTGGGCATGTAGTATAACCTCTTTCAAATACATTAAATGCCCTTTTAAAAAT
GTGTCCTTTTGAACATTTAACTTCTAAATTAACTGATAGATTTTAGATATAACTTCATA
TCCTAAATTATTCAAATATGTTATTTTATCGTCATTATCATTAATTATATCCTAAATA
TTTTAATACTATTATAACACAGACTATATTAAACTACCCTTAATTTATAAATAAATAGGA
TAATATAATAACTTATGAAGGTAAAATTAAATGGAGTTTTTCTTTTTCAAAACAACTAAA
AAATACACAAAATCACTACTCAGTCTATTCAACAGTATACAAGTTAAAAGAAAATAGAT
GAAAAAACAGATAAGTATGTCACAGTACCTATTAGTTTTGGAAGTAAAGATGCTGCTTCA
GTCTTTAGTGATACAGAGTTAGATCAATTATTAAATGGTAATTTTAATATATTACCTAGA
ATGTCTTTAGCTTTAATGAGTATGGAAAGAGATGATCAAAGAGCTACAAGTAGATTTCAA
ATACCTATAAAAGATATTGACGGAAAAAATATAACTTTTCAACATAACTGTGTTCCTTAT
TCTTTTGATTTTGTATTAAGTATAGCTACAAGGTCTTTAACGGACTTAACTTCTATATTA
GAGCAAATTTTACCTTTCTTTAACCCAAACATTAATTTAAGGGTTAGAGAGTTAGAATGG
TTAACAGAACCTACAACTATACAAGTTGAATTAATTAGTGTAGATTATGAATTACCTGAT
GAAAATGATGGAGCTGATATAAGAGTTTGTAGTGCTAATGTTACAATGAGACTTCACGGG
AATATATATCCCCCTATTAAAAATGGTGCTTATTACACAGATGATACTGATGATAACA
TTAAGTTTATTATAAATGTATTAGAAGATAATGGTGTTAATCCTATTATATCAAACAAC
TAAATTATTTTACTGTGTTTGCTAAAAATAAAGGTGCCTTAAAGTTAAGTATTCAAGCAG
TAAATTCATTTGATTTACAAAGTAATATTTATGAAATGGAGTTAGAATTCTCATGAAAGA
AAAAGCAGAAGCATTAGGAAAAAAATTAGATAAAATAAATGATATTTTAATGTGACAGA
AAAAACAATAGTTGAAGTTGAGAAATCAGATTTAATAAAATCTAATCCAGAAGAAAATTT
AAAATTCACATATTTAAAAGAAGATTTTAACCTAATGAGAGAATCTTTAGTTAATACTAT
TAAAAGAGGACAAGATATATTAGAAGTTATTTCAAATAATATATTAGCTGATCCTTTATC
TTCTAATCAAGCTGTTATGGCTTATTCAACATTAGTTGATACTATAAACAATAGTACAAA
ACTACTTACTGATATCTACAAAAATATAGTTGATATTCAAATTAAGATAGCTCCAAAAGA
AGCTGAAAAAGGTAGTGGTAAGCAAGAAATAATGACTATTGCTCAAATAACAAAAATGAT
TAGCAAGAATCAACAAAGCCAAAATTAGGCTTTGTTTAATTCTATTGCATTAAAAATCAT
TTGTGTTAATATCCCTCAGACATTTTTATTAACCTTTAATAGTATATTTTCAATTCTTTC
TGAAATATAACAACCAGTAAGTACAATAACAGTTATAACCTTATTTAAATTAACTTCATC
TATTTCTACTAATATAACTATTAGATATAACAACAAATACAAGCACAAAAATTATTCAT
AAACCAATTTAGTATTTTTTAAACATTTTATCTCCTTTTTAATTATTTATCAAGATTCC
AATTGATATTCTCTAAAATCACAAAGCTCTCCTACTTTATCTTCTATTTCTTTTTTGTGG
TTTGGACATAATTCTATAATATCACATAATAATTTATTGAAAAGAAAAATAACTCAGTT
TCCTTATCTATTTTTTCAATAGGTATATTATAGTTTAAACTTATAAATTTTTTTACAGTA
TCATATTTTGATTTTATTTTGTAATTTTCGAATACAACTTTATCTGAAAATGCAAATCTA
ATATTGTGATAGTTATTACCAATCTTACACATTTAATAAAATTACTTAGTTTCATTGTT
TTTCCTTCTAACAAATTTATATTTTTATCTTCTTTTATGCTGTTTTCATCCTCTTTGATG
TTTAACCCATGTCCATTTAATTCTTGCTTAAGTTTTTCATAACTGTAAAGTTCTTTTTTA
CTTGTGTAGCAATTAAAATATTCTAGCATTTTATTTCCTCTAGTAAATTATCTTTATTAT
TCATATTGTAACATAATAGTCTTAAATTAAACTTATTTTGTATTAAAAATATGTAAAAAT
TTCTAATATATAAAGTCTTCAAGTGCATTTTCAAGTAGATTTTTATAATTATTTCTATCA
GCAAATAATATTTACCATCTTTAAACAAATAAATGTATTTTATATCACAATAATAGTCA
TCAAATACTACATTCTTAAATGTTTCCAAATTCATTCTTACATCATGATTATAGTTATGT
TCATATTCAAAGAAATTGCATAAATCAATGCAGTTTGATAAAAAGCGAATATCTTTACCT
ATATTTAATAATTCACACAATTTATTATAATTATAATTTTGTAAAAGTATTCTACCAGCT
AATTATAGACATATTTGTAATTTTCCATTTTATCCCTTTTTAATTAAATAATTTTCTTTA
CTTTTATAATTATAACAGATTAGCCTTAAAATAAACTTATATTATTTATTTTTATTTTTC
AAGTTCTTTTATTAATTTACTTATTTTAATTTTTCAACCTACAACCTGTAACCTTCATAA
TCGGCTTTATACCATTTGCTTATCTTTAATAAACTTATTTAACTCATCATCATAACCAT
AATGACTTTCAATCTCTTTAATTTTTTCTAGCATACATTTATAGAAGTCAAAACCTAAGT
CTGAAACTTGTTTCTCTATGTTAGAAAGTATATAACTTACAATTTCATTATAACTAATTC
TACTTATTCCATAAATTACTTCATTATCTAATGCTAAAGAATTTTTATTATCAATTAAAC
AGCTATTTAGATATATTAATGCTCTCATTCCTGAATTATGATAAAAGTCGTATTCATATT
CAATATCGAAACTATTAAAACAAAAAATTACTATATCGCAAAGTGCATCTATTTTTTCTA
AATCATCTTTTGCTCTAAAATATTCACTAATTTTTCAAAAAATATTACCTAAAAACTTTT
```

FIG. 13B. Continuation of (CJLB-10 [organism=Campylobacter phage CJLB-10] complete genome)

```
CTTGTTGATTTTCATAGGTTAAATTCTTTTCTCTATATTTTTCTAATCTTTCTTTAATTT
CATTAAATTGCTTTTTGTTCATTTTTTTTCCATTTTCTATTGTATTGTATTCTATTCTAT
TCTATTTATTTTAACTAGTTCTATATTTAGGTTTTCTATACTACAACACTTATTACAATT
TTCATTATTTTCCCAATTACAATAACAAGTTTTTACAAAGTTTTTTACAATATAATCTGC
TTGTTTTCTATTTAATACTTCAACATATTCATTTTCAAATAATGTTGTTACCATTACCTT
TTCCTCTCAATTTACACAAATTATATCATTATAGACTTAATTATCATCCATCCAGTCTGC
TATTCTTAAAGCATCCTCATAATTTTCAACAAATACTTCTCCGCCTCTATCACCGAAAAC
ATAATACTTATTGAATTTAAATTTATATGAGATATAATAATTATCTTTTGCGGTGCTTTT
TATTTTTATAGGATAGAATATACACATTAATTCTATAATCCATTGTTTAATTTTATTCAT
TATCACCTTCCTTTATTGTAATATTTTAAATAATTTTATTATTCCATAATTATAACAGAT
TAGCCTTAAAATAAACTTATCTTACTCTAAACTCTACACTATTTACCTCTTAATATTCAG
TAATAAATTTATCATCAGGTTCCTGATAAGGACTTCCATATTCAATAAACATACGACGAT
GAATAGGTTCATTAAATATTTTAAAGCATCTTCATAATCACTTATTGAAATTAAATCTT
TTTTATCATAAAAATAAACATTGTCTGGTGAAATTAAGCAATTTCTAAAGTCTTTTAATA
AATGCCAATGTTTTCCATCTATTAAACAAAACTTTTGGATGTTTCATATTTATCATCAT
ATAACTCAACTGAAAATTTATAAAGTGCCATATATGATAATTTCATTAATAAATCATCCA
AAAACATTATACAATTAGTTTTATTATCAAAATGCTTGAAAATATGCGTTAGAGAATCAA
GTTTATCTTTGTACTCATAAGAATTAAACTCTATTGTATTTTTTCAAATTGCTTAATTT
TTTCAAGTGCTTTTTTCTCAGAAGGTTTTAATTTTGTATTTTCATTTATGGTTTTAGCAC
AATCAGAGTTTTCATCCTTTAGATACAAATCTAAGTAAACTAAATCGGTTGTTTGGATAA
TTTCAGACTCCGTAATTTTCAAAATGTAATCAATTAAAAAATCATCTTGTCTATAAGTGA
GTGTAATAATACCATAATCTTTAGTTATTTCATTACAAAGACTTTTGTCTCTTTTAATTG
CTTTTAAGATATATTTTGGTAAATCACAATCAACAAAAAATAATGATTTTAAAGGGTTAC
ATTTACACTTTACTTTTCTAAAAGTTTTCTTAAAACAATCAGGACTATAAAGTTTATCAA
AATTGATTTCAACTCTATCTTGCCTACAAAATTTAAAATTTTCAAATACAACTTCAAGTA
ACATTTCTTACTCCTTTCAAAAATTTCACAATTATAATAAACTTAAATGTCTTTATTATA
ATGTTTATTTGAATTATTGTGCGGTAGATCAACAAACAAATTACTTTCTATACAATTACA
AATATAACCACTACTAAAGCTACTCGTATTTCCATCAAAGCTAACTTTTTTATTTGGTAT
TATGAAATTTATAGGTTTTTGTAAGTTTGCTAATCTTAATGTTTCACTAAAATCTTGATA
ATTTATGCTCATTAAGTTCATTAATAACATAAAATCAATATTCTCTTGGGTTAAAAGTCT
TATGATTTCATTTTCTTACTAAAAGGTGGGTTGCTTATTAAAATGTCAAAGTCATAATT
AAGCCACCATTTGCTAAAAAAGTCTTTACCTTGATTAATATGTCCATAAATTACATCAAA
ACCATAGTGTTTGAAAACTTTAACATAATTAGAACTTTCATCATCAAAAGGACAAAGTAT
TTTAATAATATTCTTTTCATACAAACAAGGTATTAAAAATTCAATTAATATTTTGGTGT
GTAATACTCATCTTTTAAATCAAAGCATTATTGTAACTCTTCATACTTTAAGCTCCTAT
CATTTTTTCCTACTTATTATTCTTCTTTTAGTTCTATACAATTATTATACTATAATAGCC
TTAAAGTTGGCTTAAAAATAATTAGTTAGTCTTATTCCTCAACTTTTATACCACATTTTT
CTAAAAATTTATTACGCTCTTCATCACTAATTTCTATTTGGTTAATATTTTCATATCTTC
TAGGATATTTTGATTCACCTTCAAGAATATATTTACCCTCAAGAAAATCTTTATACGCAT
GTTCAAAAAATTCATTAGTTTCTTTATCAAATTCAATTCCATCAGGAATTAATACTATAC
CTTTAGCTTTTATTTGTTTCATTATCACACTCTTTGTAATTTGTTCTATACTTTTCTTA
ATAAACTCATAAAAATTTGATTTTTTATAAGTCTTGTCAATGGAGTCACTTAAGTTTTTC
ATAGCTTCATCTAATTCAGGATCTTCAAGTCCTGTTTTAATAACATTTCCATAAGCATCT
AAATAATCAATTTGACCATAACTATCCCTACATTTTTTATCCATTTTAATACCTATTTAA
TTCTTCAATAACTTCTTTTTCAAATAATAACGCATTTTCATATTGCTCTTTTATAACTAA
ATCCATATTAATGCAATAGTTTTCATAATCAATTTTACCGTCTAATAGTAATTTTATATA
ATTATGAGCATTTTGAAACCATTTAAATCTTGAATTATTTGGTAAATCAAAATTATCATT
TATAGACTTAATTATATTACCCATACACTCTAATATAGATGGTAAATATTCTAATAAAGT
TTCTTTATTTATAATATCATTTATCATTTCAGTAACCAATCTGAATGAAGATCATAAAA
AATAAATTCATCTAAATCTTTTCCATTTTTAATAGCTTTATTTAATTCATTTCTAAAATA
TCCCATAATAAATGTAGATTCATATAATAAATCATTTCTAGCTCTATCAATATATCTAAT
TTTATTCAAAATAGCTATATCTTTCATCGTTGGATCTAATTTTTTAAATTCTTCTAATAT
ATGATCATAAATTGGTTTTTCAACAAATTCAGAGTATCCTGAAACATCCAATACTTTATA
TCCAAATCTCATGTTTTTAAAATTTAATTTGCGTTTAATAATGAATTTTGACTCTATCAT
ATTCCTAACCTTTCAGATATCTCTTTAATTTTCTCTTTTGAAGCCTTTTTAAAATTTTTA
TTTTCTAATTCTTTATCTTTAATTCTTTATAAAATTTCTTTAACTCTTCATCTTCATTT
TCTCTTCTTATATTCATATCAAGATCAAAACTGAATAATGTTGATTTAAATGACCCAAGT
TCTTTTAAAAATTCCTTTTCAGCTTTTTTGTTAGAAATATTATCTCCAAACGATTGACAA
TGACTTATCTTGTATTCTAAACAGTCTATTAAATCATTTATAATACTCATATAATCTTTA
ATTGTAAAATCATCAGTATGAGCTAATAAGTTTAAACCTTGTATTGCCTTCATTTTAATG
CTTAATTTACTATGTTCTTCTCTCAACTCTGATATTTTCTATCCACAATTGATCTAATT
CCAAGATTTGTGGGACGACTACTACATTCTAATAAAGCATCAATTTCTTCTTGACTTAA
AATCATTGCCATAATTATACTCCTTTATAAAATATTTAATTAGTATTCTCTAAATTTTTT
TGCTCCGATATCACATTCATCTAAAAATTAATCAAATTCCTTCATCTCTTCATCATATAA
TAGAGCTTTAAAATTATTATTTTTATTATAAATATATCACTTTTCTTTTGTATTTTTTTT
ATAAAAATTAAATATTACCATAATTAATGGTAGCATAATATAAGGAAAGTATATAACTAA
```

FIG. 13C. Continuation of (CJLB-10 [organism=Campylobacter phage CJLB-10] complete genome)

```
TATGCATAGTAATATTATACCACCGACTATAGGTGCTCCAGCACAAAAGTTTTTAATATG
TTCTAACATCTTAATCCCTTGTTTTTATATTTTTCATTTATAATATAATTTACTGTTAAG
TTCTTCTGATTTTTTGAGAATTTGTTTTACTAATTCATTATCACCATAGTCTTTAATGTA
TAATAAATAGTCTTTTAGTAACATATACTCTGTGTCTTTATGTTCTTTCGGAGTATCAGT
ATGTGCATAACGGAATATATGGGTACCTAATCTGTTAATTAATGTTTCAATATCCACATT
TTTATCATTTATTTTTAAGTATTTTATATTATTTTTCATACAGCTTATGAAGTTGGTAAT
TCTTTTAAATTCATCATCTGAAAGATTACACATATATTTAACATTGTAGAACTCATCATC
ATAATAACATATGCAATTATTTAAAAATGCTAATTGCTCAGTTTCAAATTTAAAAGATAT
CACAGTTGCGTTATTCATATTATTCCTTTCAAATGTTTATGGTATTATACCACAAATAAT
CTTAAAGATTACTTAAATAATTCATTTTCAGTTAATACCATAAATTCCATATTATTTATT
CTACAGAACTCTCTTGCAGCTTCCCATTTTGCTTGATTTTTTGAAACTGTTAATGCTTGT
TCTACTACTCTTTTTTATTTTTTCTGTGATTATTTTTGGTTTTTTAAATATAGCGTCT
TTTTGTGGTTTAATTTCAATAAGATATTTCTTTATGTTGTTGTCTTTATCTTTTACTTCA
ATATAAAAATCAGGAAATATCTGTGCTTTTTACCTAGGAACTCATAAGGTATAATTATT
GATTCACTAGCCCATTTAAGAACACCAGCATTATTATCGCACCATAACATAAATCTATAT
TCCCATGAGCTACGATAGATGATGTTTGTTACATCATCTATATATTTTTCTGGGTTAATA
GGTTTATAAAAACCTTGTTTGAATTCTGGCATTAGTATTTAGGTTGTATTATTATATAAG
CATCTTCAATATAATCAAATGGATCATCAGGGTCTATAAACACTCCACTATCTACTAAAA
TTAAATATTTTGAAATATCATCATATTTTTAAGATCTTTTTTTATAATTCCAACTATTT
TATCATTTATTTCATCAGAGATTCTCATAGCATCTTCAATACCTGTAACTATATATCTTA
ATTCAATAATATTACAATGCATTTTTAATAACAACTCTTCATTATCACCATCAAACTCTG
GATTTGCAGAATCATATGTTATTTTTATTTTAAAATCATCAGTTTCTACTATACTTTCTT
TACCATTTATATACTTGTAAAATCCATTTACATCAAGTCCATAGTCAGCTAAAGATGATT
CATTAATTTTCCCAGCTTTATTAATATAACCTATATTTTGTTGCCAATTATATCATTTA
TTTTGTGAATAACTAAGTCAATTTGTTTAGGTTTCCCTTTATTATCTGTAACCTTTGTTA
CTTTAATATTATCATTTACTGTGATATTAACATCACATAATTTATTACCATTTTTGTCCT
TATATGTAGCTATTAAAGTATTTCCTTTCTCAGAAACACTATGTGTAGCATTTAACTTTT
TACCTAAAAAATCAAGTGATTTTTTGGCTAGATCCTTTTGAGGTTCCACTTCCTCATTTA
AAAAAATACTGTAAATATTCATTAATTCTCCTTTAATTTTATATTATTTATAAAAATTAT
TTAACAGTTTTCTTTAATAATCATTGTTTCTCCTTTAGTTTTGATTTATAAAAATTATAT
CACAGTTTTCTTAATTTTTATTTTCTTTTAACTACTAATAATTCGCGTTTTCGTGGATA
TTGCCTCTAACTAAAAGTTCTGACTCATTTAATATTCTTAAACCTAAAGTGTCATTTTTG
CTAAATTCTAATCTGAATTCACCGCTATGTCTTTTAATTATTACACCAATTCTATTAGTA
TCATGAACAATATCATCAAAGATTATGACATCCCCTTCATAAATCTTTTATTATTTTTG
TCATAAAATCCTGTAAATGTTCTAGTTCCATTGTTTTTCTCCTCGTTATGTGATATAAT
TTTTCAAAATTTATGGTATTATATATTAGTGGATATTACCGATAACTTTCATATTTTTT
CTGACTTAAATACTTTTAAAAAAGATATATCAGGTTCAGCTTTCCTTTTATAAATTTTAT
TATTAAAGTTTTTACTAAAAATTTCTATTTTAAACATTTTATAAGTATTATCTCTTTTAA
TATGATAAAGTTCTTCAAGAGGCTCATATTCTAATATATCATTTTCATAGATTTTATTTC
CATTTTTATCAAAATAACCAGTCCATAGCTCTATTTCAGCATCATTATTATTTTTATTTA
GTATTATCCCAAATCCTAAAATCAAATCTTTTAGTTCCATATTATTTCCTTATTATCTG
TCTTCCAACTCATCCTCATCTTATATTTTGCACTTTTTTCATTCATCATACTTGCAATAG
TTTCCTGAAACATTGAAGTTCTAAATAATAAACATATTCTAATATATCCCCTTCATAAAT
CTTTTTATTATTTTTGTCAAAATAGCCAGTCCATAGCTCTATTTCAAATCTTTTTATAT
CCATTTCTTTCCTTTTAAAGCTTTTAAGGGTATTGTATCAAAATATCCTTAAATTAAAC
TTAGAGATCAAATTTGGAAACTTTATCTAATATTTCTTCTTGTCTTTTTAAGGCCCCATAG
TTTGTTATTAGCTAAATCATGAAAATATTCAATTGTATCATATTTTTTCTGGAGTTTCTA
ACATTTCAAATTTATCAAAGAAATTGTTTTTGGCAGGAAAATTTCTTATTTATATCGATA
CAAATAATCGAAAGAGACAGAATCACTTACTAAAAGCCATACTTGTTTTTTGAATACCCT
CATTTACAATAGATTCAACATATTCTCTTTCTTTTCTTATTTCTTCTAATCTTTCATCAG
TATATTCTTTTTCTTTTAAAACTATTTCAAAGATTTCTTTTATTTTTCCAGGTGTCATTT
CACAAACCTCCTATAATTTAGAGTAAGCATTACTGATAGTTGTTTTCTGTTAACTTACA
TATAACTACTTTCATAATATATTAAGGGGATTATATAATATAATCCCCTTAAATGTACCT
TAACACAAATTATCTTCAACTTTATCCCTGTTAAAATTTCTATAAATAATTAACTGATAA
CAAAAACATATAAAAAATATAAATATTGATATAAACTCTACTATCATATTTTTATATTCC
CTATTATTAATGTCATTAAATATAACACAAGTAACAACAGAAAATATTACATAACTGCAA
AATAAATTAAGCTGTATCATTATGTTCCTTCATATCATTTGGTAAATAATATTTATATTG
ACCATTTAAAAGCAATTTCATCAAACTCTTCTAATGTAGGTAAACACATAGATTTTATGA
AATTATCCACAATATCTTTTGATATCTCTTTACCTTCTAGTGATCTTTTTTCAATTC
TTTCTAGTATTGTGTTATAGGGGCATAACATAACTATTGCAACTTTGTTGTAATTTTAA
TCAAACTTGATGAATTAACAAAGACTTTCTTGAAGTATTTGTTTTATCAATTACAATAT
CTTTACCTTGTTGTAGTAGTCTATTTAACTTAAATTTAAAGATGTTATCTATTTCTTTTT
GGTCATCTTGAGATAATTTACTCCATATTTCTGAGTATGTATCTAAATTAAATTTTGTTT
TACCATAACTCATCAATATATCATCTCTTGAAATTACATTTTCATATTGATTACACAAAG
TTGATTTTCCAACTCCAGGAACACCTATTAACATTGTTATAGTTGGTTTGTTATATCAA
TAGGTTTTGTTTCATAAGGTTTTAATAATCTTATCTGTTTATATATGTCAGTTGATTTTG
```

FIG. 13D. Continuation of (CJLB-10 [organism=Campylobacter phage CJLB-10] complete genome)

```
GTGTATGAGTTACTCTACCTAATGAATCACACATTGAAAACTTACATAATAATTGCAAAT
CATCATAAGTGAATTTTATTTTTAATTTATCTATATCATATTTATAGATATCATGATAAG
CAACTATTTTTATTATTTTTATTATTTCTTCTTCACTTAAATTAAACTTAGATAAAACAT
CACAAGCATAATATACTCCAACATTTTCATGATTAAGGAATCTTACTTTTACTGTTCCAT
TATCTTTTGTTACTACTTCTCTTGTAAATATCTTACCTAAATCATGTAAGGCTGCACCAA
ACATTAAAACTTTATAATCTTTATCATTTTTAAATAAATCTTCAACCTTATTTAATACCA
TTATTGTGTGATCAATACAGTTTTTTCTAAATGATATGGGTTATCAACAGTTTCAGTTC
CATTTAAACATTTATGTAACATTTCTGAATACATATGATTTATTAATTCTTTTTGTTTA
TCATTCTACTATTCCTTTCAAGCATAAGGGAATTATATCATTAATCCCCTTAAATATAAC
TTAATCACATATAATGTACTATTTTTTCATCTTTTTTATAAGGTGCTGATGTTGGTAAAA
CTATCTCACAACATAAATTACTTTGTGTAACAGTTCTATTTAGCATACCTTGTTTATTTA
CATTATCTGTAAAGAAAATGTAAATATTTCCTGTTTCAACTCTATACTTTAAAATTTCAT
CAAATAACTCTCTAGCATTTATTGATTTTTTCCTAATGTTTGATTTCTGCTCATATTCTA
AATAATATTTTCAAAATCATCACCAAAACTATCCAACAATTTTTGAGTATCTTTTGGAT
CAAATAATGTATAGTTTTCATTATTATACCATCTTTTTACAAATACATCATCTATTTTAA
TAGCATATTGTAAATTTCTTGCTCTAGTTGATTCAGTTCCACCGTTATCTTTTAACATTA
TCAAGTTTTGAACATCCATATGCCATGTTGGGTAATAAACACAGCAACTACCTTTTCTGG
TAGAACCTTGATTCCATGCAGATATTGTAGAATCTAATAATTTTATAAATGGAATAGGTC
CTGATGAAACACCAACACCATCTATAATAGAACCAGTAGCTCTTAAAGCTGAAATATCAC
AAGCAGTACCACCTTTATTCTTACTATATATTGCAAGATTATCATTTGTAGCTAATATTG
AATGTGAATCATCACCCATCTTAGCCAATACACAAGATGACAACTGACCTTTATTAATAC
CAGAGTTTAACATTATAGGTGTAGCGTATGTAAATTTGTGAGTTGAAATTAAATCGTATA
TCCTTTTAATTTTTTCAACTCTGTTATTTTCATTCATACAAATAAACATAGCAACTCTCA
TATAAGTTATTTGAGGTGTTTCTAATTTTATTGTTTTTGTTCTATTTAAACAATACTTTG
TATAAAACATACTAATAGCTTTATAGTTTTGAAACAAATAATCTCTATTATTATCAATAT
ATTTATCTAATTCTTGTATTTCATTTTCTGAAAAATTATTAACAAAGTCACTAGAATATA
TCCCTGATGAAAGACCAAGTCTTAAAACATTACCAAGAGATATTTCATCTCCCATGTTTT
TTCGATATTTAATGATATATAGTTTTGCTGCAAACTTTTCATACATTGGATATAACATAC
TTATTTCATTCACAGTAGTAGATAATATTTCATCATAAAGATCTTGTATTTTAATGTTAT
CTCTTAATTTTATTTTGATTTTGACAAAATATTCATTGCATATGATTCTTTATTATCAC
ACACTTTTAATAAAAATTTATACATTTTATCTGGACTGTATTTTTCAACAGTCCCATTCC
TTTTAACAACATTTATGTTAATATCATCTAATTCTGTAAGTGATTTAACTGGCAACATTT
CCATCTCCATTCAATATTTTTTCTAACTCATTTTCTAATATTTCATCATTATACACTTCT
AACTTTGTATCTTTTTTCATAACACCTTTTGAATAAGTGATGCTATCAACTTCTTGAAGC
ATTTGATTTCACTGCTTATATTTTTTATTTCTTGGAATTCTTTGACTAAGTCTGTTTTT
GGTGCATTCCATATAGGTTGAAAGCCACATTTTTTTAGTCTATCATCAACAAAAAACTTT
AGAAAACCATCAATATTTTCAATAGTCAATCCTGGAATAGGACCCATAGATAGTAAATAT
TTAGCCCATTCTAATTCATCTTGGTAAACTTTTTTTGCTATTTTCTAGCTTTTCGTGAC
AAACTATCATCAAAAAGGTGTGAAAATCCTTGATGTTGCTCACTTCTAAGAGTTTTAATA
ATAAAACTAAAAATTACAAGGTGAATATCTTCATCGTTATTTATTAATTTTATAATTTTA
GTTAAATTTGGTATTTGTTACCACCAGCTGAATATTTATTAATCATATAAGTTGTTAAA
AAACTTACATAAAACTTAACACCTTCTAAAAACTGAATTCTTAAACAAGCTTCTAATATT
TTTAATTTATTTTCATCATTTTCTTCTAAATTGCCTTCTAGTAATTCATAAGTGTCTATT
TCATCATTAATTCTAGTTTTTATTTCAGGATATTCACAATATTCATCAAAAATATCAGTA
GGGTTTGGAAATACGCTTTTTATAAATATGTGAATAAGATCTTGAATGAATATATTCAAA
TAAGCCTGTGTTTTTAAACAACCTTCTAATCCTGATGATGTTACTAGTGGTATTAATATA
TTGTCCAAACCTCTATTTTGGCCAGAATCCATTAATGTTTGAAAAGTTAAATTTGCTTTT
ATTTGTCTTTGATTATGCTCAGGCAATTCTATAAATGACTTTGGTTCATGAATCATACTA
ATTTCTTCTGGAAACCATAATTGTGCTTGTTGTTTTCTATCTAAACTTTCTAATTGATTG
TGTGAATACCAGTCATATCTTTGAAAACCTGAGTATTCTCCAAAGAAAAATTTTTCCTTG
GATCTATCTGTCACTAAATTGGTTTACTCAATAACATATTGTAATATCCTTACTCATTA
ACATCAAAAAACTGTTCAACATATATTAATTATACATGCTATAACTCAATACAATTT
GAAATGAAGTCATACACAATATATGTAATTGAAAGACTTACAACTATATTATATAATTA
GTTGTATATTTGTTGGTAACAAGTAATAAAATACAACAAATTACTATAAATGACCATATA
AGTATATTTGTATATGTTTCAAATACCATTGTAGCATATTCTTTTGGGTTTTCAAGATGT
ATTCCAATTCTATCAAACACTTCAAAAGCAACAGTCAAACTAACAAAATTGATAATAATT
GAGAGTACACAATAACATATAATTGCATAAATTCCTAACTGTTTATTCATTTTCTTTCTC
CTTATAATAAACTATTTTATAATTTATTTTTTATCATCTAAAATAGAAATCATATTCTT
TGAACCTTTTGAAATTCCATCCCAAAAAATAATAGCCATATCTGTTTCTTTGTTTAAACT
ATCGGCCATCAATTTATTTCTTATAGGTCCTGCTGATTTTCCATATAGATTCCAGTTTGG
TTTATATTTTTCTATCTTAAGAGAGTTATCAATACCATATTGATAACCTAACATATCAGC
ACCACGGGCCATACCACATACAATTGTTGATGGTTGTATGTTTAATTCAAGTATTTTATT
TTTCAATAAATTATAATCATTAAAATCTCTGCTACCAGCTACTAATAATTTCATTTGCTA
CTCTTTACCATTGTACCAACACAACTACCATCACTTATTTTGCAAATATATCCACCTTCA
TCTACAAAGAAAAAATCACCACTATATTTCATTCCGTTTTGTCCTTCAATTATAAACTGT
CTATCTATAGTTATAATTTTCTGTAAAGTTTTTAAATTTATAAACTTACATATTAATTCT
```

FIG. 13E. Continuation of (CJLB-10 [organism=Campylobacter phage CJLB-10] complete genome)

```
TTAATTTTCATAAGCATCCTTTTTTATTTATATTATATAATATTTTAACTTAGATTATCC
TTAACCCAAACACCTTGCCCACAATCCCATACTTTATGATACCCATTTACTTCCATATTC
TCTGATTCAGTCAAGTTTGGATTAAACTTCTCTAGTTTATCTTTAAGCTTATGTTTCATA
AATTGTTGTCTTGAATATGTTCTATTATTCTTAAAATAAAAATAACCTGGTTTTGAGTAG
TGACTAAATGTAAATCCTAGCTTTTTGTATATCTCACCATTTGAATAAAGTCTATCAGAG
TAACTAATAAGACTTCCTTTATTATGTCTATGGAAGTAACTAAGTAATTTAGAAGCACCA
CCTATTACATTTAGTCCCATTTTTGTGCATAATCTTATTAATTCCCAGTCATATTTATTA
GTGAATCTTGGCTTACCAAAACTCATTAAACAAACTAGCTCATCTTTGTAATACAGCCCA
TAACAGATAGAACTACCAGTGAAGCCTTGGAGATGATTTTTGTTTAGAAACTCTTTCTCT
TCTGTTTTAGGTACTTCTTTAATAACACATTTCCTAGCCATTATTTTCTCAGACTTTCCT
AATTTGTTGTTATAATACTAGTCCATATTTCTTTATTGCTGTACCATGAATGTTCAAAA
ATGTGTAGAAGATGAATACCTTTATTCTCACATTTTAGTGTTTTATCCAAATGATAGTCT
TTACCTTTTCCATTACTTTCAGAATGCCAGTAGTCTCCATTACATTCTATGGCTAAGTTA
TGGTCTGGTAAATAGAAGTCAAGTTCTCTATTACCCAAAACAGAATAATCATTTTCTATA
TAGTCATCTAGTAATTCAGATATTTCTTTTTCAAATGAGCTAGTAGAAGGGTTGCATATA
GGACATGTTATTTTACCTTGTTTAAAGTTACCATAAGTTCTATTAAAAACATGTCCTTGT
ATACATCTTACTTTTAATTCATCAGCTAAATTATTAGAAATTATTTCATATCCTAGATTG
TTTATATAATTTATTTTACTAGTATCTTTACATTTGGACAAGTTGTAAAGCCATCTTTG
AACTTCCCAAATGCTCTTTTAAAAACATGTCCATTTGAGCATCTTACTTCTAATCCCTTA
GATAGATTTCTGAAACAACCTCATATCCCAAATTATTTAAATAATCTAATTTATTTCGA
ATATCACATTTAGGACAATTAATTTTGCCATTTTTAAAATCACCAAATGCTCTTTTAAAA
ATATGACCTTTTGGGCATTCTACATGTAAACTATCTGCTAAGTTCTCTGAAACCGCTTTA
TAACCTAAATTATTTAAATAGTTTAATTTTCCTAGTCTATCACATTCAGGACAATTTACA
GAACCTCTTTTAAAATCATCAAACATTCTTCCAAAAATATGGCCATGTTTACATTCAACT
TTTAAACTTTTGGATAAGTTTTCAGAAATAGCTTTATATCCTAAATTATTTAAAAATATT
ATTTTTTCGTGGTTAGTCATGTGTGTTCCCCATATTAATGTTTAGGGGGATATACCCTAA
ACATTATTTCGGTAGTTTCGTTATTAGGTGTAATATTCAGTAAAGAGTATTTATATTCT
AGAGCATCTACAAAATCTTTATTAGAGAGTAGCTCACTAAAGAACTCATCAAGCTGCTCT
TGTGATGCACTTTTTAAATACAACTTTTTCTCTGTAAATGGATTAAAATGACTATCACCT
TGTTTTTGTAGGAATCCAAGTTCTAATCCTAGATCAGCCAAACCTGACCATTTATTTATA
CCGTTATCAAAAGTAACTAAAATAGGTATTTTTGATTTTTCTTTGATGAATCTTGATTTT
TCAACATTTATTGTAAATTGCCAACCTTGTAAATTCTTTTACTATCTTTTTCTTGTGCT
TTTCCAACAATAAAAATAGTATCAGCACTATAAATCACCCCAGTGCCACCGGATACCACT
TGACCACCCCACAAAGATCCAATATCATCATAAGTATGATTTACAACAACCATAGGGATC
TGTTTCATAGACAAATAAGGTGTTACAATTCAAACAAACTCTTGATATGTTTGCTTCTT
TGCATATCTACAACTGATTTTTCATTTATAGCATTTTCTATTTCAGCTTTACTTGCTAAG
TTTCCTAAGCTATCTAGAATTATTATAACTCTATCACCATCTTCGATATTTCTAATTGA
TTTGCAATATCAAATTTTAATTCCTCAACATTCATAACTGGTGTATGGATAACTCTTGTT
GTATCAATACCAAAGTTTTCCATATAGTTTGGAGTGATACCAAATTCAGAATCATAAAAA
ATACATACAGCATCAGGATATTTTTGCAAATATGAAGCCATCATTACAAGTGCATAATTA
CTTTTAAAATGTTTGCTAGGACCTGCAATTACTGTTAGTCCTGGTGTTAGCCCACCATTA
ATTTTACCACTTAATGCAAGATTAACATTGGTACTGGTGTTTCAACAAATTCAGTTTTA
CCAAAATATTTACTATCTTCAAGTTTATTAGTTCTATCTTTTAGAGTGCTATTTTTAAT
AATTTATTAATTAATGACATTTTATAATCCTTTCTAAATTTAAGAATATTATATTACAAA
TATTCTTAAATATTACTTAACTTGTGAATTAAACTTCTCTATTGAGTTATAAAGATTATT
ATAGTTAAATTCAAGATGTTTATATTGATTGTGTATAAGTATAAAATCATTTGGAGATAT
TAACAGATATTCTTTACCATTAATTTCTTGTTTCATGATTTTAACACCTATTTTATGAGG
AATGTATTTTTCATCAAGAGGATATTTAAATACTCTTTTTCAGTAACTGTTATTGTTTT
GGTTGCTGTTGAACAGCCAACAAACATAAATGTACTAAAAATTAACAATAATATACTGTG
TTTCATTCTCATCCTTTCTAATAAGCTTTAATTTTTGTATTTTAGTCTCAACATTTTTTA
TGTTATTAAGAACTTCCTTATATTTTACTTCTTTTTCTCTAAAAACCTCAATAGTAAGAT
TATTATAGTTTTTAAGCGCTTCTAATTCCTTTTAGAATTTTTTATATTTTGTGTTAATT
GTTTTTCATTTTCAATCAATATAGCATTTGATTTTTCTAATGAAATATATCTATAAGCAG
TAAAAGCTAACAAAGATCCTAACAAAATATAAATTATGTTTGACTTTATAAATGAAAATA
AAAAATTAAACATTTATCTAATTTTTTAATTAAATTTATTTATTTTAATTAGATTTTTA
TAGATCCTTTTTAAATTATTTATATTTAACTTTATCGTTTTTAAATATATAATAATTTT
TTTCATAGATTCAACTAAAAATTTTGAGTATATCATACTTATATCCTTTTTTCAATTATT
TATATTTATGTCGTATTTTATAAGAGCAGCTACTAAAGCACTTAGACATAATTCTCTAT
CTCTACTTGTCCTATCATGATCACTATAATGTTCTATAAGCATTACAGCCTGTGGTATGC
TTTCTAACTCAAAAAATTTATCAACATTTTTAAACAAATACTGGTAAAAACCACTATAAC
TTACTGTTTGTGCTATAATTTTTCTAGCTTCAGTATAATCTTTTTTCTTTAAAGCTTCGA
CTAAATTGGAATAATTATTAATATTTTCAAATACTTTTTCATCTATTACTAATTTATTAT
TAACAGTATTATGCTGCATAACTATTAACATCTCTAATACATGGATAAAAACATTGAA
TAAGTTTCTGTAAATCTTTCTTATCATATTCTACTTTTTCATTTTGTAATATAAATTCCA
ACCTATCAAGTATTTTAACACCCTAGTTCAGTTTATTATCATTAAACTCTTTATCAAAGT
CTATACATGTAACACGAGTCAAAATAGGTTCTATTAGTCTATCAGTATAATTTGCTGTTA
```

FIG. 13F. Continuation of (CJLB-10 [organism=Campylobacter phage CJLB-10] complete genome)

```
ATATAAATCTACAATTTTGGGTATATTCATCTATTATATCACGGATTGAGCGTTGTAATT
CATTTGTCATCCCATCACATTCTGATAAAGATATAATTTTTAATGAACCATCTATTGAAA
CACTGCTTGCAAATGATGTAATTTTATTTCTAGCAAGATCCACTCCACTCTCTTTTGATG
AGTTAATGAATAAATGAGTTGCACCTAATTCATCACATATTGCTTTGTTTAATGAAGTTT
TTCCAGTTCCAGGTGTGTTACTAAAAAAACCAAGGTTTGGTATTTCACCAGAATTAATCC
ATTCTTTTATTTTTGAATGAAGTTGGTCTGGTAGAATCATATCATCTACTCTAGACGGTC
TATATTTTTCAGCCCATATATATTCTTTTTCGTTTATATTTTTCAAATCAATCCCTTCCT
TTTTTCTGTATTATATATTAACTATACTTAAAATTACCTTAATCTATAATACTTCGCCTT
CAATTTGTTTAAATACAGTTTTTATGTAATCTTTTGATTCATCTGTAAACTTTAAAAACT
TAAAAACATTCAAAATACTTTCACATATAATAGTATTGTTTATACCATTAAAATCTTTAA
TATTATATAACATTAGATACCAATACACAGTAACGAAAGATATTTGTTTTTATTATATT
CACGCATTACTTCTTTAAACATCGGTTTTTTGTATTTCTCTTCTAATAATGTTATGTCTT
TTTTTATTATATTTTTATAGAATTTTATTGTGTTTTAAACTTCTCATATTCTGTTTTAT
TGTAATTTCTTAAATAATCACATAAACCATAAATACTAGATGGACTGTATTTAAACATTA
TATATACACACAATAAATGAAGTCACCTCTATCAGAAAAGTTTAACGGATAAAAACCTA
TTTTTTATCCATTATATCTTTGCTATGAGATACACATAATAAGTTTTCTTTTAAGTTTT
TTTGAAATGTAAGAAACACTCCATTAGAAATATTATAAAATATCATAATAGTGCAATTTCA
TGCAGTGTTCCTTACTCCCATATATCTATGTTATATATCTATGTTGCTTTGGTTTGAATC
ATATCTTGTAAATTTGAATTTTTTTAAGTCTTTCTCAACAATATCCCTGAATATTGCATA
GTCAGACAATTCTGATGCTATTAATTCAGGCTCCATATTAATATGATTTCCAAATTCAAT
TATAACATCTAAAATACAATCATCCATCATATCTTTTTGTTTTCTAAACTCAAAGAGCTT
ATTAAAAAGCTCTGTTTTACTTTCCACTACTGCCCCATCCACCGTTATTACCTCTAACTA
AATTTTTTGTAATGTTATCAAAATCATCTTTTGATATGTTTTCTATTTTACTTTCATTAC
ATTTTAATAACTCAAACTGACAATACTTATCACCTTTTTTTATAGTGTATGGTTCCTTAC
CAAAATTATACACTTTTTACTTTTAAATTCCCACTCCAAGAAGCATCTAATATACCAGGAT
AAACAAATAAATCTTTTATAAATCCTAGACTACTTCTAGTGTTAAATCTTATATAATATC
CATCTGGAATTATTAATCTAACACCATTTTCAACATACTCAAACCCACCAGGTTGAATTG
TTTTATCTTCTATTGAAAACATATCGTAACAAGCAGAGCCCATTACTGATATTTCTGGTA
ATTTTGCATTACTGTCTTCTAGCCATGTTTTAATACACACATATTTTTATCCTATTAAT
TAAAAGTAATGATTCATCATCAAAATCATATATTTCTACAAAATTATCAATTAGGTCAAG
TAATACATTAATACTTATTTTAAAAGATATTTCAAGTAATGATTGTGGGTTTTTGTTTAT
TATATTTTCTAAATTATCCTTCATAAGTACTGACAAAACAGTCCCATAACATGGTAGTTT
TGTATCATCATCTAATTTAACAGATATACAGTTCAATTTTATTTTTTATTTTCTATACT
TTTACTTTCTCTAACATTTTCTTTTAATAATTCATAAGTATGAGAAAAGTTTTCACTAAT
CAACAATATTGGGTTTAATTTCACCAACTCTTCAACCATATTTAAAATTTCTATATTTTT
CATTTTTACCTCTTTCAATTTAATAATGCATGAATGCCTGTTACAGCAGCTGGAATAATA
CCTCTTGTAATAGCTGAATCACCTACAAAAAAGATATTTTTGCTAAAATCCTGTACTGTA
AAATTATTATAACTAACTCTAGGACCTATTATTTTTCTGGAAAATATCCTTTC
CATTCCTTTATATGTAGTATATCACAAAGTTCCTTAATAAATTCTGAAAGTGAGTCACCT
AAGTTATCAAAACAATTTAAAAACTCTAAAGATGAGTTCTGATTTAATTCATAAATTTTA
CCATTAGTAATGGTTTCTATTTGTGATAAATAATCTTCTACATTTACATTTTTAAAAGAA
CCTAAAATAGCCCAGTTAGATTTTCCCGTCCATTTGTCTTTTACATGTAATCCATAAGCG
TGTCCATTTGCTTGTTCTCTAATAGGAATAGAATATCCTTTTACTTTTTCTGTTACAACT
TCTGCTGTTCCATGATTAACACAAAATGTTCTCAACTCTTTAAGATGATTTTTGTTAATA
TTCTTAGAGAACTTAAAATCATATTGAATATTATTTGCTAACTCTTGAATTGTATTATTA
TATTCCACACTCAAACCTAAATCCTATATGAATTTGGTCAGCAACGGATTTAATGTTGTTT
AATTCAAAGGTTTCTTTAATATCTTTCATGCCACTTCTACCAAGACCTATAAAAAGTTTA
TCATAAGTTATATATGATTCAATACCATTTGTATCTCTTACTGTTATACATTTATCAAGT
TTTGAAGGAATATATGTAGAGTTACAATAAATTGTAACACCTTTACTTTCAAGCCATTTT
ATCATGTTTTTACACATTTCAAGCCCCAAAGTTGAACCTATATGATAACACTCAGATTGT
TTTAAAGCTATATTACCATAACCACTTACAAACTTTGATCCTGTTTCAACTGGTTGTGTT
ATGTGTATAGAAGCATTTTCTGGTAAGAACATTTTAAATAGTTTATTTTTAAAAAATCA
TAATATTCTAAAACTTGTTGCTTATTAATGTACTCAAATATAGGTTGATCATCATGTAGT
GAAAATATATTTTTATTATCACTAAATGCACCACCACCTAGAAGACCATTTACAATATCT
ATTGTAGGTATCCTATCATTAATATGTTTCCCTTTTTCAATAACAATTACTTCATCATGT
TTCATATTAATAATATTATTCATAATACCATAACAAATAGTGTATATATTTGCTACACCA
CCACCTATAAATACATATTTCATATAACCTTCCTTAATTTTAGTTATTATATAATAATTT
ATGTTAAGAAAAACCTTTAACTAAAGGTTTTCTTAGTCAAATCATAATTACCATGCAACA
AATAATCAAAATAGAAAATATTTTCTTTAACTCTGATTTATTATCATCTTTACTGCCAA
GTCTTGAAACATACTTTACTATGTTACCTTCACAAAAATTCAAATTATTTTATATATAA
AATCAATGGGTTCTATTGCCAGTTTAGTATAATGCTCAGGTATTACCTCTTCTTTATCGC
TGTGTTTATATGATGATGCTTTATAATACTCTTGTTTAATAGCTTTAAATACATCCATAT
ACTCGGGATCTTGTATAGCAACAACATTTTTATTGTTTATGTAGCTAAGTTGTGTTATTA
AGTATATCTGAAACTTATTAAAATTATTACTATTACAATACTGTTCAAAACTATAACTCA
TTTTTTATCCTAATATTAATTTACTATTATTTGATTGCTTACTAATAGCATCTTTTATAA
TAGTTTCCAATTCTGTTAGATTTTCTACTATTTTCTGAGTATCAATATCAGATAATACTA
```

FIG. 13G. Continuation of (CJLB-10 [organism=Campylobacter phage CJLB-10] complete genome)

```
ACTCTCCAACATAAGACTGTAGTATTTCATTAATATCATTAATTTTATTTTTTATAGTCA
TTACTAACTCCTTTTATTATATTTGATATTATACAACATTTAATCTTAAGATTATCTTAG
TTATATATTATTTTAATATTTTTTATATACATGCTAATACATACTGGGCTAAATCTAAC
CCACTTTTATTTAAGTATTTGTCATACCCCCTTCCCTTGTAATAATGTAATATTTCTAAG
TCATCACTAGTTTTATATTTTTGCTTAATATAATTTATTATAATAGCAGTAGCTTCTATT
TGATTTTTTAACGAGTTTATATGTTTTATATTATGTTTGGCTAATACCATCTTCCACATT
TTGTAATTTATTCCACTTATTCCCTTAACATTATTATGTTTATGTTTTACTTTATATTTG
AAGTATGATTCTGATTGTATTAACGACATTATAAAAACTGGATTTAGATTGTATTTTAAA
GATACTTCAAATATGTAGTTTGTTATTTCAGTAGCGTTTTTGTTATTATATTTTGAAATG
TGGTTTATCATATTTTGTTTTAAATATGATAACCTTTCTTGAATAATATCTTCAAAATTA
TATTTAGCATGAAAAATAACTGATTGTGATGTTGTTGTAAATACAATGCATAAAAAAATA
ACAATATATGTTAGCTTTTTCATTATAGCTTTTTCAATATTTTAATAATATTGTTTTAGT
AGTTTTTCACACCCCTTAAACTTTAGCTTTCTTTGTTTTGGATTCCTACAATAAATAGTG
ATTTTCAATCTTTTTTCCAATGCTTTTTTGTATTTTTTATAGCTCTTTCTGGTATCTCA
TCTAATGATATACTATCCCACATGTTATCACACATTTTTGCTTCTACTGAAATATATAAA
CTTGTGATATATCTTCTAAAGTCACCAATTTTTAAACACAAACTATTTGCTAATGCATAA
AATAATGGTCCTTTCTTGGAGTCCATTTTGCAGCTAACTGGTGTTTTTTAATCTCAACTCT
TTTGAATAAAATGCCAATATTTTTTCTTTGTTAGAATTACTTGCAACTTTGTACATCTCA
TTTAAATCTTTAAAACAGCCATATTTTACAACAGATGTTAAAAACATGTCATTAATATTA
TTTGTTTTTTCAGCGATATATTTTAGAAGTAAAATTGAATTCTTTATATTTCCTCCATTT
ACATCTCTGGCCCATAATAAAATCTGCATTGCTTGTTTTTATCTTCCTGTTTGGCATAT
TTGAATAATTTTATAAGATAATTAATATCTTTTGAGTAAAATAACGCTTTTGCAAAATTT
TTACAATTAAATTTCATATCATTCCTTTTATACTTAAAGAACACCAGGTTAAGAATATCT
GAAGATTGAAAGGAGGGACCTATTTCAGGTCTGCGTATTAACCTTATGTGTTCTATATTA
TTACTCAGGCTATGATCTCTTTAAAAGTAAAGAGAAAATTAACATAATAAGCTTACCATA
ACCTTGATATATTCATTAATAAAATGAATATATCAAGATTATGATGCAATCATAATCTTT
CAAATAATTTATTTATATCATCCAACCAAATATCTTTAACGTGTTTTTGTGATAACTCAT
TAAAACTTTGTTGCAAACCACTCAACTGTTCATTCAAACTATTTATGCTCTCTTCACTTA
ATGAATATAAAGGCATATTTATAAGTGTATCAATATTATCAACTATACCTATATTATTTA
TTTGTTTGATAAATATCCTCTTTTTTCTTTCTTTCAAATATAACCTTTTTATCCAAAACTG
CTTTGATGAATTTTATTTTATTATTAATTAGTTCAATTTGGTCTGAATATTTAGATAATT
TATGTTGTTTCTCTTTTGTATATACTCTAATTTAACATCTATATATTCTTTTAAAATCC
CAATCTCATCTTTATAGGTTTTAATGAAATTGTTTCTATCAGCACAAGTAAAGTTTTCGG
TATCAGTTGTTTCTATCCCTAATAATTTATGAATATTTGATTATTCCAAAAATCTCCAC
TTACATTTATTACATATTCAAAATTGTCACCTAATGAGTAGTCTTTATAATCTTTTATTA
TTTTTTTCTCTTTTAGTGAGTTAAAATGTATTAACATACTCTCATTAGTAGCATAAGGTG
TTGTTTCTGTTATTTTAAATTATAAGTGTCTATTTTTTCATAAACACCTTTAAATTTCC
ATTGTTTTTTACCATGTTCTGTATTAAGTAATTCAACAGTACCCTTATAACCTTTAAAT
ATGGGACCAGTGGTTTTGGTTGTTTGTTATCTAAAATGTCTTTAATAGCTTGTTTAACAT
CTTCAGCACTTCTTTGCATTATATTTTGGGCAAAACCCACACCCATACCGTTATTGTTAA
TTAATAATATTAATGGTAAAGTAGGTAATAGAAACTTTGGTTCTATTTTTTGTCCTTCAA
AATACTGATGATCTAAAATCTCTTCATCGTCTTTATTGAATAAAAGATCATAATAATCTG
ATTTTTTATAGAAGAATATCTTGGTTGAGCTGATGTTGGTGAAGTCCTACATCCTATAG
CTGATAATGGTTTAAATAATGGTAATGTAACAGGACCACAATCAAAATCTCTTGCAAAAT
TTGTAATTATATCAGGTAAAATATCTTCATTATGCAAATATTGTGATTTAGATGCTATTT
CTGACTTTAATGTTGAAACTTTTTATAATTAGCCAAGTCTTTACTAAAATAAACTATTT
TACGACCTGAATTTTTAAATCCATCAATTAAACTTGCTATACTTCTAATGTTATCATATG
AAGCATATTGACATAAATTATCATTAAATAATGTATTAATATTCATTTCTATCCTTTCAT
TTTATATATTATATAACATTTTAACTTAAAATTTCCTTAACCCAAACACCTTGACCGCAG
TCCCATACTCTATGATATCCATTTTCCACCATGTTTCATATTCTGTCTTATTTGGATCA
AATATTTCTAGTTTATCTTTTAACAAATGTTTCATAAATTGCTGTCTGCTATAACGAGTA
TTATTCTTAAAATAGAAATAACCTGGTTTAGAATAATGACAAATGTAAATCCAAGCTTC
AAATATATACTTCCATCAGAATAAAGTCTATCTGAGTAACTTATTAATGACCCTGGGTTA
TGTTTATGAAAATATTTAAATAATTTAGAAGCACCACCTATAACATTTGTGTTCTTCTTA
GTACATAATCTAATTAACTCCCAGTCATACTTATCTGTAAATCTAGGTTTTCCAAAAGAC
ATTAGACAAACTAACTCATCTTGATAATAGAGTCCATAACAGATAGAACTACCAGTAAAT
CCTTGGAGATGATTACTTTCTAAAAATTCTTTTTCTTCTGCTTTAGATACTTGTTTTAGG
ATACATTTCTAGCCATTATTTTATTAGATTTTCCTAATTTATTGTTTATAATTGACTTC
CATATGTTTTCTTTTCATTCCATGATGATTCAAAAAATAGAATAAGCTGAATATTTTTC
TCAACACATTGTTCTGTTTTAGTTAGATGATATTTCTTATCTTTATTCATTGATTCACTA
TGCCAAAAATCACCATTACATTCTATTGCTAAGTTGTATTCTGGTAAATAAATATCTAAT
TCTTTTCCATTCAATATTTCCCAATTATTAGTTCCACCTGTTAATTCCCTAACTTCTTGC
TCGAATGTACTATAATTTGGATAACAAAATGGGCACAAATGATGACCTTTTGAAAAATTG
CCAAATGTCCTTTTAAACACATGACCTTGTTGGCATTTACTTCTAAATTATCCGCTAAG
TTATCAGACATAATTGTAAACCCTAGACTGTTTAAATAAGCATGTTTATTTCTGCTTCA
CATATAGGACAGAATTGCTGTCCATTTTTAAAGCTGTTAAATGTTCTTTTAAATATATGT
```

FIG. 13H. Continuation of (CJLB-10 [organism=Campylobacter phage CJLB-10] complete genome)

```
CCTTTTCGGCATTTTATTTCTAAGTCATTAGTTAGATTATTAGATAATATTTCAAAACCC
AAATTGTTAATAAAACTATGTTTATTATTTATTTCACATATAGGGCAACTAGTGTGGCCA
TTTTTAAAACTCTTATATGGACGCTTAAAAATATGACCTTTCTCACATTTTACTTCTAAG
TTAGTGCCTAAATTATTAGACATAATCTCGAAGCCTAATTCTTTTAAGAAATCATATTTT
TCTTTTTTCTCACATTCAGGGCAACTTGAAATACCATCTTTAAAACTCCCAAATGTTCTT
TTGAAAATATGCCCTTTTTGACATTTTACTTCTAGTTTTTTTCCTAAATTTTCAGATATA
GGTTCAAAACCTAAACTGTTTAAAAAAGTTATTTTTTGTCCTATTTCACATGTAGGGCAT
GCTGTATATCCTTTTTGAAAATCATAAAATTCTCGCTTAAACACATGCTCTTTAGAACAT
TTTACTACTAAATTAGTAGTTAGATTTTCAGATATTACTTGAAAGCCTAGAGTATGTAAA
TACTCTATTTTCTCTTGGTTTGTCATACTGAAGGCCTATAAGTTTTCAATATTAAATGAT
TTTGTACTTAATGTTTGTTTTCTAAAATCAATGCCATTGTCTGACATCCACTGCTCTAAA
ACTTTTTCATCATTATCTTTCCACTCAATTTTTTCTAAGCAATTGTCTATACCATCTTTT
GCAAAACAATATTATAATTAGCTGCAGACCAACTTCCTAATCCTTTCATGTATATAACT
TCAGCATTTTTAGGTAAATTTTTTGCATCTGCTTGATATTCACCTAATGTATAATACCAT
CTAATTAACTTATCATTTTGTAACACTGAGATAATAGGTGTTTTTAATCTATACACTCTA
CCTTCTGTTAGTAAGTTTGGCTGTAATTTGTAAACTAGTGCTGTAATTAAACATGCAATA
TGGTTTCCATCCAAATCAGCATCGGTAGCTATTACCATGTTTTCATATTTTGTTTCAGGT
AACCCTAAGCCCATAGCTTCTACAATATCCATAACTCTTTGATTTTTAATAATTGTGCT
GTAGAACATTTTAAAGCATTTTGTAATTTACCTGTTAAAGGTAAGAAACTACTACAATCT
CTACCTATTGCTTGTATTAAAGAAGAAAGTGCGCTATCTCCTTCCGCTATATACATAAAT
TTAGGATCTTTAGTATGTTTAGTAAATTTAGGATTAAATCTTTCTTTAGCTTCTTTTCTT
TCAAAAGTATTTTGTTTCTATTTTCTAATTCTTGTTGAACTTTATATAACTCAATTATT
GGGTCTTTAATGTGTGTATTTTTGAATAATAGTTCAGCAAAATCAGTATATTTAGTGTA
GGTATTCCTAATTCAGTTATAGTATTCTTAATTTCTTCTTTTGTTTGGCCTCCACCAAAT
CTTAAATTCTTTTTATTTTTAAGAATCAGAATGACACCTATCCTGCTTTTTACAGCTGTA
TTTGTAATTTTGGAGTATCCCTTTCTTAAACGATTACCAAAAGCATTTACAATGTTATTT
GAAATATAATCTAATGCTACCCCACCTTTATTTAAATCAAGTGAATTACAATATGCACA
AACTTATACTCATCAGTAGGAAATATAGCAAGTTCTAAGTTTTCATCACTTTGCAATATT
GAGAAACTATCAGAGTAATATTTTATAAATTCTTTAAACTCTTTTACTTTAATTAGTTTT
CCCTGAAATGTAAATTCTATACCAGGATTTGAATAAGCTATGTTTATAAGTAACGCATGT
ATATGATTTATTAAGTCATCATTGATTTCTTTTAATTCTAGCCTTTCAAAATCTGGTTTA
AACTTAATTGTAACACCATGTGTTGATGAAGCAGGCGCTTTGTCTTCTTTATGCTCTATT
GTAGACATATTGTTTAAACATTTTACAATACCTCTATCCCCTTCAAGAGTAATTGTTGTT
AATTGATACTCAGAACTAAATAATGGTATTAATTTAGAACCTATACCATGCGCACCTATT
GTGATTCTGTCTTTTTTTCTTTTCTAAAAAGGTATAGTTACTTGATGTTCTAAACTTG
GTAGTTGCCATAACATAAGTATCTATTGGTAATCCTCTACCATTGTCTGATATTGTTATT
ATACCGTTATCTTTGTCAATCTTTAATGATATTTTATTAGCGTATTTCCATCAGTTCTA
GTAAATTCATCGATTGAATTTTGAATAGCTTCATCTATTTGTTTTGTTAATGTTTGATTA
TACACTATTTCTTTATTAACAATTTTGTTATTTTCTAAGACTTTAACTGTATTATTAAAT
GATGTTAATGAACCTGTTATAAGGTGAGGCAGGTTTAAATAATATAATATTTCATTATCC
ATATATACAATTTTATTGTCTGTCATTATTCTACACTCCTTTATTTATTAGTTAAATTAT
ATAACAATACTCCTTAAAGCGGGCTTAACTAATTTTATTTGTCCACAATCCCATATTTTA
AAACATCCAGCTGGATCCTGTGAAACTTTAGTTTTAGTTTTTACATAAATAGGACTTGGT
TCTAAATATTCAACAATCTCAAATCCTAATTTATTATATGTACTAACACTTTCATATGAT
CTATCCACATAAGTAACTATATCATATTCTTTTTTAAGGTTCTCTAAAATATATTCAGCA
CCACCAACAACTTCTATATTTAATTTTGAACACATTCTTATTAACAGATATTCTTTACCA
TTATTCAAAAAGACATTGCAAACATTAATTCATTCTTATGGTATAAACCATAACATATT
GAGCTATTTGTATAGTACCATAAATATTCAAATATATGGATTAGTCTTATATTTTGCTT
TCACACTCTAATGTTTTATCCAAATGATAATTTTTATCTTTACCCATTTGCTCAGAATGC
CAGTAATCTCCATTACATTCTATAGCAATTTATGGTTTGGGACATAAAAATCCAATTCTT
TATCACCCAAAACTGAATAATATGTTCTCCTGGATATGTGACCATTTTTGCACATGAGTT
CTAATTCTTCTGATTTTTTATTTTGTTATTTTTTTTCAACTGGTAAGTTATACC
ATTTTTAAAACGTGCATATACTCTTTTAAACGTATGTCCATTTTTACATTCTACTTCTAA
ATTGTCACCCAAAGTGTATGATATAATTTTATAACCTAAAGATTACTAAATAGTCTTTTA
AAAATGTGCCCATTTTTACACATGAGTTCTAATTAACAACATTGTACCCAAGTGATTGTA
TATATTCTATTTTATTATGAGTTTCACACTTACATTTCACTATCAACCCTTTAGATAAGT
TTTCTGAAATAACTTCATAACCAAGATTATTTAAAAAGATATTTTTCTTCCCTTTCAC
ATGCAGGACAGTGTATAGTCCCTCGCTTAAAATAATATGTTTATTAGGACATTCAACTAT
GTTTGCCGAAGCATCTATAAGCCTATATCCTAGGTTTTTAGAAACTCCGACTTTTCCAT
AATAAATCTCTAAATTAACCCTATCTTTTTATTGTTTATATTTTTCATATGTGATATGTCA
TTTTCTTTTAGATAATTTTTAAAATTATTTTTACAAGCAATGTTATATTTTTCTCCTTCT
ATAATATTACTTAAATTACACTGAAGAATGTTATCATTTATTAATTTGTTGAATGATTTT
TTAGGTAAACCATTGTTTTCCCATATTTTCAAGGCTTCTTTTTTAGTCAATGTTCTTAGG
TTTAATATATCAAATGTTCTACCTGCTCTTAATAATGCTGGATCAATCTCATTAATGTTT
CTATTTGTTGTAATTATAAACTTTGTTTTACATGTAATATCATTATTTATACCTTCAGTA
AATGATAAAAAGTGTGACATAAATTGATTTCGTTGTGCATCTATACCATTTTGAATATCA
```

FIG. 13I. Continuation of (CJLB-10 [organism=Campylobacter phage CJLB-10] complete genome)

```
GATCTAGGCAATAGATAATCTAAATCATCAAATAATACTAAATTGTACCTATTTGCTAAT
AACTCATTCCAGAACGCATCACCAGCTAATAAACTCTCATTCTTTACAACTGCAACATTT
ATACAGTTACTATCATCATCTGACTTATCAAATACTTTCTCTTCTAATTCAAGATGTTTA
TATTTCTTATAATCCAAATTTAACAAAAAATTTAAATAACATTCTGCAAGTTTTGTTTTC
CCTGTTCCAGGTTGGCCATATAATATTAAATATTGCTATTTGCAAATAGAAACTGTATA
AACATTTCATTTAAATCTAGAAAAGGGTAATAATCATAATCAATATTTTTATAATTATCT
TTAGTTTTAGATGAATCTACATATACTAATTCCCCTTTTTCTTCATAGAAACTCTTTATT
TTGATTAATAACTCATCAGTACCAGTAATATATTTCTTTAAAATATTGTTATAGAATCCT
TTTAAAAAATCTATACTGTTTGAATACATATCTAACTGAACACTTTTACCTATTCTATAA
GTTATTTCAATGTATATGTTAGATAACCTAAAAACAAATATATTTTTATCACCTTCAATA
CCATCCCATTCATAATAAGAAGTTTTTAAAAATGTTTTTATTTCATCTAATAATTCATCT
AATTTATCAACTGGGATTTTTATATTTTCTAACTGTTCATTATAATTATCACATATAAAC
TTGCTTTTCAAAGCAAATCCAGGTTTTGGTGTTCCAAATGCATTATCTGAAATTACATGT
TTAATACTCATACAATTCTCCTTTTTTAGAGAATTGTATTACTTAATTCCTTAAAAATAT
CTTAGTTAGTATAATATATTTTCATTATGTATCTCACAAAATCTTCTTAAAGCCTGTTTA
CATACCAGTCACCATCATCTTCTTCAATATGCTGTATAATTTTTCTAGAGTCCATTATAT
CCAACTCTTCAAACATCCTCCAAGCTGTTTCTGCATCTATACCATGCAATTTCTTTTACT
TCAGAAATAAAATCATCAAAATCCATGTCAGCTTCATTCAATTTAGTACTACTTTTTTTC
CTTTTTATTTTTATTTTATTTTAAATTTAATTCCTTAAAAATATCTTAGTTATTATAATA
TTTTAAGCTTTCAACTAATACTTCATGAAACACATTTAAATCTTCATATGTAATTAGCAT
ATTAATTTCTTTTATAAAGTCTTCCAAACTTGTAATTGGTTCAACATCAAACTCAAAATC
ATGACTATGTTCAATATTATACTCTTGAATTATTTGCAATGTTTCATTAATAGCTTCTAT
TTCATGTCCTTTTGCAAATTGAGCTAAACCGTTTATAGTTATATCTTTTATTAACTGTTT
GTCCATTGTATATCCTTCTTTCTAATAAATATTTTAAAATATTTATTAGAAAGGTTTATA
ATGACTTTTGTTGAAAAAAATATGATTAAAGAACTCAAGAAAACCATATCAGCAAAAAAA
CCATTAGTTTTATGTTTTATGTCAAAATTACTACAAAAAGAAATACAAAAACTCTTAAAA
GGTAATAAACTTATAACTATTATAAAAATTATATTATATGCTTTTGATAAAACACCTGTT
GAAGTAAAAGAGGGGTTTTAGGATATGTTGAAAATGAAAAAAATATTCCATTTCAGTAT
AAATATGATAATATAACAAAAACACTAACATTTTCATTAAATAAAAAATCATATTATTTT
AATTTATGCACTGCTAATGAATATATTAAAGTCTTAGCAAATGAAACTAATTGGATGATT
TTAAAGAAGAATTTAAATAATGCATTAAAAAATATAAATAGGATATATCCTACTTTTAT
TAATATTCTACTGTAACAACATCATTTTTATATACTGACATTTCATTTGTAAATGTTATT
TTTGTTAAAGTACTATCATGTGTATAATTTGTTGTTGGAATAAGGTTTCCATTAACATAT
ACTTTTGAAGGTTTTAATGAAAGAGAATTATCGGAAACTTCTGTAACTGGAGTATTATAA
TCACTTGAACTAACAGTTATATTAACAGAAGATGATATAGAACCTCCACTTATTTTTTTC
CATTTTGATGGACTTGTATCTGGTTGATTCCCTCTATTTCCATCTGATAAAGAAACATAT
ATAGAATTGTTATATTTTACTATTTGATTTTGTGTATATGTTGTGCCTGTATCCCAATTT
GATGGATCAGTAATACCAATAATTGAATTCACTTGAGACATAACAGTATCAAGTTCCCTT
TTTAATTGTAAACTAGGTTTCCCTAGGACATCTTGATCTGCAATTTCACCATTTTTAGGG
CATAACTTTTCAAATTCTGTATAGTTTGTAATAGCCATTTATAAAATCTCCATTTTATTT
TTATTTATATTTAATAGCTTATTTGTGGTGGAAAAGGATCAAATAAAAATGTTACATCAA
ATGTTGCCAAACCATTACTATTTTGATCAAGTGATAATCCACCATGACTTCTTATCATAG
CACATTGTGTATCTATAATAACATGTCCACCATTTTTAAATTCATTGTTTTGTACAGATT
GATTTATGTAATTCCTAGATTCTCTTAATGTTCTTTTCCTTATCTTAATAATCCACATCT
GATCATCTGGATATTGATCTTTTAAATGACCAGTAAGTTTTTTAAAAGCTGAATATAAAA
AACCACCATCACTATCTCTAAAAGTTATAGTTAATTGTTGTAATTCGTGTCGTCCTTGGG
TATAAACCCAACTAGAACCTATCCATTCATTTATTTCAGCAAATGAAATAGGATCTATTG
AAACTCTTTGTATTAATATATCCATATTTGGTAAGTCAAGAATATTAATTCTACCAGCAC
CAGGAACTTCATTTTTTAAAGCAAAAGTATCAATGCTATATAAACTTTCTAAATCAAAAT
TAATACCATATGTTTTTGTATTTTTTGTGCTAATTCAGTTATAGCTGATTGTGTTTTAT
CACCACCAAAAAAATCTGATATTGCACCAACAGCTGTATTTAATATACCCATAAAACCCT
CTCTATAAATATTACTAATATTTATAGAGAGGAAACTATGGAATTAGAAGTTTGGAAAGG
AAAACATTCTGTTTTATTAAATAAATTATATAATGATAATTATTATGTTTATGACAGCGA
TATTATTGATGTTTTAGTATATAAATGCCTAAACCAACCTAAATATATCACAAATGATGA
GGCTAGATTTCTATTTTTAAGAAATATTTCTCTGAAGTATGTAGTGAAATAGATTCTAG
TTTTAAATGCCCATACTGTAATGAAATGAATAACATAAAATTTACTAATGATGATATCTC
TATAACCGAATACTCGTTAGAACCTATTGAAATAAATGTAGATAATATTATTGTTACAAT
TTATTTTAAAAAAGAATTATCACAAGATGACTCTTTATGTCTTATTGCAGAAACAAAAAA
CATGATAGACCACGAGAAAGATTATTAGAATTATATTATATGATTGATTATATTTCTAT
AAATGGTGAAGAATTAAGAGGTAATCATATTATATTTGAAAAATATATTAATGAACTCCC
ATTATCATGTTTTAATAGAGTATTTGATTATTTTAGAGATTCTATACCAAAACATAGTAT
TATTAAAAGTTGCTCTTGTAAAAATTGTAATAGTGAAATAAATGTTGAATTAAAAGAATT
ACCTGAATCTGTTAGAAGGAACTTATTTTGATAAAAGACATTGTTATTAATAACAAACAT
TACTATTTAAATGTATGGAAGATAAAGATGAAATAGGTATATTACATCAATTTATTGAT
TGGATTGAACTACCATTAGAAGATCAAATAAATAAAATAGCTGATATATTAATACCACAA
ACAAAAGATTTGGATTATATTTCAAGATTATATACCATGATAATCTTATCGTCTTATGCT
```

FIG. 13J. Continuation of (CJLB-10 [organism=Campylobacter phage CJLB-10] complete genome)

```
AATGGTGATTATAGTGATATACTACTAACTTGTCCACATTGTGGTAATCCTATTGATACA
AGAATAAGCATAAGAGAGAATTTAGAATTTATACCTCCAAAAACTGTTGAAGTTGAAATT
AACAATAAAAAATATACTATTTCAAAACAAAATATTGAACTGTGTAATGAGTTACCATTA
AAAGATTATAACTCTATTTTAAATCAATTAAATGATGATGGTGATTTAAAATTATGTGCT
AAAGTAAAATGCATTATGTGTAATAATGATGTTTTAGCTGTAAGAGAATTAAAAGATTTA
TTTGAAAATTATGTTATAATGCTTGATTTAGAATGGTATTATTCTACACTTAAATATTTT
ATATCACAATTAGGTTTTAGTAAAACAGATTTTGATAGTTTATATCCTTTTGAAATTGAA
TTGTTAACAAACGAGGATAAAAATGAGTGATATTATTAAAATAGATGGCCAAATGGTTTC
ATTAGATGTAGATTCTTTAAAAGATGCTTCTATTGAAACTATTGCTAAAATATTAAATTA
TACTGAAGATACATTTAAACCTTTGCTAGATTATATGTCTAACAATGGAATCCCTTATTA
TATGATTTTATATGGAAGATTTAATAATGAGTCTTTATATAAACAAATGGGAATAAACAT
CCTAAAAACATTAGGTGCTGTTGCAATGTTATTCCCACCTGTAAGGTTAGTAGGATCAGG
TTCTAGAGTTATTACTGTTGTACCAAAATTAGTATTTAGTAAAGGTGGATTAGTAAATGT
TACATTAATATCTGCTGGTGCAGCTTTAAAAACAGAAGAAATAATGAGCTATATACACT
TGAAACTATGCTTAAAAATGCAATTGTGTTTGTATTTGAAGATATTATAGTTAGTACTTT
TAAAATGGCTAAAGATGGTATAATGAAATTAAGTTTAGGTATAGCTGAAAAAATAAAAAA
AGATGGAAGTGTTTTAGTTAATGGATTACCTATATACTTATATACAGATCTTGATAACAT
GGATCCAACTTTATTATCAAAAAATTCAGAAACTTACGATAAATTAAGACCTGATTTATT
AATTATTTTTGAATATATCACAACTCAAGCTAAAACTAATAAATTTGTTGATAATTATTA
TTTTGAATCTTTAAGTTTAATGAAGGAAAAAGATCCAAAACTATATTCAATGGTAAAGAA
TTCAATATTTGGAAAACAACATGTAAGACAAGGATTTATAAGGCTTGTACACAACGCAAT
GTATTATTTTTCAAATTCTTATGAAGTAACATATGATGATTTAATGATAATATAGATGA
TGTCCTACCATCTAATATATTAAATGATTTTAAAAAAATGATTTTGGACAATTCTTTAGA
ACCATTAAAAGACAAAAAAGGGAAACAAAAAACATCACTATTTGGTGATAAACTATATAA
AGTAGTATATGATAAAAGTGCCTCACAAAGTTATAATATTGGAGATGTACAAGATCTTAA
CAGGTTAACAAAAGCACAATTCTTTAATGTAAATAAAAAACTTCAAAATCAGACAATTTT
GAGTCAATTTGATATAGAACCACAGAAAACAGAAAAAATACTGCAAATGTTTCAACACC
ATCTACTATAATAGGAAGAGTAAGTTCTGCATTACAAAACATGTAGGTAGGGCAAAATT
AACATCAGAAGGAGTTGCTCATGTTAAAAAATATGGTATTACTACAACAAAGTCAAGTCT
TACTTTAGAAGGTTTTGATCCATCTAAATATTATTTTTCATATAGTGGTAGTGAACCATT
TAATACTGGTATAGAAAAATTAGATTCAAACCTTTTATACAATTTAAATCTAATGGCTTA
TGATTACTTTAATACATATAAAAAACAATTTACTGTAACTTCTGGTTATAGGAGTATAGA
ATCACAGCAAAAATTATATAATAATTTTATAAATGGTAAGGGTAGTCCTGCAAACAGACC
TGGATATTCATTACATGAATATGGTATGGCAGTAGATATTAATAGTGCAGATGCAATAAA
ATTAGATTCTAGTGGAATGCTTTCAAAACATGGTTTTTGGAGGCCTATACCAAATAAGGA
ACCTTGGCATGTTCAACCAAAAAACATTACTGATAAAAACGGTGATGGTATGCTTGAAGC
TGATATCATTGAAACTAAAAAGAAACAAGCAAATACATTGCAAAAGACAAAACCTATAAG
TACTACTATTACTCCAATTAATACAAATGTAAAAAAACAATTCTACAAGTACAATAGT
TTCTACTTCTGGTAAATATTATTCTATAAATATAGGTAGATCTATGTATGTTTCTAATAT
AAAACAAGAAAAACCTATAAAAGCAAATACAAGAGATGTTAAACAAACCACAAATAAAGT
TATAACAAATGTAAAGACTATTGAACCAACTGCAAATAAAGTTATAACAGATATGAAAAC
AGAACCTATTAATTATTCTAATAATACATCAAAAAAGTACGCTCCAGAGGACACAATTGA
AATTAATAAAGAAGTAAAAAGATTGGGTGATGAGTTTGCACCAAAAAATAATAAAGGTGC
ATCTATTCCTGGAGATATAGGATACAAAAATGCTGGTAATGGCGTATCTATCCCTGGGGA
TATAGGTTACAAAAATACTGGTAATGGCGTATCTATTCCTGGGGATATAGGTTATGAGGA
GAAAAAATAGCAACTTCTTATGATGTTAAAACCCAAAAAGCAAAAAATATAACTTATAA
AAAAGGAAAAGATGATAATACCTATTATACATCAGATGGTAATTTTATTACCAAGAAAAC
AAGAACATATGATGATGGAACTAAAGAAGATTACTATTTAACAAATACTGGTCTTGAATT
AACAGAAAATATGTTACAAAATGATACAGACGAACAATTTACTGAAATGTCAGGATTATC
AAAGGATCAATTTCAAAAAGGTATTAATTTAATAAATAATAAACAATCTTCTACTAATGG
AGACGGTGATAAACCTTCTGTTGATGCTGTCAAATCAGTTGAAATTACAAAGAAATTAGG
ATTATAACATGGCTGAAGTAATTAATATACCTGGATTAGATAATGAAAAATATTTAGTTA
AAATAACAGCTTACGATATTGATAATTTAGGTATAGGGAAGGAAGTTATGGATTCCTGGG
ATGATTTGGTAAAAAAGTTGATGAAAGCGGATCAACTGATATTAACTCAGAAGGAGAGT
ACTCATCTATAGATCAGCTATCCGAAACTTCAAGTAATATATTAAAACGCACAGTTGAGC
TAATGATTGATAGAGATTCTGCTGTTATATCAACAGATGCTGCTGGGACATTCTATTTCC
CTCTGCCAAACTCATTATCAGACCAATATGTACAATCATATGAAGTACAGTCTATGAATT
TGTTAGGTAGTGCTATTTCAAAAGCAAGTAGTTATGCAGGTCAAACTTCTATAAAAAATA
TATCTGAACAAGCATTAAAAAGAAGTGGTATTCAACTAGATCCTAACATTTATCAATAT
ATAGGTCATCAAATCCTAGAAATATAGATATGTCTTGGAATATAATACCAAATCAAGAA
AACAATATGACGCTTATGTTGCTCAAATAAGTAAGTTAAAAAACTGGACAAAAGCTAAAA
GGAATCCTATTACTTTAGGTAGTGTAGGAAATATAATACCTATGAATTTTTGATTATGA
AATACATTTTTTGTATAGAAATTATTTCACTGCAAAATGATAAAACACCTTTAGTTTCAA
ACTTATTAAGTGCTTCAAGAGATATTACAGAAGGCTTTTTATATCTTTAATAAATACTA
ATATAGGGTCAAGGCAACTAATGCTGAGACATGATGGTAACCCAACTGAATTTTCTCTTA
GTATCCAATTTATTGAAAGGAAACCTTTATGGAGAGATGATTGGGAAAAGAAAATAAATA
```

FIG. 13K. Continuation of (CJLB-10 [organism=Campylobacter phage CJLB-10] complete genome)

```
GCCTATATAACGATCAAGGTAAATCAGAAACTTCTTTAAAAGAAGATGATATTTATAAAG
AATAGAAAGGATGCAATTTTATGAATGATACACAAACTATTCAAATATTTGATTTAATAG
GTGACTCACAAGCTAGAGATTATATTGCTATAAAAGCTTATAAAATAGGAAGTGATGTAT
CTGGTATAAAAGATAGCATTAATGATATTTTAGATGATGATCCATCAAAAGTATTTGATA
ATATCTTAAACATGGCAGAGAATAATATTTCAAATATTATAAACCCATCTAACTGGGAGG
CAGGACCTAGATTAAAACCTGGTGTGCCATGTGAATACATTTGGATATTACCTATACCAT
CATCTTTAGCAGAAGCATTTAGCCATGAATTTAATCAAGATGAAATAGATCCAATAGGTG
ATATGATAGGACAATAAATTATGGCATCTATAAGATCATTTGTGAATTTTTTAACAAGG
GTTCTAAAAAAGTACATAATACAGAAGTACCACCACATACAATAAAGCCTAGTGGAACTA
GACCAAAACCTAATAAAATGTCTACAGTTAAAGGTAAAATTAAAAAAGGTGGTGCTATAG
TTGGAATGGCAACTGGTGCAGCATTACCTTTTGGGTATAATCTACTAAAACGGAATAATA
TCAGGACTGACCCTCATATTATTAATACATATAATGGGACACCAAATAGGGTCTTTAATT
TTGAAACTATTCTTTTACCTAATAATGCAAAGCATGCAGAGGATATTGTTAAGGCGTTAT
TACAGTTGAAATCAATAATGACTGGGACTCAATTGGGTACAGATAAAACTGGATTATTGA
TATCACAAGATTATGTTTTTACAATAGAATTTGGATCTAAAGATCCAGCTAAAGGTGAAC
AGCTTAAAAAAACATTAAATAAACTCTTACAATTAAATCATGAAGAAAACGGAGAAACCG
AATTAAATCTTAAATGTGTAATATTAATTCATGGGTCAGGCATCTGCTTTATATGGAA
ACGGATTACCAAGAGATTTATCTGTTGCATTACAATTTGAAGAAAAACGACCTTTAAGAA
TGACATCAGATATTGTTGAAACAACTGATACATCAAATTCAAATGGGAATGAAAAAATAT
CAGAACCTAATATAGGACTAACAGAAGAGGAACTAAATTATAAATATTCACAAGATGAAA
ATAGTTAATTTATAATACAAGGGCAAGTTATGAAAAATTCTGTTTTGAATAATAAAATAA
TGGTTGATTTCAATGGATTTTCATTATCTCCTACATATTCAGTAAATATACCAAAATTAA
GAGAATTTATGAAAATAATTTATCAATGTTTTATGTTAAAGAAATGAATGATAATGTTA
GATTTGAAGTATTAGCATTAAGAGAATATAATGATTCATCTTTATGGGATATTTTGATGA
TTTTAAACTTTGGTGAAAATGGTATTCTTAATTTTGCTAAAGGCGATACTTGGGTAAGTG
ATAATGCTGAAAATCAATATAAAGAACAACAAGAATATTTTTCACCTAATTTTAAACCTG
AAGATCTATATAATCAAATACTATCAAAAATACAAAAAAAGAATGAATCAAGAAGGAAAG
TTATTTTTATAAAAAGGCAGTTTATACCTCAGTTTAAAGAATCCATAAAGGATATGTTAA
ATGTTTCTGATTTTAAAATTATGCCTGAAGCATATTATGCAATACTTTTATATTCAAAC
AATAAAAAATCTGAATTACCACTAGACCCAGCTAATATATCAGATTTTACAATAATCTGG
GATTATAATGATTTATGCGTTGAAGGTTATGTTATTTTTAATGATACCCAAAAAATAACA
GAACTTTTACCACCACATAACGGAATATGTTTTAAAGTTTCATTAAAAGATCATTTTAAT
ATTAAATTTGAAAGAGTATTTAAGGTAACAAAAATAGACAGAGATTTTGAAGGTCAATCT
ATTGCCACTATAAAATTTGAGTTAGTTGATGAATATTATAATATGTTGCTAATACTTTT
ATTTCAAAAGGGTACAATAATGTAAAGTCAACAGATGTTATTAAAGATATTTTTAGTACA
AAATCTGATTTAATTTCAACACCATTAAATGTTATTATAAAAGATACACCTAAAAATACC
TATGAGAATTATGTAATACAAGGTAATAAAAATCTATTATATCTTCTAAATAATATGCAA
AAATTTGATGATTTACTTATTATTAATACTAGAAAAGGTATTGTTGTTATACCTACTGAT
AATATAGGTAAGTTAGCACCTGATCTATCAAAAGTAGTAAAGTTTTCACCAACTCAAACA
CAAGAATATTCACCTTATTCTGTTAAAGACTTTACATTAATACAAGGTGATATGTTAACT
CAAAATGCAATTTTACCACCGTCTATAACTTATCAAGTTGATTCAAAAGAATTACTAAA
GAAGAACACAATACAAAAATATCACATGGTAAAAGTGGTTTAAAAACAAGTTTAACAATA
AATGACAAAGATGGCATTCAAGGCATAAAAATATTCCCATACTTACATAATATAGTTGAT
TCAATATATAATACTGAAATATTAGAAAGTTCTGCTATAAATATTAATGTGGCTGGCATG
TTTAACCATAATTTAATGTGTAAAGTGAGTTTTGATGCAAATTCATCTATTGAAACATTA
AAATCAAAAATGCCTTATGTTACTGGTGAATATTTTATAACTAAAATAATTGATCATATA
TCATCTGGTAATGTTTTTACACAAACAATAACATTAGGAAGAATAGGTTCTGTATGAGAG
TAAATGAAAAGAATTTTAAAATATTAACACAAACCCTACCTTTTTATAAAGGTGTAATTG
AAGATGATAAAGATCCTTTAGAATCACAAAGATATAGAGTAAGAATTATTGGTATAGATG
ATGAAACTATACCTACTGAAACTTTACCTTGGGCTACTTCATTAGATTTTCTTTATTTT
CTGGTATGGGTTTTACAAGTTTTATAAAAAAAGGTGCTTATGTATTAGTTCATTTGTTTC
AAAATGATAGAAATCAACCTATTATAATAGGTGTTTTAAAAGGTGTTAATAATCAAAATG
AAGAATTACAATCATTTAAAGATCCTACAGGTCAATATCCTTTAAATGATTATAAAAATC
AACCTGATACAAACAATAAATCAAAAGGTGAAAATACTTAAAAAAATCAAGTATTTGAAA
CAGAATCAGGGCATTATATGGAATTTGATGATTCAAATGGGGATGAAAGAATACATATAT
TTCATAAAACTGGTACAGAAGTTCTAATTGATAAAGAAGGTACAGTAACAATAAATGTTG
TAAAAGATAGAAACTTAAATATTAAAGAAAACCAAACTTCTGTTATAGATAAGAATGATA
CAACACATATAAAAGAAAATAAAAACTTAACTGTTGATAAAGATAATACAACAAATATTA
AAGGAAATAACACCATAAGTATTGATAAAGACTGTAATATTACAATTAAAGGCGAATGTA
ATATTACAGTTACTGGAAATGCTAATATTAAAGCATCAAATATTAATTTAAATTAAATAA
TTTTTTAAAAAAACATTTAATTTTACAATGTTTGTGATTATGTGTTAGTTTCTCAACACT
AATATTAATTTCATTTTTCTTGTCATCTATTTTTTAATAATATCATCAACATTATCATC
AACAGATATTTTTACATCTGGATTTAAATGAATTTCTTTAGCTGAATTAACAATGTAGTC
TTTTGCTAAAAAATAACATTGTTATCAGATTCTATTATTATATTCTTTTTAAACTTAAT
GTAAATATTTTTTTCATCTTCTTTTATAATAATATTATCGTTAAAAACTTTGAAAGCGG
TTTATTAATAATTTCTGATATCATGATTTATCCTCTGAATACATTATTACTCCCTTGAG
```

FIG. 13L. Continuation of (CJLB-10 [organism=Campylobacter phage CJLB-10] complete genome)

```
CGATTATACCTCCACAATTAACAGCATCCCCTATACCACAAGTAGCTTTTGAATTTGTAA
AAACACTTGTGCTACCACTTGAACTATTTCTACCATGCGGTGGTGTATCAGGGCATGCGT
GTGATTGTATTTTATCACCTAATCTATGAACAGCTATTGAATTTGCAAAAACATTAGAAC
TTGCTTCTATTGTAGGTGAAGGTGGATAACAACTATGTCCTAATGCTATATCTCCTAATC
TAGTTACTGGTGGCATAATATTCCTTACCTATTTAAAATAAACTTAAACCAAATGCTAAA
AAATAGCCTTTAAAAATATATGATAAAGCACTTATACCTAATAATAAAACTATTAAAATT
ATACTACAGCAAATAAGCATAAATATACTAGGACCATACCTGTATTTTTACTAGGATAT
AGATTATAACAATTTACATCATACTCATTAAATACTCTGCGTATAATTTTTGATGTGTTT
TCCATAAAGAAGTATGAATCATCATTTTCTGAAAGTAATGTTTTATAAAAACCAAATTTT
TTTCTAGCACATATTTTATAATATCTTTTTTGTTTAAAAAATGTTCTACCTAATTTAATT
TTAATAATATCATAATCATTTATATTTCTATTGTATCTTTAAGCCTATCTTTTAAATCA
TCATCAAGTTTAATTGTAACACTTTTTTTTCTTAAAAAAATATTGTAATTTTTTCCATA
ATTTTATCCTTTCAATATTAATTTATCAATATTATATCATAATGTACTTAAAATAAACTT
AAACCAAATTTATTTTAAAATTGTTTTTATTAGGATGATTTTTCATAAACTCAACAGCAT
CAGTATATACTTTATCTCCGATTTTTAAAGGAAATTTTGCTTCATCAATATAATTTTTGC
AAAATAAAGTGCTTATTATATCATTGTCTTGCAATATGGTAATAGTAACATCGCTTACTT
CTGTTACTGTATTACCTAATCTAGAACCTCCTGAATTTACTTGTACTGTATAAGTAAGTT
TGACTTGAAAATTAAATGTAAAAGTTTGCCCATTTTTAATAAACCTAAATGCCTCCAAT
TACTACCATCTATTTTCATTAATTGATACTCATATATAGCATTTTTTGCTGAAGGTTGTT
TGCTAAGAAGTTCTATATCACCAGTTATTAAACCAGTTTTTTCATCTATTTTAAATGTA
AAGGAATGTCACCTAATAATTCCCATTTCACATAACTTTCAAAATTATTAGGTGGTGTAA
ATTTTACTTGGTGTTTATAAGTAGATAACTCAAAAGGTGGATTGTATCCACCTTGTGCTT
CATTTCTTAACTCACCACTTTCAAGCCCCATTAAATACCTTATTTAATTAAGCTATCTTT
TCCCAATGTGAGTATGTGAAATCAACTGTAAACTCTTGTATAGAATTAATTTTATCTGCT
GCTACTTCAATTTCACCAACTTTTGAAGGCCATACATTAAAAAACTCATAAGTTGCAACA
GGCTCACCATTACAATTAACTTGATGAACCTTAGCTGTAACCATTAAACTATATGGATCA
CAAGTATGATAATTGTTTTTGTACACATCAATTTTATCAATCCATGTTAAAAATTTCGCT
CTAATATTATGATCAGGTGTTTGATAAAATACTGGGCTCCAAGCTGCATCAAATGTTGAA
TCACCTGGTAATTTTAATTTCCTACCTTGGACAAATGCTTCAACTTCTCCAAGAGTTCTT
TCTGGAAAACTAGCAGTTTTACATAATATAATATCCTCTTCTGTAAATGCTACTTCTGGA
GCACCTAACGGAGTACCTATTTCTATAAAATATTTATCACTTTTTGCTCCACCTTTAAGA
GCATTTGCTAATTTATCAACTGTATATAAAGGCATTTTAATTTATCTCCATTTTTAGTAT
TATTTATACTCTTTCCCAGTAAGTATAAGCAAAAGTAACTTCTGTTGATGATATTTCTTT
TCCAGAAGCACTTAATTCAACTTCAGCTATATCAATAGGGAAAGTATAACATAGTTTAAA
TTTAGTTTCAGTTTTACCATCAGATGATAATTGTGATACTATTATATCACTCATATAACC
AGCACCTACACTATTAAAACCAACATAGTTACCTAAGAATATTGATTGTGTAATTGTACT
ATCAAAACTATCAATTCTATAAATCCAATCACTAAATAATTGATGAATATCCATATCAGG
TGTATTATAAAATGTTATTTTATGTGTATTATTAAATTGTGCTGCACCTCTTATAACAAA
TGGTTGCCCACGATGATACACTTTTACAGTACTCATAGACTTACCTGGAATAGATGTTCT
ATTAGCCATTATACTTAAATATTCACCTGATATATTTACTGTTTTAAAAAACGGTAGAGA
CCTCAATAGGGTAGGTATTTTTATGTCAATTTTATATTTTGAATTGATGGCACCCCCTTG
TTTAAGGGAGCTTCTTAGTCTATCAATATTATATAAAGACATATTAGAATATTAATGTCC
AAGTAATTCTTAATATAGATGAAACATCTTTACTTCTAACAGCAAAGGTTCGCATACAAA
ATAAATCATTACCTGCATATAAACCTGCTTCTGTATAACCAACAGCACCTGATGTTCCAT
TACCAGCTGTTGTTGAAAGCTCTATTCTATATGTAATTGTATTATTACTATTAGTAACTT
CAACTGTTGATCCAGCACCTACATCATCTTCTGTAACAACAGCTTGTCCATCAGATTGTG
GTGGTGTAAAATTAACATTATAACAAAACTCACCTTCTTCTTCAGCAAATAATTGAGTTC
TAGCAGCTGTAAAACCTTCATTGGCTGTTTTTGGCATCATCAGGTTATTACCAATATGTC
CTCTAGTTCCTAAAACAAGTTTATTTACTGGAGTTGTGCTTCTACCAGCCATGTGTGAAG
CTAGAACAGGTCTTGATCCATTTACAACTAAGTTATGTTTTTCAAAAGTATCTATAACAT
TTCTATTTTTATCTAATAATTCAATTTTAAAATATCCTTTTGGTGGATTAATTGATTCTA
CCATTATTTTCCTTATTTTTAAAATATTTATATCAAAAGCGTCATCTAATATAACACCA
TTATCAATATGTTCTGCTCCTATATTTATATTACCTACTTTAAACGAACCAACTGTTATT
TTTATATCATCATTAACAACTTTTTCATCAAAGTTATCCAATATAGTTGTATAAAAATTA
GTTTTAAGATTTTTTGTAACAGTTTCAGAATATTCTGTTGGGATTATCTCTCTTTCAATA
CTAAATGAATCATCAAGAACTGCACCTCCTTCTGGATTTTCAGATTGTGATCCAACTTTA
AAAGAACCTACTATTATTTTATTTCCAATGATATTACTAATACCTTTTTCATTTACAGCA
TTATCTATAAAATCATTAGTTGAATATATATCCATATCATCATGTATATGTTCAAATAAA
CCTCTATTTATAGCATTTGTAAGAAATAATGGCATTTTATCTGGAGTATATTTGGTAGGA
TCATCAGGTAATGTATAAATAGTATTATCATCAATTTTACCAATTACAAGAGATGAATAA
TATTTATCAGCTACTCTAAATTTATTTACAATGGCTTCACCTATAATAGGCGTATCAAAA
CTGTTTAATCTATTCCATACACAATCATATACTATAAGGTTGTTTCGGAATTATCAAAT
TCATCTTTTAATCTAAATTTTAGAGAAATATCATAATCTAATTTAATATGTATGTATTA
TTCCAGTTTTCTATTACGCTACCATCTTTTTCATTATATGTTATAGAACCATTAAAATCT
TTTATTAATTGTTTCCCATCATTAAATGTTATAACTATTCTTTCTTGGTTTTGTATATTT
TTAGAGGTATAGATATCTTCTACTTTATCTTTATCAAACTCTTTTTTATAATTTGTTGAA
```

FIG. 13M. Continuation of (CJLB-10 [organism=Campylobacter phage CJLB-10] complete genome)

```
ACAATTTCTAAGGTTTTTACATTGAAGTTAATTAAATCATCTATATACTCTATAAATTCT
AAAACAAGACTTATAACATAGTTATAACCAAAACCAACTGGATGTGCTATTGACTTAACA
CTACCTTCATATAATATAGGATCTAGTAGGCCTTCTATTCTTATGAAAAACGGCTCATTA
GGGTTATCTTCTGTACCCCATTTTAAATTAAAACCACTTGAACCATTTACATCTAAACCA
GGTTGAAGTCCTGATGCAAATATAATATTGTAAGCATATTCTATTGCTACATCAAGACCT
TTTTTTTCTTTAAAACTTGTAAAATTAACAAAATAATCTTTTAATAATTTTTTATAAAAT
TCTTTTATATCAAATGGTTGATAATTATCAGTTGTACCTATTTTTCTTTCATTCTCTGA
ATTACAACTGGATTTGTCAATGCTTTTTGCATACCATAATATAATGATTCTGCATATATT
TTAACAATATTTTCTGTTATGTTATTATTAGGTCTTTTAAATATGTTATATATATCTAAT
GAATATGGATTTAACTCATCTAAAACCTCTATATAGAGCTTCCAACACTATCTTTATGCAGT
TTATTTTCATTATAAATGTTGGGCAAATCAACACGATCTATCATATAACATCACTTTCAC
TTACAAATTTTACTGAAGATAATCTAGCTATTGTATTTTTATAAAATGATAGGTTATCAT
CAGAATATTTTACCCTTATATATTTTGGAGTTACATTATCAAGACTGCTTAAAACTATAC
TATCTGTTATTTCTATAACTATAAACCTTCTTCTATTATCATATATTTATTTTATAAGTTC
CTATTATTGTTCCATTTGCAAATATATTAAAACTTATATTAGTATTCTTTATAATTAATC
CATCTGAAGTGACAACATTTTTACCATTGAAAACTGCTGATTGACCATTTCCTACATCAA
AAGTACCTATTATAGCATTAGAACTTCCTATAATTGTAAATCCTTTTATAGGATTTTTAA
AATCAACTTCTAATTTTCCACCAAAGTCATCTGAACTTATTTGTGGTAATAAGTTAACAT
GTAATTCATTTGATCATCCTGTGTTTAGTTATTATTTGCTCAAAAGGTATAGCCAGAT
AAATATATAAAATATCTTTGTTTGGTTCTTTATTTCTTAAATATAAAGGTATATTCATAC
TAACATCTACTTGTATACCTGATAAATCATATAATTCTGTTCCTAACCTTTTATAACAC
TTGAATGAAAATAAGAAGATTCAAAAATTTCTATATCTGATTTAAAATAATCTTTTAAAA
TATTAAATAATTTATCCTGTGTTTCATTTTTCGAAACTACAATATTTTGTTTGATTATCC
TTATTTCATAATCAAAATCCATATATATAGGATATCTATTATGTAATTCCATAGTCATTA
TTTTATAAGAGTCTAGCTCATCAAATATACCTTTATTTACTAAATATCCATTTTTATCTA
ATGTATTGGATCTTAGCTCACTTTGTTTTAAATAATATGAATCATTTTATTTACTAATG
AATATGTTTGTGTTGTTTCATCTAATGAAAAATCTTGATTACGGTATTCAGGGATAAATG
AAAACCAAATGTGCCCTAGTTGTACAACTTGCTCTTCATCTCCACCCCACACTTGGGTTT
GATATATATTTGTATATCTATTACAGATTGCAATATAATCTCTTACTGTAACTGCCCTGT
TTGCTGAATTATGAAATATGGGAGCATTTTCTTTTATTGAACTATTGGTTTCTTCATCAG
TGCCAACTATTTTTGTTTCAAATTTATCAATTTCCATGAGATTAAAAGGATATGTATTTT
GTGAAAATGAAAAATTGTCACCACACTTACCACTACTTCCTTTAGATTCTAAATATGTAA
CTTTTACGGTACTTCCTGGTAATAAATTTGTACCTATACCTGATATTGAAAATAAATAT
CAACACCACTATAATCTATGTTATTTAAAACAAAATATTTTTATTTGTATCACTATCTG
CATCTATCATAAATTGATCTGACTTTTCCCAATACTCATCAACTTTATTATCTCCAGTTT
CGATATCAATATAAGTTACAAAAACTTCAAGCCCATTTTCTTCTATATTGTCTTGATATA
ATGATATTTTATTTGAAGATTTTATACTTCTATTTTGTTCAATAGCTTTAATAGTAAAAA
CTTGTGTGTCTTTATTTTTGTCCCACTTATGTAAAACTCCTTCCTTTACATCTATTGTTA
TAGTGGATGCTTTTCCAGTAGTTATATCTTTATTAGATAATTCAACTTCAATATCACTTC
CCATATAATAATATGTATTTGAACCACTATTAAACATTGTATATTTGGGTATTGAATAAA
CTCTTTTATCTTCGTTATCATCATCTTTTGTATTATCTTTCAAAGGTTTTATTTTCAAAG
AATAAACATAAGATACTTTTCTTGATGCTTCATATCCTAATTGTCTAGCACCCATAAGTA
TATTTTCCTATATTGAGCAGTTGATAATAGCATTTCACCTGCTTGAAAAGAGGTATTTA
CATTTATACTATAAGCTAAATAAGATAATATATCTGCTAATAGATTTGCATTTGAACTTT
TTACATCAGCACTATATCCTTTATTTTTAAGTAATTTTATTACTTCATCTTTTTATATCAT
CATAATTATATGGAATTAAAATATTATCCGCCATTATCCAACCTTTATGCTAGCTGTATC
TGATATAGTTGTGTCTTTAACTCTATATTTTATTTCAATATATACACTATTATCAGAGTT
TCCTTTTGAAATATTTATATTATCAACTATAATACGATAATCAAATTTTTGAATTGATGT
TTTTAAAGATGTCTTATAAGCATCCAATGCAACTGAGCTATATTGATCAAATAATAGCTG
AGCATTATTTGAAAATTCTGGAAATCCAGCTATATCCCAATAGTAGTGCTTACAATATT
TTTTAATGACACATAAAAAGTATCAACATTTACTATATCTTTTTCAATATTTTTCGGATT
TATATCTTTGTATTGTATCACTATAAATAACCTTTTAAGGTTATTTATAGTATTATTTTA
CAACTTTGGATGGGATCAGGATTATAAGTGCATCATTATTTTTTGGAATTAATTTAAGCA
AATATGTATCTTGCCTTGATGTATGTTTATGTACCGATACAATATAATCTGTTGTTGGTA
TTCTTTTTAAATTTTTAATACTTATGAAAATATTTGCCTTTGAATTTATTACATTTGGTG
TTACATTTAATGAAAATTCATTACCATTTATACCTTGTCAGAAGTAGAAACAGTAATAA
TATCGTCAATATTTAATACCATATCATCAAATCCTAATAATGTAGCAGCTTTCTTAATCT
TATCCGAAACTGTCATATCTAACTCAAAAGAAGATACTAGCTGCAGCATTATTAACATTT
CAAGTATTGTTGGCTTTACACCACAAGCATTAGACAATGCTTCAACATTTGTAGTAAGAT
ATTTACAACTCATCCCATCTTTTGAAATATGAATAATGTTTTATCATCCATTGTTATGT
TTGCATCTTCACCAATTATTTTTAATAAATCCATAAACTCTTTAATTTTTAGAATACCAA
AATCTTTAGGAAATGGTTTATTTTCAAGCTTTTCCAAGTCAATAAAGCAATGATACTAC
CAGCACTATCTTTTATACCTGTTAATTTTGATGAAAATATAATTGATTCATTGATCAGTT
GTAATGAATTTACTAGCGCAATAGTTTTACTATTAAGTAACATTATATTCCTTTCTTATA
AAGTAAAGTGGTATAACACCACTTTAAGATTAATTTAAATAACTTCTTTGATTAAGATGC
ATTACATTGCAGCTTAATGAAGCACCACTAACATAATAGCCTGATATATTTTGAACTACT
```

FIG. 13N. Continuation of (CJLB-10 [organism=Campylobacter phage CJLB-10] complete genome)

```
AACTGTAATCCTAACTCAGAACAGATTTCATCCATAAACTCAATTTTATCTTTTTCCATT
TCATATAGATCTTTATCAGATTTTTTATTCAACTCTGAAATATCAGATGGCGTAATAACT
ATACCACCAGGTAATAATACACTATTTGTAGTTCCTGCTAATGCAAAATCATATTGATCT
GGGTCATCATGACTATCAACACCTAATGGAATTACCTCAACATGTTTTTCAAGTTCTTTA
ATAATATCTTTATCAAGATTATATGTATTAACCAAGCATGCCTCTGTATCCGGTCCTAAT
GGGAATACATTACAATCTAGATGATATAAATATTCATCAATACTAGGGAATTTTATAATT
TCACAGTTGAATGTTTTTGCAATCCAATCTAAAGCTGCACCGTTAGTTCTATTACCATCA
GCACCTACATACACATTACCATATAGCCATTTTAAGTCTGCTTCACCTTCAAAATACATA
GGTTCACCTTTTTCATTAGCATCAGGCATAATAATAGGATCAAATCCAAGTTTTTTAAAA
TACTCATAACCTACTTTTGTTTCACCTTTGCGTGGTTCTGACTTAAAATTACTAACTAAT
ACTCTACGATCTTCATTTGGATTTAAATGTGGGAAAATCATACCTAAATTAGCAACATAG
GCCAAATCCTGTAAACCTTTTTCAGCTGGTATTGTATAAATTGATGCTACTGAGCTGATT
GTTTTTTGCAACTCAAAAAACTGCTTTTCAATTTTTTTAATATTTGGTGTAAATTTACCA
TCTTTTTTTAAATCTTCCATCCATTTGTTATTTGGTGTTGAATCAATTATACCATATGGT
GCAGCCATTAACACTGATGGTATGACACTATTTCCTACAAAGTTTTGTAACATTTTTACT
CCTTTAATAATTTTATTTTATATTTACAAAAATAAATATAATGCAATTATACTATATTAT
GCTTAGTTCCTCCTTAATCTGGTTGATCTATATCAAAAATCTTGATTGTTTAAAGTTTA
TACCTATATATTTTTGAGACAAATTACCACTATTTCTGTTTTTAGTGAATGATACAATAG
CCTGACCTAATTCATCTAATTCTGGTGATCTATGCAGCATTGCAATAGTATCAGCTGTTT
GAGCTATACCCAATGATTCTGCTATGGTGCTAGTATCAGCATTTGAATTATTATAAGCAT
TTCTATTAAGTTGTGCTGCACTTAAAACACATTTTTTACTTTCTTTAGCATAAGCATGTA
GTTCTTCTGCAATTTTTTTATAATAAGAATATAAACCTACACTAGGTTGTAAAGCATACG
AAGCCATAAGTGCCAAGTAATCTATTATTATACAATTTAAACTTATTTCTAAAGATGACT
CTACTTTTTGAACTAATGATTTTAATTGTAAAACATCAAAACTACCAGCACCATATTCTT
TTACAACACATCTTCCTAAGTTTGGTAAACTTTTATATCCTTCTGAAACATTATAATTTC
TTAGTTCACTAATATCAATATTAAAAATATTACTTTCTATTCTATCCCAAATTTTTATTG
AAGGCATTTCTAATGTTATATAAAGGCAGTTATACCCTTTTAACATAGCATTTGCACAAA
AATGTGACAAAAACATTGATTTACCACCATGTGTAACAGAACATATGAAATTAAGTGTGC
TAGGCATGTAACCACCTGCTAAAACTTCATCTAATATTTCAACACCTGTGGAAATACCAA
TTTTGGTTTCTCTTCTTAATATATCCCTTTCTTGTGCATCAATATCTTTCATGCCTATAT
CAGTATCCATTGTAAATGATATAGCTTGTCCTAACCTTTCATATATCTTACCAATATCTT
TTTTTTCTTGTATAAGTTTTGCACCTTGTATAATACAAGATCTCATTTCAGCTTGTTTTA
TAAATTCTGCTGTTTCATTATTAAGAAACTCTGGAGATACATTTTGTTTATCTAACATAA
TCTCTTTAAACCTGTTTATACAGTTTTCTTGTTGCTCATCTTTAAAATTATCTTTTAACT
TTAAAGCTACTTCTTTAGGTGTAGGTTTTTTATTATACTCTTTTACAAGTTTTTGTATTG
TTTTGTAAATATCAGAATCTACGCCAATAAAATGCTCAGGTTTTAAAATTGAATATACTT
TATCAAAATATATTTCATCATTAATAAGACTTTTTAAAATTAATCCACTAATCATTATAA
TCCTAACATCAATTTTACTGTTTGTTGTTTATTATCAACATTATTTAAAACAATACAATT
TTCGGTTTTAATAATATTAATTTTTAAGTGAGATATCCTATCATAAATCATCTTAAGATC
ACCTGAAAATATTATTAGCTTGCCTAAATCGTCATCTAGTATATATGTCTTATACTGTGA
TGTTACCATTTTATATACAAAGGAATTATAATTACCTTTCATAATATATATCATTAAT
AATTTTTTCTTTAATAATATTTTGCTGTAAAGAATATTCCATTGATACAAAATTATTCTT
AACAATATTATAAATGCTATTTTCTGTATTATTTTTAAGTAAATCAGCTAATGCTGGCAG
TTTATTTTTCTTAAAATATAAATCTAAATAATATCCAAATAAAAAATCCCTTTGATTATT
TTTATCCCATTCATAATATGATTTTAATGGGTTTTGTAATATTTTGGTATATATTTCAAA
ATTTATTTCAAGATTTACTATATTCTTTGGTAAATTGATAGAATCAGTATTAAATCCTAT
TATTTCAAACTTATTTGAATCATCTTTAATATATTCATTAAGTTGATTATAACCACATAT
TTTAACCTCTTGCGTGTTAAAATTATTTCTATATAAACTTATTATAACTGGTACTACATT
ATAATTACATACTATCATAATATTTCCTTTATAATTTCTATGATAGTATATCATAGAAAT
TCTTAAGGTTTACTTATATAAATGATGTTTCCAAATAGTAGCTCTTATTTCCATCTTTAT
TTATAATATCTTTTCACCTTTAGTATTATCTATATTCTTTTGGCTCTATCATTAATACAG
TCTTACATATCTAATTTATATTGAACGCATATATATAAGAACATCGTTTGTTTCAGAGT
CATTATTGCTTATTTCCAAATCATTATCTATACTACCTTCTATTTTGTCTCCGCTATCAT
TTACATAATACCATACAGCTTTTCATCAGAAACAGATGTTTGACCATAATATCCATCTC
CTACATACAATATTTTATTAGGAATTTTTTCAGACAGTAAAGTTATTTAAGTTGTTTAA
CACTAGCATCAGACCATAGCGAACATTGATCAGCATTGCCAAGGTATTCTTTAAATATAT
TAGTAACGCAATGATATGAAGGGTCATTATATATCCCAGTAGTATCCACATCAACTTTTA
TATCTTGACCGCTAGGAGTTAAAGAACTAACTTCAGAATACCCAGAAAGGTTACCCAACC
CATCTAGAGATAGCAATATTTGACCGCTATTTAACCCTTTAACATTTGTTTTGTAGAAG
CATACCCGTTATCAAATCCTATTTTAACACCGCTCATACAACCACCGTATTGGCCACTTC
TTAGTTTTACATTACAAGTGATCTCTATTTTTCTAAGACTTGGTTTAATTTCATCCCCTG
TTACTATATTCACCCATTTATTAGCACCAAAAGTATTGTCTATACACATATATACAGCTT
TATTAGTTGTATCAGAGTATAGAGAACCTATTTTGTTAGGGTTTAATGAAAAATTAGGTT
TGCCTGACCCTGTAAGTAATTCTGCATTTTTATTAATTCTATTATTTATGTAATTTATAG
AATCAAGAACAGATATCAAGAACATACCATCTTTATAATCTATATTAATATTTACAGGAC
TATTATTGTCAGAGCTTCCTTTAACATTGAAGGTTTTTACAACAGTATTTTCTATAAATA
```

FIG. 13O. Continuation of (CJLB-10 [organism=Campylobacter phage CJLB-10] complete genome)

```
ATTCAATTTTACAGTCTTTAGAATATAAAAAGGATTTGTAGCACTAGTTCCAAATAATT
GAAAAGATATATTATCAACTTGTTTGGAGCTATTTATATCAACTTGGTAATAAGGATTTT
TTAACCCATCATTACTTAAGAATAAAGAGTATTTTTTATTATATTCTCTAAAAGGATTTG
GTATATCATAAACTCCACTATAATCATAAGCTCCATTAGTTTTAACAGTTACTAAGGCGT
TACTTCCACTAGAAAGATCTACACTAGATGAATTAAAATCAGAAGGTCTTGTAGATAATA
AAGCATCATTATCATTATATACTGTATCATCTCCTATTAAATTTAAACCTATTTTATTAT
TTTCTCTATCAATAACTTCAACCCCATAAGGTTTAAGGTACTCATCATCTCCTTTAAGTT
TTATCTTGAAATTACTAACTACTACTGTATCACCAGATGAATAATTAGAGTTATTAGTTG
TCGCAGATATTCTTACAGATATTTTTTTATTGTTTAAAGAACTAACATCAGTGTAAGGT
ATTAATGGAGTATTACTAATATTATATGCTACATTATCTGTAATATTTTATCTAGGTAT
TCTTTATGTATTAGTTGTTTGTTGTCTGTAATTCTTTCATTTTCTATATTCATATACACT
TTATTATTAAAAGTAGTTATACCATTTATAGATTGATGTGCTTCAGATGTTAGAACTTTT
AATGGTTTCAATGATTTTTCTACTAAATTATATACTGATCCACTTTCAGTCCCATCTCTT
CCTGTTACATTCATACCTGTAGATACAAGGAAATTAATAACATCGTTTGTATTTTTCTT
AGGTGCATAACTAATGATCCTGCAAAAGTAGGAGCACCTATTTGTATAGTATCAGCTTTA
ACAGAACTTCCTATTTGAGCAATGTTATTTAAATGGACAATCCATATCTAGATTTGAA
CCCATATAGTAATCATAGCATAAATCAGATACAGAACCCAATATTCTAACATAGCTCCA
TACCCGTATTTAGAAGAATATTGCTTAGCAGTTGAAAATGATATCTCTAATAATATTTCA
TTTTCTGCTACTTCATAAGATTCTAATGTTGATACGCTATCGGAATAAGTTACATTTGTT
TTACTGTTATCAGAAGTGAGAACTGCAATAACTTTAGTTCCACTAGTTGTATTAAAAGCA
TTTGAAGATACTTTATAAGCTTTATATGTAATATCTCTTATAGTATCTTTTATATTAACA
TACCCACAATATCCTGTTCCATAACTTGCACTACCACTAAATGAAACATCTATGTAATCT
CCATTTTCTAGTGCTATAGGACTCTCATCAAACATAGATTGCAACATGTTATTTATTGTT
TGATTAAGTTCTTTGAGTCTTACAAGTTGTAATTCCATACTTGCAGGCTTTAAAGAACAT
ATATTATTTTCTAATAAATGTATTGATTTAATTGCTTGAGATATATTACTATACAGAATA
TCTCCTGCAATTTTGCTGACAGGAGTATGAATATAAGTCATATCCGCAGATTCATATGTA
TTTTCTACAGGATCTAGTGTATCTGTTTTTACAGTTAATTTTTCAGAACCATTTGTAGTC
ATAGATATACTTACAATATCTGGAGTATTGATACCAAGTTTATCTATTTTTATAGATACT
TTTCTATTATTTGTTATATCATTTTGACTTCCAGTATAATAATCATATATTAAGTCTCCG
TCTTTTTTATTAGCGTTTCTAGCAAACATAGCTCCATAACCATATCCACTAGAATAAACA
GATATAGTATCATAAGATAGTATAACTCTAACTTCTCCTTCTTTAAGCTCATATTGTTTA
AGCTCATCAACTGTTTTAGTAATATCAAACTTAACATCTATATTTTTTGTATAATCAGTT
CTAGAAAGTATAACAACCATTTCTTTTGAAGGATTTTCTGTAAATGATGTTTTATCTGCC
ATTATAGCTTTATATTCATTGCCTACTATATCTTTAGGAATACATTTTTTAATTGTTGT
GCAGAATATGATACTGGATTTGCATATCCAAAAGTTATTTCTGTAACAGAACTTTGTGTA
AGTGCTGTATGATCAGGAAGTTTTATACCTCCAGGATTATCTAAAATGTATCCCAAATTA
ACTGCATGATTTCTTTCAGAAGGAACAGATTCTAGTAAAATATGATCTACATAAGTTTGA
TCACCTGTAAATGTATTTGATTTATTGGTTTTAGCTGTTGTTTTTAAACTTATCATCTACA
CTATTTATAGCATTAACTAAATTATCTTTAGAAACTTCATTATTTAATGAATTTAAATCA
CCAATAACAGATTCAACTTTGTCATTTATTTGTTTTGTTGTCCAGCTCAAAATAGCCACA
TCATCAGAATCAACAGGTGTTAATGCTTTTAATTTTCCTGTGAATTTTTTAATACCATTT
ATTGCTACTTGGTCTGAAGTTATATCAACAAATTTACTAGCATCAAAAGATTTACCTAAA
TCATACCAAGTTTTACCATTCCATATATACATATATCCAGTATCTTCAGCATACCATACA
TCACCTATCTTTTTATCAACAATGGCTTCTATTTCTGTATATGTAGATTTTGATCCTTTA
TATGAAAATACATTAGATAGTAGATCTTTAACTTCTTTTATGTTATTGTCAAACTGTTTC
TTTCTAATAACATGATTATCTAGTGTTGCATCTACTTCTACTGAAGGTGCTTCTGTAAAA
GTATTAGCTTTTGTAAAAATATTAACTGCATCTTTCTTTGCATAATCAGTTAAATCAATT
TCAGGTGGTACTATTTCGTCTATTTTATCATCTATCTCTTGTTTAGTATATGTTTCTTCT
TTTGTAGCAAATTTATCCAAATTTAAATCTGTTATATCAGCTACAACATGTGTATGAATT
TTATCTGCTTTCTGATCCAATAAATTATTTGTTTCTGGTTTTGTGTAATAGTTAGATAAA
TCAGGATTATCTGGATCAATTGGAGGTCAGGCTTAAATACAACATCATCACCACCGAAA
AAATCAGGATGCATCATAGCTATTTCGGCTGGATATGTAACTCCTGGTGATAACAAAATA
GCATATAGATCATCAGTACTAACCCATCTAGGTTCTTTTAATAAACATACAAAAAAGTCT
TGTGTAGGCTCTCTTTTTGGTTCTATCATAATACAGTCCTATAATATCTAATTTATAGAT
ATTTATAAGACTGTTAATAGTTATTACATCCAATCATCAAATAAAGAAGTACCCATGTTA
CTGTTAAATGAAGCTATACTATCACTGTGTTTTTACAATTATATTTAAGAAAAATTTA
AGAAGATTATTAAGATCTATTGTTGGCTTTTCCAAATTATATTGTTCTATAATGCTTGCT
TTAATGTTGTCAGGTATTTCTCTAAAATCAATTAATGTTTATTTCTGACAAAATTATCA
TAAACAAGCTTGTTTTTTTCAAGATTTTCATTTAAGTTTTCTAAAAATCTCTTAGCCCCT
ACTTCACCAAAATAAGCTGGTTTAAAAGGTGATTTTTCAGACTGCTTAGAATATAAATCA
TATAATGTTTTGATATTTCTAATTTATTGAAATCATTTACATCTGTTTCAAAAATACCA
TTATTTTCAAGAAACTTTATAAAGTCAGGTGTGAAAGTTGTGCCTTCCATTATTGATGGA
ATATTATCTGCTTTGTCACCAAGCAAAATATGCATAGTTAATGTTTTTGTTATTTCTGAC
TCTTCTATGTTTCTAAAGAACTCTTTTTTGATAGGTTTAAACAAAGTTATATGTTTATTT
ATTAACAATTGCATAAAATCTTTATCTTCAGAAACAACTAATACAGGTTAACAGTATGA
TTTGCTAATACAGCAATAATGTCATCACCTTCAGCACCTTTTACTCTTAAAACTTTATAT
```

FIG. 13P. Continuation of (CJLB-10 [organism=Campylobacter phage CJLB-10] complete genome)

```
GGTAGTGACTTTTTAATAACATCAATAATCTCATTAATAGCTGGAAATACTTCGTTTTCC
CAATCAAAAACATCCGATAACTTTCTGTTTGTCTTATATTCAGGATAATATGACTTTCTC
CATGAATTAGATCCTTCCAAAGCAAGGACAATTTCATTTCCATAATCTCTTGCATACTCT
GTTTGGACTAATTTTAAATAATTAAATACTAAATGCACAAACATACCATGATATTTTTCA
AAACTAAGTTTCTGTTTGCTATACATATCTTTTCCAACAGCTACATATAAACTTTTAAAA
GCTAAATGCATAAAATCAATTAAAACCATTTATAGCCCCTTTCTTATGTTTTTCTTTTCG
TGTATATTTTGTTTTATTTTAATAAATCTTGTCTGTAGATTTATTTCCCTTTTAAATGA
CTTTATAATGGATTCATCTCGTTTCATTTATCCTCCCTCCTTTAAACATATTTAAAATT
TCTTCTTGTTTTCTTTAGGTAGAATGCTACAATACTGTTTGGCTACATTAAAAGATATA
TTATAGTATTTGCTAACAGCTTCTTCGTATTCATTTAGTTTATCCTCTTTTGGAGGTCTA
CCCATATAAGTTACCTTATTCATTATTGAGCGTGCAAACCAATACTGAACATTTATAGGT
ATATCGGTATGATTGTTAATAAAATTAGCAAACTCAACAGAATGAATATCATTACTCATC
CATCTACATAACATAAACGAATTTAATAAATTCATTTCATTTTTGTTAGGTATAAAGTCT
TTTTTATACGCAGAAACCATAACCTCATATTGTGAATGTGTTATATTCATTTATTTTCCT
TAAATGCTACAATTATTTTTACAATTGTAGCATTTTATACCTTAAAGATTATTTAACCAG
TCATCATCCTGATTATTTTCTTGTTTAGGTTTTTGTTGTTGAACCACTTGTTGAGGTTGT
GGTTTTGATTCTTGTGTTTCAAATGGTGGGTTATCATTTGTTTTTTCAACCACTGATGGA
ACACTTGAAGTTTTAGTGCCAAAAGGATTTTTAAACCTTTCTAGTTTTTCTTTTAATTCT
TCATAAGAAGGAAAATACTCAGGTTTTGTAAACTCACTTAAATCGTAAGTTTTGTTAAGA
ATTATGTCTATAATATCTTCATTTTTTCTAACCCGCCTAACTTTGAAGGTGATGGTGCT
AAACTTGTGTTATCATAGTTGAAGAAACCTGATTGTGGATCTTTTTAATAGTTAGCTCT
ATATTATAACCATTTATAGGGTTATATAGTTCTTTTCTGTATGTCCTAGAGACCTTTGT
GTTTCATCTGGATTCATCCAAGCTAGGAACTTTTCTTTTAACTTACTTCCAAATTCAAAT
AGAAACACTTTACCTTCATTTTCAGGATTAGCTGGATCTTTTACAACTAAAATGTTAGTG
TAGTATTTTACCTTTCTACCATATAGTGATCTTGCCAGTTTTTCATCACCACTATTTAAT
ACTTCAAAATACTCTTCTTGAATAGGACAAGGTAATCCAATTGTACTTGGACTATTTGCT
ATTAACCAGCGATCTTTGCCACCTACATTCTTTTTAGAGTTATAGTGATATATGTGAACG
AATGGTGTTTATGTTATCTGTTATTAGTCTAATAACAGCTGCTCCACTGCCCTCTTTA
TTTTTTGATAATTTCCAAAATCTATTATCAATATAACTTTTTTGGCCAATATTTTGTGGC
ATTTTTTGCATTAAATCTGCACCTGAAAATCCTGTTAAAATGTCAAATTCATTCATAATA
ATTTCCTTTAAAAATAGCTGAAAATAAGATTAATAAATTAATCAACAATAGCCAAAAATC
CCATATCTTTTAGATATACGAAATTATATAATATTTATCCTTAAAATCAACTTAATTTAA
TCCAAACACCCTGACCACAATCCCATACTTTATGATATCCATTTTCCACCATGTTCTCTG
CTTCAGTCAAGTTTGGATTAAACTTCTCTAGTTTATCTTTGAGTTTGTGTTTCATGAATT
GTTGTCTTGAATATGTTCTATTATTCTTAAAATAAAAGTAACCTGGTTTTGAGTAGTGAC
TAAATGTAAATCCTAGCTTTTTGTATATCTCACCATTTGAATAAAGTCTATCAGAGTAAC
TAATAAGACTTCCTTTATTATGTCTATGGAAGTAACTAAGTAATTTAGAAGCACCACCTA
TTACATTTAGTCCCATTTTTGTGCATAATCTTATTAATTCCCAGTCATATTTATTAGTGA
ATCTTGGCTTACCAAAACTCATTAAACAAACTAGTTCATCTTGGTAATAGAATCCATAAC
ATACAGTTGATCCAGTAAATCCTTGGAGATGATTTTCATTCAAAAATTCTTTTTCCTCTG
TCTTAGGTACTTCTTTAATAACACATTTCCTAGCCATTATCTTCTTAGACTTTCCTAGTT
TATTATTAATAATACTAGTCCAAATATTTTTCTTTTCAATCCAAGAGTGTTCAAAAATAT
GGAGTAACTGTATCCCTTTTTCATTGCATCTCTCTGTTTTATCCAAATGGTAGTTCTTAT
CTTTCCCATTACTTTCAGAATGCCAGTAGTCTCCATTACATTCTATGGCTAAGTTATGTT
CTGGTAAATAGAAGTCTAGCTCTTTATCACCTAATATTGAGTAATCATTGTTTATGTAAT
TACCTAATATCTTTGACATTTCTTTTTCAAATGAGCTTGTACTTGGATAACATATTGGGC
ATAAAGTTACACCCCTTTTAAAATTATCAAATGCTCGCTTAAAAATATGCCCATTTGGGC
ATATTACTTCAAGATTATCTAACTAAGTCTTCAGAAACAACTTTATAGCCAAGACTGTTT
ATAAAAAGTAGTTTTCTTTGTTTTTCACATTCATTACAAATTTGTATAACCTTTTTTGAA
GTCGCCAAATGCTCGTTTAAAAACATGCCCATTTTTACATTTACTTCTAAATTATTTCC
TAAATTGTCTGAGATGACTTCATATCCTAAATTGTTTAAATACTCTAGTTTCTCTTGCTT
CTCACATGTAGTACAAATAATAATACCACTTTCGAATACTTTATATGGTCTTTTAAAAAT
ATGACCATTTTGACATTCTACTGTTAAATCATTATTTAACTCTTTAGAAACAACTTTATA
GCCAAGACTGTTTATAAAAAGTAGTTTTCTTTGTTTTTCACATTCATTACAAGTTAATTG
ACCTTTTTTAAAATTGTTTAAAGTTCGTTTAAAAACATGTCCATTTTTACATTTTACTTC
TAAGTTATTTGATAAATTTTCTGAAATAACCTCATAACCTAATTTATTTAAATGTTTAAC
ATTTTCCTGTCGTTCACACTCAGGGCAAGCTGTTGAACCACTTTTAAACCTGCTAAAGGA
TCTTTTAAAAATATGCCCATTTTTACATTTTACTTCTAAATCATGACCTAAACTATCCGA
TATAGTTTCATACCCAAGATCATTTAAAAATTCTATTTGTCATTAACTGTCATAATAAT
ATTATATAATATTTATCCTTAAAATCAACTTAAAACATTTTTCGATTTTTACGATATATTT
TTAGATTTTGATTTTTATAGTTTTGAATTGCTTTTGCATATAACTTATCAGCAGAATAT
CCACCACTAAATGATTCAGCTCTTAATCTAGCAGCTACCAACCATAAGTCTTGTGGAATT
ATAATACCTTTCTTGATATTCTTTCTTAATATATAATCTTATAACTGGTCCTAAATGC
AGTGCAGATAAAGTGGTTTAACCATTTTATATGTTATTTTTAATTGTTTATTTTTTGA
ATTGCAGCTTTATTCATTTTAAACAATATTTTTATCAAAGCTATACGAAGTGGTACTGGA
GTCCAATGTAAATTTAAACCTAAAACATAACTTCTTGATGTACTTAATACTAAAATTAAA
```

FIG. 13Q. Continuation of (CJLB-10 [organism=Campylobacter phage CJLB-10] complete genome)

```
GGTGTTTTATCATATACCTCATCTTTAAACTTTGCATCATATTGCATAAAGATCATGTTG
CTAAATCTAAAGTCTTCTGCTTTAAAATTACGAGTGCCTTTTTCATTAGTTGTTTAACT
ATATCAAGGGCAGCTTTTTCCTGCTCTTTTGTAGTTTTTTCTTTTAAAGCGTCATCAACT
GTATCTTTTATTACTTTTTTGCCAGTGTTTATATTTTTTGCTTCTTCACTTATAGCTTGT
GTTTCTTTTGTCTTTTTTTGATAAGATGACACAAAACCAGGTTTTGTACTATCTACTATA
TTAGACTGATTAGAACCTGGCTTACTACTGGAAAAATAATTTGGCATGTTTATACTAATT
TTCGTAATCTAAATACAAATATCTTTTACTTGTCTATTTTCTTGCTTTTTCCAATTTTCG
TTCTTTTTATTTAATAAAAAATAACTTTAATCATTTTTTATCCTTTTTATAATTTATAAT
ATTATTTATATTTTAAAGCAAAATTATCCTATTCTGTTATATAATTCTTCCATTGTTATA
TCTTCAATAACACCTGTTTTTTTATTTCTAACTGTATTTTTGTGTCACCAGCTACACAT
TCATCAATAAAAATTAAATTGATACTAAGACCCCTAAAAGCATCTGGTGTAGTTGCACTA
ATGTATGCCTTACATCCTATTTCATTAACAAATGACTCTTTGTTATAAACTTTCACGGAT
GGCTTTAACCATATCGGTAAATCAGCATACATGTCCATTAGTCTTTGTAAGTTCTCAGCA
GCCATAGTAAATTTATTAGCACAAATACCAACAATGGTATCAGGGCAAAAACATAATTTC
CATAATATGTATAATAAAGTTGTAACAGATTTACCACTTTGTCTTCCTGCTAATCAACA
TTGAATCTATTTTCATAATATTGTTGTATTAATTCTTTTGATAATCTCTTAAGTCAGGA
TAAACTAAACCTTCATCAAGACTTCTTATTTTAACATAGCTTTCCACAAAATAGATAATA
TCTATACTACATTTTTGAATCTCTATTATATGTTCTTCTTTCAAAGGTAATTTAGTATTA
ATATATGAAAGTTGAGGATTATTACCATAGCTAACTTTCTGGTTACTAATATCTAAAAAA
TATCCGTTTTCATCCTGTGGCAACAGTTTATTTAAATAGCTTATTTTATCATCTTTTAAC
TGCTGAATATCTTCAACCATAAAATATAATCCTTATATTTTATCCAAATATATATTTTAA
TAAAGCTAACAAAGTAAATATAGGAATACATAACCAAACAGCACCCATAAAGGTTTTTGC
GTGGGTTTCAGCTAATTTTTCTAACTTTCTTTCTTCTTGGTAATGTTTTTGTATAAGGCT
AACATTATTAAAAATAACCATTTTCGTTATAGTACTCAAGTCTGTTAATTATAAACCTAA
CTTTTCCTTTAGATAAATTTAACTTAATTTCCTTGTCAGGTTTATTTATTGAATCTGCTC
CATAATTTCTAAACTCCCAATAAACATCTTCTGATATTTTAAAAGAATATGATTTAAAAT
TAGTCAATTCGTCTTCTAATAATTTTCTATAGAATTTATTTTCATAATCTATTGAAATTA
AATTTATTAGTAATTGTAATTCTAAATTACTTAGATCTTTCTTAGAGTTAAAAAGTAAGA
AATTGGCAAAATCTTTTGATTTTATTTTACTCATTATTACTCCTTTATAATATTTTTAAA
CAAAGTCTGCTTATGTAAGTCTGGCAAAGACTCATAAACTTTATTAGCTAATATTCTTAT
TTCATATAAAGCATGACTAGATGATCTTAACTCTAAGAAGTTTCTTAAACTTCTAGCATT
TATAGTCCAGTATAAATTTGTTCTAAATGCTTCTGGTAAAGCATATTTTACAACATCATT
ACTCTTATTTTGTTTTACTAATCTTAATAAATTATCCAAATTAGATAATATTTGTAAATT
AGATTCTAAATCTTCAGTCAAAACTACATATTTAGAAGCTCTATCAAGTCTTGTTCATA
TTTGAATCCTTCTTCATTTTTAGATGTTTTTTCAAAGTATATCTAGTACTCTCTACGCT
AAGACTTGCATGTCTATGCCTAGCTAACTCTTGGAGACACGCTCTACTAATACCTTTTAT
AAAAAAGTTATAATATACATGTTCTATTGTACTAAGGTGCTTGTGATGATTAACAATCCT
ATCTAATAATGCTTTATCTTGATTACCTAAAACTAATTTACCATTTTCATAAACACTGTC
TTTTTTGCATCCACTATCCCAACAAGTCCTTATAGCGTCTATTGTTATTCTAATGGTGT
ATGATGTAATAATTTTACTTCTATGTTTTTCATGAATTACAATCCTTCTTATTTTAAA
GTGAAAAAAACTCCAAATACAATTTTCTTTTAGTTATTTATAAATATTATTTTAAATTT
ATGTTATTGTATAACAAAACCGCTTAAAATTATCTTAAACTAACTAAGCAGAATTTAAGT
AAAAATTGTATATAATATTACTGAAATTGCTTGAAAGGACATTATGAATGTAACTGAAAA
GTTAAAGTTTTTAAATGATTTAGGATATGAAGTAGTGTCAGACAATTTAGGAAATAATTT
AGAAGTAAAATGTAAAAATGGGCATGTTTTTATAAAAGAATTAGGTTATGAAATTGTATC
GGATAACTTAGGTCCTGACCTTAGAAAGGAAAGTGAAAAAATGGGCATATATTTAAGCGA
GCATTTGATAATTTTAAGAACAATTTGTCAAAGAAATGAGAGAATAAATGACTATGTTAA
AAATGAGTTAGATTTCTATTAACCACACCATAATCCAGCAATAGAATGTAATGGAGACTA
CTGGCATTCAGAAAGTAATGGAAAAGAAAAAACCTATCATTTAGAAAAAAAACAATAAAT
TAGGAAAGTCAGAGAGAATAATGGCTAGAAAATGTATCCTAAAACAAGTATCTAAATCAG
AGGAAAAAGAATTTCTAAACAAAAATCATCTCCAAGGCTTCACTGGCAGTTCGATTTGTT
ATGGGCTATACTTTAATAATGAGTTAGTTTGTTTAATGTCATTTGGTAAACCAAGATTTA
CTAATAAATATGATTGGGAATTGATAAGATTATGCACTAAAGATGGGATTGAATGTAATA
GGTGGTGCCTCTAGGTTATTAAAACATTTTCATAAAAATAATAATGGGTCATTGATAAGC
TACTCAGATAGACTTTACTCTGATGGTAATATATACAAACAATTAGGATTCGAATTTAGC
CATTATTCTAAGCCAGGTTATTTTTATATTAAAGGTAGTAATAAATACTCTAGACAACAG
TTTATGAAACACAAACTTAAAGATAAATTAGAAATATTTGATCCAAACTTAACTGAATCA
GAGAATATGAAAGTAAATGGGTATCATAAAGTATGGGATTGTGGGCAAGGTGTCTGGGTA
AAGGACATTATGAATGTAATGATAAAATAAAGTTTTTAAATGATTTAGGATATGAAGTA
GTGTCAGATGATTTGTCCAAAAATCTTATAGTTAGATGTAAAAGCGGACACGAGTTTAAA
AGAAGGTTTTATGATTTTCAGCGTGGCACAATAATATGTATACAATGTGATCATAACTCT
AAATTATCTTATTTAAACTCATTAGGATATTCAGTAAAATCTAAACTAATAAACAATGAC
CTAGAAGTTATATGTAAAATGGCCATTCTTTTAAGCGTGCATGGAGTGAGTTTAAAAAT
GGAAATATAAGATGTGCAATGTGTTATGAACAGCACAAAATAGACTTTTAAACAAACTT
GGATACACAATACTCGATATTAATAAAATTAAAGTAAAATGTAAACATGGGCATGTTTTT
GATAGAGTATGGAGTCATTTTAACAGTGGAGTGGTAGAGTGTAAGCAATGTAAGAGTAAT
```

FIG. 13R. Continuation of (CJLB-10 [organism=Campylobacter phage CJLB-10] complete genome)

```
ACAAAAATAGAATATATGAAGCTTGCAGAGCTTGAACCGATTAGTAAAAATATAGCTGAT
GGTTTAAAACTAAAATGTAAAAATGGGCATGTTTTTAAAAGAACATTTAGTAATCTAAAG
AAATGTAATGTATGCCCTATATGCTACTCTAACATCAGCTCATTTGAAAAGGAAATAAAA
GAAATATTCCCAAAATGTATAGAAAATGACTACTCGATTCTAGGTGATAAAGAACTAGAC
TTCTACTTACCAGGACATAACTTAGCTATAGAATGTAATGGAGACTACTGGCATTCTGAG
CAAATGGGTAAAGATAAAGTTATCATTTAAGTAAAACAGAAAAGTGTAAAGAAAAAGGT
ATTCAGCTTTTACATATTTTTGAATCATCTTGGATTGAAAAGAAAAATATTTGGACTAGT
ATTATTAATAATAAACTAGGAAAGTCTAAGAAGATAATGGCTAGGAAATGTATTTTAAAA
GAAGTATCTAAAGCAGAAGAGAAAGAATTTCTTGATAGAAATCATCTCCAAGGATTTACT
GGTAGTTCTATTTGTTATGGACTCTATTACCAAGATGAGTTAGTTTGCCTAATGTCTTTT
GGAAAACCTAGATTCACAGATAAGTATGACTGGGAATTAATAAGATTATGCACAAAAATG
GGAATAAATGTTATAGGTGGTGCTTCTAAATTACTTAGTTATTTTCATAAACATAACACA
GGCTCATTAATAAGCTATTCAGATAGATTATATTCTAATGGATCAATTTATAAACAATTA
GGATTCGAATTTAGCCATTATTCAGCACCTGGATACTTTTATTGTAAAAACAAAATAAAG
TATTCAAGACAACAATTTATGAAGCATAAACTCAAGGATAAACTAGAAAAATTTGATCCA
AACTTGACTGAATCAGAGAATATGAGATTAAATGGGTATTATAGAGTGTGGGATTGTGGG
CAAGGTGTTTGGGTTAAAGGTAGCATTTGAGCTACCTTTAATATTTAAATTGAGCCTATT
GCTTCTTCAAAACTAATTGTAGCACCAACAGCGACGAAATTAAGTGTGATAAATTCTATT
GCATAAGTCGGTTTAATTAAGAAAGACGCAACAAACTGATTGTTGGATTTAACCAAAGGC
GTGTTATTGCTATCATCACATACCATTTTAAATGCATCTATACCGCGACCCGCTTGAACT
TGAGTTAATAACGGAGAACACATACTTACAAACATATTTTGAGTGTGAGTGTCATTTTGC
TCAAATACAACATATCTAGCTGAGTTAGCTATGTTTCTTTCAAGATAATTAAACAACATT
CTAACATTTACTCTATCAAATGCACTAGGTTTTTGAGTACAAGTTTTTTGTCCCCATAAA
CAAATTCCTAAACTTGGAAAGCTAACAACAGGATTTATAGCTCTTATACAAAAGATCT
CTTTGTCCATTATTAGGATTAAATGCCAGCTTGATAATATCTAAATATTGTCCTTGATTT
AAACCAGCTGCAGCAAACCATGGCTGTCTTGCTTGATTTGTATAAGCTCTTAATCCTGCT
GTTGCACCGGCTAAGTTGATCCATCTATATTTGTCATTATACTTATCATATATATAACCA
TAATTTCCTATAAATGAAAAATACTTATTATCAATATTCATTTCACCAGTGCTTCTATAC
TCTAAAAGATTTTTAACACAATCTTCAGCTTTTAAACCAACAACTTCACTAAATGGAACA
CCACCATAACCTATAACATCACCACGAGTTACACAAAAATCAGCACATTCTTTATTAGCC
ATTTCATTTGCAATAACAATATCAATGTCTATTTCTTCTTTTGAACTAAAATTATCTGTA
TAACCACTAATAATATCAGCTTTTGTTGGAGCTCCATCTTCACCAAATTTAAGTGTTATG
ATTTCAGAATCCAAAGCGGATTTTGGTAAATCAGTTATTGTAGTGTTATTTTTACAATAG
ACATAAGATGATTGTCTATTAATAACATCTTCAATATAATTAGATTTATTATTATAATCT
TTAGCGCCTTCTTTAATTGAAACCATATATGTTTCTTTTATTTCGTTGTTTTCTAATACA
ACTACAGCAACTTGATCTGTATCTGGAATATATTCAAAGTTATCATCTAATGGAATACCA
CTAATAATATTTTTCTTTGCTCCAAAATCAGCTTTTGTTGCAACTGCTACTTTGATATTA
TTTCCCCAAGAACCAACTGATTTAGCAATAAACTTTAATTTTGTTTCAGTATCACTAAAT
TTAATAGAAGGCTCTAAAGTTTCATAAACATCATTATTAGGAATTATTTTAAGAGTTTCT
TTTAGTTTGGCATCTGTTATAGTATTACTTAAACCAGTTTTTAAAACTTCACCTATTGCA
TTCATTGATGGGTGACAAATATAAATTTTTGAAGAATTACCAACACCATCACCTGTTTGT
ATTTCTGGAGTGAAAGTTATTTTAGTATTAGCTTGAATACTAGCAATAGTATAAACATTA
GCATCAGTTTTTTCACCAAACATAATTTGTTGGCCAATATATAAACCTGTTGTATCTGTT
AAAGCTATTTCTGTTGCTTTTTCACCTAATACAGCATTTATTGTTAAACCTGAATCTTTT
CTTGTAGATTTTCCAAGTTTATCAATAGCTCTTACAACATATAAACTACCTGCTCTTCTT
AAAAAACAATACGCTTGAAAAAAATCATTATAATTTGAGTTTGTAGGTTTTCCAAATACA
CTTTCAAGTGTTGGAATATCATTTATGAAAACTGCACCATCACATGGACCTTTTGGAAAA
ATACCACAAAACGCCCCAAAACTAGATGAAGCACTTGAAACCGTAAGAGATAAGTCAATT
TCTTTAACTTCTACACCTGGACTTAGTAAAGCCATTTTCTTTCCTTTAAATAAATCTCAA
AACAGTATATTTAAAATTTTTAAGTTTATTAAAGGAAATAAAATTAAACCTATATATTAC
TTAGTATAACTATCATCTTCTGAAACAGTTAGCAATATATAGTTATTTTAAATAAATACT
GTTTTCTAATATCTATTTATAAAAAGTTATCATAGGCAGATTCATTAATTATTTTGGAAT
ATAATATTGTTATGTTTAGTTTGGGCTCTTCTAAGTTATATAGTATATTTACTTGATATA
GTCTATCAAGTTTCATCTTAATGTTTACAGAGTTTTTACCCCAAGATGATATTTTTATAT
TTCTTGTAAAGCTAACAAGAAGTTCTGCTTTTATATCTTTTATAATTTTATCCCATGATT
CTGGGGATTCTTTAGTCCATAATAATATTTCTACATTATGTTCATCTTCTATTGGATTTT
GTTTAAAATAAATCCCACATTTTTTACCTATATTTAAAAGTATATTTAATAATTTAGTTT
CCATTTATCATATCCATATTATAAGTTCTTCTATTAATTTCACCATATGATTTATGAATT
GTTATAGAATTAATTGTACCAATTCCCCTTCTAAAGCCACTATTAGAAGCCCATTTATTT
AATGGTGCTAAATTTCTAAAACTCTCACATCTACATAATGGTGTATCTATTACTTTATCA
ACATGATAATGCCCAAAATATGCATATACATATTTAGAATGTACAAAGTTCTCTTTATTG
TCAAATGCAATAATTTGTCCCACATCTTTCATCTTTATGTTATCACCATGAGTAAAAGCC
ATTAATACATTTCCAAATGAGTGATATTTGATATTCATCAAAGACTCATCACAAATAACT
CTTTTATTACCAGCAAAATGTTCTTTTATAATATATTGAACAGCCATAGATGGTAATATA
TCGTGATTACCTGGAATATTGATATAGTACACATATTTATGTTTCCAAGTGCCTTATAG
ATCATGTTTATAATTGAATTATAAGCAACTGATAATATTTGTGGGAATTTTTTATCAACA
```

FIG. 13S. Continuation of (CJLB-10 [organism=Campylobacter phage CJLB-10] complete genome)

```
TCAAGTACATTCCCACTTCTTGGTGTTTTATGTGTAAAGTCATTAATATCAATTAAATCA
CCTAAATTACATATAATACACTCTTCTGTATTATCAGCACCACCACTTATTAACTCTGTTGAT
AATTGATCTAATGTTTTTGATGCTATATCTAAATTCCAATCACTGTCATTAGTTTCTTCT
TTTAAAGCTAACATACCAAAATGCATATCAGAAATATTGTAAAGCGTTAATGAATTAGTA
TCTAAAGATTTTAATTTAGATACATTCTTAAGTGAATATTTTTAAACTTTTTAGAAGCA
AGTTTTATACTTTCAATAACCTCTTCAGATGGTATTGATTTTGGTGCATTTTTTACCCAT
TGTAAAACAACCTTACCTTTGTCATTATATAATGTTGATGTATTCATATAAATCCTTTCA
AGTTTATATTATTTATATTTTGCTGATTTTCTTGCTCTAGTATTTTTTCAATATTATCT
GCTTCGTCTTTATCGTGTCTTAGCTCAATGAAAACAGGTAATATTAAAGAATATTTACCA
TTTTTTTCCATTGCTCTATGGGCTTCTACTGTAACAATTTTACCAATCATATTATTATTC
CAGAAGAAATCTCTATAACTTTCTTTAAAACCAGTTCCAACACATACTTCTAATAAACCT
TCATCGCTTTCACATACTAAAGCTCCTAATGTATTTTCACAAGATGTACCAGATTTACCA
CATTGATAACCCTTTATTCTTAAATCTACTTGAAACTTAATTTTTAATTTAAGCTGGTCA
TTTGATGTTTTGTCACCCCAAGTTGCAAATTTATTTTTAATAATAACACCTTCTTGGTCT
TGTGAAACAAGATTTTTATAATGTTCCATTATTTCTTCCATATTGTTTACCATATTATAT
ACAATTGGATATATAAACCCATTAGGTGTTTCAGTAGTTTTACGAACATTGTTAAATCGT
GTTTCATAAGGTATATTGCATTTTCTTTCCAGATAATCACTATAAGGAATACAATCCCAT
GCTTTTAAAATAACTTTATTTGACTCTTCTTCTGTTATAGTTTGGTTTGTTTCACTACTT
TTGTTAATAATACCATTTCCAATCTCTCTTGGAAATATGTTACCATTTTCAACACATAAT
AATTCACCCATTATTACACATTCACCAAGAGTATAATATATTAGCTGTTGTAAGTTTGAA
AAATCTCTTTTAAATTTATATTCTGTTCCTGCTCTAGATACAAACTGAATATTGTTTTTA
GTAACAATTACATTACAAAATTGACCATCTAGTTTTTCTTGAATATATGCAGGATATTTT
ATTTTTGATGATGTTTTTTCATTTAATAACGCACATCTCATATAAGGTGGTTTTTTTACA
AAATTAGGGATAGCACTATTGATTGTTTTAATACCTAAGTCAGCTTGAAGATTCTTTCTT
ATTACTTTTTGTAGAAGTAATTGATTTTCGTAATCTAATTGTTTTGCAAGTTTAATTACA
AAAGTTTCAGCATCATTACCTCTGTATATACCGTTTTGTAAATGGTCAAGTGATGATATT
ATATCGTCTAATATGCCATTACCTGTTTCAGATGGTAATTCAAAATCGGTTATTCCTAAT
CTAGTTTTTGGATTATATACTATATCTAAAAGTTTGATAAAACTTTGATTATCTTTATTA
TTTTTAATTATTGTAATTTTGCCTGCATCTGTATTCTCATTTTTTAAGCTGTTAATTATA
TCTACTAACATGCAATACCTTTCAATTTTATTGAAGGTATTGTATCATAAAACCCCTTAA
TTTTTACTTAAGTTTTTTTAGGGTTAAAGTTTTGGTTTGTTTATATTTTATAATTTTCGG
CTTAATTTTACCTCTCTTTAATGTAAGTCTAGAAGGTGTGGTAGCTATATCACCTGAAGT
TGTCATAAATTACCTTTATTTTGGTTTAAAGTATCAACAAAAATAATGAATTTGTCTATG
TTTTCCATAGAATTTGAATATACAATATATTTACCATCATCATTTAACTTCACTATTATA
CCTATATCATCATATTTTGATTGAAACTTAAGTGATAAATTGATATTATATTTTAATTTT
AATGTTTCAGATAAACTAACTGGTAGTTCTTTACTAAAATTTAAAAAAGACTTGTCAAAA
TTCTGATCTGTTACTTCAAATTGAAGATCTAAACTTGATTCATATAAATATTTAGTGTAC
ATTATTAATTAGCTCCTTTTTATGTTTTTTTATAAATATCTCAAAATTATACGCATAATA
ATCTTTATATTTAAATATAAAACCTTCAAAATTGTGTTTTATAAAAACAAATGGTTTTAT
ATTATCATATTTTACAACTAGCATAGGTAATTTATTTGATATCTCACAATCAGCTTCAAC
TTGTAATATCCATTTATCCCATTGTGCACATTCCTGGATAATTAAAGAGTTAAAAGATGG
TGCAGTTGCATAATGTTTACATTCAATGGTATATTTAAACTCAGATGGGCATATTATATC
ACCTGCGTAGAAAGTATGCTCATTTAAAACATTCATACCACGATAGCTGTTACTACCACC
AAACACAGAACCACTAGATATATTTCTTTGAAATGATTGAGCAACATTAAATACATCAGC
ATAATTATCTGATAACATTTTTGCAACTGTTCGTTCAAAAGTATTACCTTTAGACTTGCT
TTTATTAGCCATAAATAACCTTTTTAGGTTATTTATTTTTAAAATATTTTGCAAAACCA
GTATATGTATAATTAAAAAATATAGTTTCGTCTTTTGATACTAATATAAGTTTTGCATAT
TTTCTTAAGAACTTTGAAATCCCATCATATATTTCAGAATTACTGCCATATACTTTCTTA
TTGACTACATAATGTTTGATTTAAATAATGAACATTCACCACATTTAAAAACAGCGTCC
ATCTCTACTCTAATAGTTGGTAATTCTTTAGAAGGTGAAGCTAAGTATATAGTACCTGAA
ATATCTAAAACACCAGGAACTAATATTTTGCGATTTAATTTGTGTAGGTTTTTCGTAGAA
ACAACATTTGCTGATAACTCTTTTGAATTTATAAATTGTACTTTCATTTTCTGTCCTTTC
ATCTGGGATTCTTTAATCCCTAATTTTTATACCGTAATGTACCCAAAATAGACTTAAGAC
AACCTTAAAAGTACATGGGAAAAGGTGCAAACGCACCTTTTTTACCAATTTACTTTATTT
CCAAAAATATCATACCAGTCATTAGCATTTATTTCGTTATCATCAACAAATAATTTGCCT
TTTCGTTGGACAACATTAAACCCAAGACCATTTAGTCTAGCTCTAGTTGTTTGTGAATTA
TAACCTGCTAATGAATATTTTTCATCACCATTTTTATTTTAACAGCTATTAAATTATCG
TGTAATCTTACTTCTGTATTGCCTTTATCATCTACACTTACAACAGTATTCCCATCTTTG
ATTGGTTTACTATTATAAAAATATAATCCTATTTTCTTATCAATTTTTCTACTTTCATTT
ATTGAGTTATCATCTAAATCATCATCCTTCTAGATTATTATCTAAAATCTCAACCATCATCA
TCTGAATTGTCATCCACATCATCTATATCATCATCTAACTCAAGATTTAAAGTTTCAAAA
ACATCATCTATAAGAGTTTGTTCGTCTTCGGTAATATCTTCTCTTTCTATTAAGAAAGGT
GTAGTACCATTTACTAATATGATGCATACTTTTTCAAAAATTGATATAACATAATCTTTT
CCAACAACAGAACCCATTATATTTTCATCAGAGAATTCTTCCATGTTTTCTAAAGCATCT
TTTAAACCATTTATTTCTGACTCATTTATAGAAACTTTTCTTTTGATATATTTAAAATAT
CCTTTTTCTGCAGCTTCATTTAAAGTAATACCTTTGCTTTTATCCATATTTTTAGCCCTT
```

FIG. 13T. Continuation of (CJLB-10 [organism=Campylobacter phage CJLB-10] complete genome)

```
CTTTTAACTGCTTCATTTAATGTAATACCTTTTTTCATTTAACATCCTTTATATTTTGAT
TACTTTGTCGCCTGTACCAACAAACATTATATTTGTGATAATTTGATCAATTTTATTTTT
ATCTTTAGTTGTTTTTATTATATCTATAATTTTTTCTAGAGATGGTGATTTATATTTTAA
TTCACTAATAAGTTTAAGTGTCTTTTCCCTTTTAGTTTCTAAATCATTCTCATTCCATAT
GTTTTTAAATCATCTTTAGAAATTTGCTTTAGTTTGGCTTCATCTAACTTATTAAAAGC
ATTTTCTACTATAGGGTTCTTTTCACCGTCTTCTATATCTTTTGCAATTTGATCAGGTGT
TCCACCGTTATATAATGCTTGTGAATTAACATCTTTCCATTCTTCAGGAGTAAGTTCTTT
TTTATATTCTTTAATTACCCAAGTATCGCGATCAAATTGTTTCACATCGAAGTTGTCTTC
AAGCTCTTCTAACTTGTTAAATTTAGCATCACCACCATACATCACACAATAACCATGTCT
TAATAATTTTGAATACGCACTAGCTGGTGCCTTAATACCAACATCTAAACAGTTCCTGAT
AAGCTGTTGGATTTCTTCATATGTTACCATTATATTCCTTTTGATTAGATTTTCCAAATT
ATTTATAAAATTATACAACATTTTGGTTTAAATTTAACTTAACCAAAATATTTATAAATA
ATTATATGGATAAGATAGAGTATTTGAAATCATTAGGTTATAATTTATTGTCTGTTGAAG
GCTCTTATGTAAAAGTTGAATGTAAAAATAAACACATGTTTAGACGGGCTTTTGCATCAT
TTAAAATCAGAAATACACCATGTCCAGAATGTGAAATAGAAAATAGAAAACAATTTTTAG
ATAGCATAAATTATTCCCTTATTAGTATAAACGGTAGAAAAGTAGAAGTTAAATGCAAAA
CATGCAATACTATAATTTCAAAAGAATACTGTAATTTTAAGCAAGGTAAAATTACATGTA
ATTACTGTGAAACTAATAATAAAATAGAATATATACAATCACTAGGGTACAATGTTGTTG
ATTTTGAGTCAAGAGGATATATAAAAATACAATGTAAGCATAATCATATTTTCAGTAGAG
CATATAACTCACTAAAAATGGATTTATATCTTGTCCATATTGTGAACATGAGCAAAGAG
AAACATTTTTCAAATTCATAAATTTAGAATTAATAACTTTTGATAAAGGTAAGATAACTG
CTAAATGTAAGAAAAACCATATTTTTAATAGAACATATGGTTCATTCAAAAGAGGAAGTA
CATTATGCCCTATATGTTATCCAAAAAGTAGCTCATTTGAAAAGGAAGTAAAGAATATTC
TACCTAAAAATGTAATTGTAAATAACAGAACTGTATTAGATGGTAAAGAGCTAGATTTTT
ATCTGCCAGAATATAATCTAGCTATTGAGTGTAATGGAGACTATTGGCATTCTAAGCAAA
TGGGTAAGGATAAAAGTTATCATTTAGAAAAAAGTTTAAAGTGTATTAATAAAGGAATAT
ATCTAATTCATATATTTGAAAGTAAATGGTATTCTAACAAACAATTTTATATAAATTTAA
TAAAAAATCACATTAATGGTACAATTAAAAGATATCCTAATAAAGTTATATCTGATATTT
CTTGTGAAAATCAATTAATATTCCCAAACTAGGTTACAAGCTTATTGATAATGTTGAAC
CTAATTTTGAAATATTTCAGAACACACTAAAAGTATATAATTGCGGATATAATGTTTGGG
TTAAATCATTTTGACCCAAACACCTTGACCGCAGTCCCATCTTTATGATATCCATTAAT
ACTCATATTCTCTGCTTCAGTCAGGTTTGGATTAAATTTCTCTAGTTTGTCTTTGAGTTT
ATGCTTCATAAATTGTTGTCTGTCATAAATAATACCATTCTTAAAATAAAAATAACCTGG
TTTAGAGTAGTGACTAAATGTAAATCCTAGCTTTTTGTATATCTCACCATTAGAATATAG
TCTATCAGAGTAACTTATGAGACTTCCTTTATTATTTTTATGAAAGTAACTAAGTAATTT
AGAAGCACCACCTATTACATTTAGTCCCATTTTTGTGCATAATCTAATTAATTCCCAGTC
ATATTTGTCTGTAAATCTAGGTTTTCCAAATGACATTAAGCAAACTAACTCATCTTTATA
ATATAATCCATAACAAATGGAGCTACCAGTAAATCCTTGGAGATGATTGCTTTCTAGGAA
TTCTTTCTCTTCTGTTTTGGATACCTCTCTTAAAATACATTTCCTAGCCATTATTTTCTT
AGACTTTCCTAATTTATTACTAATAATACTAGTCCATATGTCTTTCTTTTCATTCCATGA
TGATTCGAATACATGTAATAACTGGATCCCCTTAGATTCACATTTCTCTGTTTTATCCAA
ATGATAACTATTATCTTTACCCATTGCTCAGAATGCCAGTAATCTCCATTACATTCTAT
AGCTAAGTTATGGTCTGGTAAATAGAAATCTAGTTCTTTGCCATCTAATATACTTCTATT
TCCTTTAATATAATTATTCAAATGTTTGATACTTCATTCTCAAATGAACTGTTAAAAGG
GTCACAAATAGGACATATCGTTTGTCCCTTTTTAAAATTACTATAAGTTCTATTAAAAAC
ATGCCCTTTATTGCATTTTACTTGTAAATTATCAGCCATGTTATCAGAAACTATTTCATA
TCCTAGCGTACTCAAATATGATATTTATTATCTTTTTCACATTCAAGGCAAATAGTGAT
ACCTTCTTTAAAGCTACCATAATTTCTTGTAAAAGTATGACCTTTTTTGCATTTTACAAT
TAGCTTATCTGATAAGTTTTCTGAGAGTATTTCATATCCTAAATTGTGTAAAAAGTTTAT
TTTTTCTTGCTTTTCACATTCTGGACAGTTTATTGAACCTTGTTAAATGTGATAAAATC
TCTTTTAAATGTGTGTCCATGTTTACATTGTACAACTAGATTTTTTGAAAGATTATTTGA
AATTACTGTATATTTTAAGTTCTCTAAGAATAATATTTTTTCTTGTTTTTCACATTCTGG
ACAGTTTGTAAAACCTTTTTTAAATGTATCAAAGTCTCTTTTAAAAGTATGTTTATTTTT
ACATTTAACTATCATACTCTTATTTAAATTATCTGTTATAATTTCATATCCTAAATTGTG
TAAAAGTTTATTTTTCCTTGTTCTTCACATTTAAGGCATCTAATAACACCTTTTTAAA
ATCACTAAATGGTCTTTTAAAAGTATGGCCATTTTTACATTCTACTTTTAAATGGTCAGC
TAAATTTTCAGAAATAACTTTGTATCCTAAATTATTTAAAAAAGTGTGTTTTTCTGTTTT
TTCACATACAGGGCATTTAGCACAACCTGTTTTGAAATAACTAAATGTTTCTTGAATAT
ATGACCATTTTTACATCTTACCTCTAAGTCATTTCCTAAACTGTTTGAAATAATTTCATA
TCCTAAATTATTCAATAATTCTATTTTTGCTTGAACTTCGCATTTAGGACAATTTACTCT
ACCTCTTTTAAAATCACTAAATGGTCTTTTAAAAATATGACCATTTTTACATTCTACTTC
TAAATCTTTTGACATACTCTGGGATATAGGTTTATATCCCAGGTCATTTAAAAATAATAC
TTTATCCATCTATATTATGAGCATGATTCGCATTCATGTTCTACACCATTATCTTTTTCA
GATTTAAAATAATATAAAGTTTTTAACCCTAATTGATGTGCATACATATGCAGTAGAGAT
AGTTTGTGAGAACTCTTTTGAATATAATTTAATTCACCATTAAATGTATAAGAATACATA
TTTACACTTTGACTCTGATCCAAAAATAATTGACGAACAGCTGCAGCTTTTATCAACATC
```

FIG. 13U. Continuation of (CJLB-10 [organism=Campylobacter phage CJLB-10] complete genome)

```
ATAGGATCACATTCCTGAGCTAACTTATAATATTGATTATATTCTTTAAACATAGGTGCT
AATGTTTTAATGTTTATATTTCCATCTTCTTTATATAAAAGCTTTTGAATAGGTTCTATA
CTTTCTGATGCATTTATACTTCTACCTGATGTTGCTGTTGGAGCTATGGCCATTAGTGCG
CAATTTCTCATCCCATACTTCTTAACATCTTCCATCAGTTTATTCCACTTGTTTTCATCA
GGTTTAAATTTTATCAATTTTTTTGCCTTTTTATTTCCTATTAAATAAGGATATAAACCT
TTGGCCCATTTTGTTTCATTAAAACCTTCTGCTCTTCCTTTTTCAATAGCTAACTGCATA
CTAGCTTTTACACAATTATATAATAATTCATCAAAAAGTTTTGCTTGAAATTCTAAACTT
TCTTGTGAATCAATAATAATTTTATGTTTTGCTAATAAAACAGCTAAGTTAGATACACCT
ATTCCTAAATAGCCGATATTTTTTATTAGCTGTTTGTGCATCTTTGACCATATAATAAGCC
AGATCAATTGTATTATCCATTGTACTTACTATATCATATATTAGATTATATTTTTCTGTA
TCATTTAATAAATCATACTCATGCAAGTTTATACTGGCAAGATTACATAATGCAATTTCA
CCATTTGTATAGGTTTTTACTACATTTATTTCATTCATCTCACTTCCTTTAATATTATTT
ATATTATATAATATTTTTACTTAGATTATCCTTAACCCAAACACCTTGCCCACAATCCCA
TACTTTATAATACCCATTTATACTCATATTCTCTGATTCAGTCAAGTTTGGATCAAATTT
CTCTAGTTTATCTTTGAGTTTATGTTTCATAAATTGTTGTCTTGAATATACTTGATTATT
TTTGAAGTAGGAATATCCTGGTTCTGAATAATGACTAAATTCGAATCCTAATTGTTTATA
AATTGAACCATCAGAATATAGCCTATCTGAATAACTTATCAATGACCCAGGATTATGTTT
GTGGAAATGTTTCAATAATTTAGAAGCACCACCTATAATGTTTAATCCTATTTTTGTGCA
TAATCTTATTAATTCCCAGTCATATTTATCTGTAAATCTAGGTTTTCCAAAAGACATTAG
GCAAACTAACTCATCTTGATAATAAAGTCCATAACAAATACCTGATCCAGTGAAGCCTTG
AAGATGATTTGTGTCCAGAAACTCTTTCTCTTCTTTTTTAGATACTTCTCTCAAAATACA
TTTCCTAGCCATTATTTTGTCTGATTTACCTAATTTATTATTAATAATACTAGTCCATAT
TTTTTTTTTCTGTACCATGAATGTTCAAAAATATGAAGCAACTGTATGTCTTTCTCTTT
ACACTTTCTGTTTTATTTAAGTGATAATTTTTATCTTTAAACTTATCTGAGTGCCAATA
AATACCATTACATTCAATAGCTAGTTTATAATTTGGAATATAAAAATCAAGCTCTTTATC
TCCCAAAATAGAGTAATCTTTTTCTATATAATTATCTAGTAAGTCAGATATTTCTTTTTC
AAATGAGCTAATAGAAGGGCTACATATTGGGCATATTTTAGCACCTTTTTTGAAGTTATG
ATAAGACCGTTTTATAATATGACCGTTTTTGCATATAACTTCTAAATCATCAGCTGTATT
ATCTGAAATTATTGAAAATCCAATATTGTCCAAATAGTTTGATTTATTTTGCTCACTACA
CATAACACATATTGAAATACCATTTTTAAAATGCTCATATCTTCTTTTAAAAGTATGTCC
ATTTTTACACATCACTTCCAAATTGTTACCCAAATTACTAGATATAGGTGTATAACCAAG
ATTATTTAAAAAAGATATTTTTTCTTGCCTTTCACATGCTGGACAGTGTATAGTACCTCG
CTTAAAATTACCAAGACTTCGTTTGAATTTGTGCCCATTTTTGCATTGTACTTCTAAATT
ACCTGCTAAATTAGATGATACAGGTGTATATCCAAGTGATTTAAGATATTCTATTCTATC
CATTAATAATCCATTATAATTTTTGGGGAGTATATAATAATGTAACTTAAGAGAGGCTTA
ATTAATGTGACTCGGACTTACAAAGTCCGAGTTATCTACTAAGAGATTATGTAGTTATTT
AAATTAACAGCAAATGTTCTGATGAATGCTTCTGGGTGTAATGGAGTAGCAACAACATCA
TATCTGTTATTTAAAATCATAGCAGGTTGCCCACTTACTGGATCTGTTAAATTTTGTTGT
AATGTAATGTTATATGGTGCAAAGAAAATACCAGCATCAAAGTTTGATGCTCCTTTGTAA
GCAACAGTACAATAATCAAATTCAGCAAAGTTATCAACAATTACATCGTAACGATTATCG
AATTTACCAACATTTGGTTTAATACCACTGTTAATAGCATCAATCTTACTTCCTGCTGGA
GATAAAACAAATGATCCGATTTCGTCAAGAATTGTAGCAACTTTTGGAGAAACGATTAAT
TTATTACCACCACCTTTTCTAGTTTGGCGACCGATTTCTCTAGCTTCATTGCTAATTCTC
ATACTTAAACCTCTTGCTTTTTCAATAAACCATCTACCATCTGCACTATTAACATCAAAA
TCAGTACATACAGTAGCAACTTCATTTGCTTTTTCAATGATAGTTCTGTCAATTTCAAGA
GCAACTTCTGCACTTAAAATGTCAGCTAGTTCTTTTTCAGCATTTATTCCGTGTTGTGCT
TTTAAGTCTTGTAACATTTCAATAGTATAAGTACCTTTTACTTTTCTAGTTTTAGCTTCA
GCTAACACTCTTTGAACACTAATACCCATTTCTTTCATGTCTTTACCAAGAGCTTCACCA
GCTGCTGTTGCATAAGGACCAGTATAGTTTTTAAGAACTTTTAACCATAAAGCTTCATTT
GTATATACAGCCTCAACAGTTGCTTTTTTAGTAGCAAATGAAGCTGCTTTATCCATTTCA
TCACCAATAGCAACAGAACCAGTTGAGTTAGATTCTAAGCGAAGTAATACATTTACCACA
TCATCTGTACCTGCTTGTTTCTCACTATATACTATTTTACCTTTAACAGTTGTAGCTGTC
TTAAATGAAACTTCAATAGGAGTTCCAGTATAATTAAAGTCATTTTTATTTCCAGATTCT
GTTTTAAGTTTTAAAACAATAGCATTTTTTGTTGGACTAACACTATTATTACCATCACCT
ACATAGTGTGGAACCATTGCATACAAATAAGCAGTTGGAGTTTAAGTGCTTGAACACCA
GCTATTTCAGTACCAATCAAACTAGGTAATGCTCTACGAATTACTGGAACTAAGATTGGT
GTAAATTTTGCAATATCACCAGTTACAGTGCTTTCCATAAGCATTTTTACTTCGTTTCCT
TGGTTTTCAAGCACAGTTCTCATTATATTTTTCTCAGATTCATTGAGATTAGGGTATAAG
TTGCTTGTAATAAATTTTTCTTTTGTTGATTCATCTAACAAATATTTGTCAGCCATAGTA
TTTTTCTCCTTTGGTTAATATGTATTATTTATAAAAAATTACCATAAGTGGTATTATTT
GTGACTCAGAAAGTTGTTGCTTTCCACCTATACTTTTCCTGCTAATAGTTTTTGATTTTA
GTTCTAGTTTATTGGCAATAGATTTAAGGTTTGATTCATAAGAAATATCACCAGTATATG
CTACACTTTCAGCAAGTGTATCAAACATATCTCTATTTCCAATGCTTACTGTATTTCTTA
TATTGTTATATATATTATTTTTTGAGCCTCTTCTAGTTTCATCTGAAGTTTTTTATTTT
TTTCTTCTAATTTTTTAACATTTTTTCTTTTTTAACACTTTCATTAATTCTTTCAATG
CATTTATAGGACCACCTACTTTATCAGCTGTTCTAGCACATGCATCAACTACTTTTTTGT
```

FIG. 13V. Continuation of (CJLB-10 [organism=Campylobacter phage CJLB-10] complete genome)

```
TACTACTTTCAACTAGTGTTTCAAGGTTCATTGATCCTTTTTTAACAAATTCATCAACTT
TATCCTTAATAATATTTTCAACTAGCTTATTGTAATGTTTTTTTACTCTATTAATGGCAT
TATGTATAACTTTTTGGTTATTTTTATTAACCTGTTGTTTATACATTTCAGCACTTTCTT
TTAGCATTTTAACTTGTTTTTCATAATGTTTATCAACTTCAACTGCGTGAATATCAGCGA
TTTTTAAAGCAGCTTCAACTTTATTATCAACAGCTGCTTCAAATAATTCTTTTATTTCAC
CAACAACTTCAGGTGTAAAAACATTTTTATCAAGTTTACTTAAAAGTTCTTCCATGATAA
TTCCTTTATAATTGTGAAAATAAATCGACAAACTGAGAAGTTATACTCTTGTTATTTATA
TTACTTTCATCTGCCTCTACAAGTATACCATTTTTATCTTTAATATAATTTTTATCTTTT
AATATACCATTATCAAAAGATTCATTTAGACCTTTAGTATGTGCATTTCTATCAGACGGA
TTTGGCACTATATCAAATGTAATTAATTCATATTCTGTAACTGTTCCATTCATTAGCTCA
CCACAACCCCTGCTAGAAACACCTATTGATATACCTTCATCAATTAGGTTCTTTAGTTGA
TTTGCTTTTGGGTTATCAAGCAATTTTGCTTTCCCCATAACATAATCACCTTCAATTCTA
AGATCTACTATTTTTGCTACAGCTTCAAGTGGATCAACATATTGTCTATTTGGATGTTGA
TATTCCATTAAAGAACTTGTAGTAGGGGTAGTTATATGATGCTGGTATGAATTAACAGCA
CTTTCCCAAATAGGTCTTGGATATACTCTACCATTTATATTTGCTGATTTATAGTTGCA
AATATACCTTGTATATAATAATTTTTTTCACCTCTAGGTTAGTTCTACTGAACCT
TTTATTTTTACCGGTTCTTCTATAATTAGTTTCATTTATACTCCTTTAATACTTTAATTA
AAGCTTCATTTTCTTAATAGTTTCAATGTGATTTACAACTTTTGGATGATTATTATATT
CTTGTTGAAGCTTTTTTTGAATTACATTAGAAAGTCCATCCATGTCTTTTCTTTCAACAT
ATTTTACATAATTATACATTTATTCTCCTTTTATTAATTTTGTAGCTTTTTTAATTTTTT
GATTTATAATATTTTAGGTATACCTAATTTTGTAGCTTTTTTAATTATATTTCTTTTAT
TATCAGATATATCATCTTTAATTTTTAAGTTTTTACTTTCTATATTATCTAGAGAATCAT
CTTCAGGTTCATCTTCAATATCATTCTTAAAATTGTCTTCATCGTCTGTAATATCTTCAT
CGTCTGTGATTTCATTACCAAATTCATCTTCACCTGGAGTTGTTTGACTACCTTCTTGAA
GGATTTCCTCTCTCATTTGGTCTATTTCTTCATCAGTCATTTTTAAAACATTTTTTAGTA
AATATGATTTGCTAAATATATCACCTTCATATTCTTTAAATTCAGTATAAAGATCTAGCC
TCTGTTTTAATATATCTAAGTTTTGTCTTTCTAAGAAATTGGATTCTTTTTCCCAACCTA
TAAAAATATATTTTGAATAGTTATCAAATTCATCTTCTGTAAGAATATTATTTGTTATGG
CATATCGTTTCATAATTTCAATTAATAAAACATTAAATCTTTGTCTTAATCTGTTAATAA
AAGCAAAAAACTTAATCTCGGTTGATTCTATTGATGTTGAGCTAAAGTCAAATACAGTTT
TATTTTCACCCATTAATCGTGATGTTGGAACTTTTAAAGCATTATATAGTTTATTTTTAA
AATAATCTAAATCTCCAGTTTCACCTAAATTTCCAGTTTCATCTAAAACATCTACTTGAG
TTCCTTTTGTACCACCTCTATTTGGAAAATAATAATCCTCTACCATAGACTGGATTGATG
CACCATTTGATATACTACCGGTTTCTGTATTATAATATTTTTTATATTTAAATTTATTTT
TAATATCTTCAACGGCTGCAATTGCTTTTTCATACCCAAGATTACCGACATCAATATTAA
ACACTCTACGAGACACAGATCTTGAATATCTTAACGGTATCATAAGATCTTCTAATGTTT
GTAGTTGATTTACGATTTTTATAACACTATGCAAATGAGATAATATTAAATTATCAGAGT
ATAATCCTGAATCAATTCTTATAATTTCTTCTGGGTCATATACTTTAGAAGTGTCATCTG
TTACTCCATAATTATTGCTATTATTAAAATACTGCCATTTGTTTGTTGATTTATTAAAAT
ATAACCCTGATGGGTTCATTATAACTGCATCAAGTATATTATTGTTATCATCGTAAGATA
AACCTATTACTAGTTGCCCATCTATATAGAATCTTCTACACAAAACATCTATGTTTTCAT
TTAACTGCAATATTTCACATGACATATCAAATAATGATTGGAATGCTTCTTTCAAATTAT
CAGATAATATATTATCTTTAAACCCTAAATAGCAACAATCAATATTATTGGGTACAAATG
ACATTTCATTCGTTATTTCATCAATAGCATCTGCGACTTCAGGATATGCTGCTATTCTTC
TGTATTCTTTTATTAAGCTTGCTTGTTTTGATACATCACTACTATTATATCCGTCTCAAAT
TATTATATCTATAATTCCCTTCATCAAAATAACCTAATACAATATCATCTCTTGTAAGGT
TGGCTTCTTTATGTGGGTCATCTGATTTAATAGAACCTTCCTTATTTTCTACTTTTAGAA
AGGTTTTTTTGACAGATTCAACTAGACCATTAAACATATTTGCCATCAATTTCCTTTATA
AATAATATCAAATATTTATAAAGGATACTCATGACTAATATACCAAAACAAAATAAATTC
GCTTATACAGAAGATAAACCTAAATACATAGACATTAATGGTACAACTAACTATATTTTA
CCTGGATTTGAATATCCATCAGATGTAGCAGTTAAATTTCCACAGTTTTTTGGTGGTAAA
GATAATGTTTTTTACCCAGACTTACAAGTAACTTTAGCACCTGATAGTTTAACTTTTGAA
AACGGTAAAAAGTCACAAGCAATAACTTATACAGCTACCGATGGGTCATCAATTACATCA
GCTGTTGTAACAGTAGAACCAAGTGATTTAGCTACATGGAATGAAGGTGACAAAACATTT
ACGGGAAATGAAGAAGGTTCAGGTAAAGCTATATTTGAACTTACAGATGATAAAGGTAGA
ACAGCTATGAAAGAATTACCTTTAACTGTTACAAAAGCAACAGTAGTAACAACTTTAACT
CTTTCACCTAATAATTTAACTTTCGCTAATGCAAGTGCTCCAATGCAAGAAGTAACAGTT
ACAACTAATGCTTCAGATTTTATGTTAGAATTTAATAATCAAAATATACAAGCTGTTAAA
TCAGGTAATAAAATTCAAGTAACTCCAAAAACAGGTAAAACTGGATCATTTACAATCACA
GTTAAAGCACAAGCTGATGGTGGAAATCAAATATCAAAAACTCTTAATATAACTGTTAAT
ACAGGTGGTTGATAATGGCTACTAGACAAAGCCTCAAAGATTATATTTTGGCATGTTAG
GTTCCCCAGTTATTACTGTGGAACTTACTGATTTCCAAATAGATGAGAATATTAACTTTA
CTATACAAAAGTTTTCTGAGTTTGCTATGTATGGTAAATTAAAAGGCACACTATTAATTG
ACCTACCTAAAGGTGTGAGAAAAATTAAATTAGACCCTAAAATTTCTGAGGTTATAACAT
TACGAATATATCCAAGTGGCGGAGGTTTTTTAGGGGTTAAGTATTCCAGGTGGTTTAGTAA
TAACACCAACTGAAATGCAAGCAATGCTATTTGGTGGAACAGTACAAGGTAACTTTAGTA
```

FIG. 13W. Continuation of (CJLB-10 [organism=Campylobacter phage CJLB-10] complete genome)

```
TGCAAAACATATATTCTGTATTAGCAAATATGTCTATACTTGATACATATTTTACAATAA
TACCAAATTATGCTTTTAATCCATTTACAAATATGTTAGAGTTTTTTGAAGACATAAACT
CTGAAAAGGTTTTATTAGAAGTTAGATACAAGTATATACCAGAAGAAGAAGATGGGATAT
ACGAGCAACCATGGGTTAAAGAATATGCTTTAAACTTATGCAAAAGAACTTGGGGTTCAA
ATATAGGAAAATATGATGCACCGTTAATAGGTGGTATTAAAGCTAATTATGAAAGGATTA
TACAAGAAGCAAATACTGAATTAGAAAGATTAGAAACAGTATTACTAGAAAACTATTGTG
AACCACTTCCATTATTAAGAGGTTAATCCTCTTAATATGATAAAGGAGAAACATGTATGA
AGTACTAACACCAAATGGATTTAGTGATTTTGATGATATATCAAGAGAAAAAAAGATGT
ATATAAAGTAATAACAGAAGATGATTTTATAAAAGTAACAAAAGGTCATAAATTTGAAAC
ACCTAATGGTTTTAAACAATTAAAAACATCTTAAAATTAATGATTTGATAAAATATAAAAA
TAAGTTTTCAAAAATTGTTTCAATAGATTATGTTGGAGTAGAATATGTATATGACTTAAT
TAATGTACATAAAAATAACGAGTATTATACAAATCATTTTGTTTCACACAATTGTGCGTT
TATAGATAAATGGTCAGAATTTAGTAACTCTGTAATACCTACAATATCCGCATCTAAAAA
ATCACAAATAATAGCAGCTTCTACACCAGTAGGGTTAAATCATTGGTATAAAATGTGGTC
AGATGCTGTTGAAGGCAAGAGCTCATATAAACCTTTTAAAGTTGAATGGTGGAAAGTACC
AGGCAGAGATGAAAATTATAAAGAACTTATGATAAAAACTCTCGAGGGAGGTATTAGAAC
CTGGAACCAAGAGTATGCATGTGAATTTATAGGAAGTTCTGATACTCTTGTTGATATGAC
CGTTTTATCTAATATTAAATTTGGAAATATTTTAAGAGAACCAAATTTTGGTGAAACAAT
AAGAGTATATGAAGCCCCACAAATAAATCACAAATATATGGTTCTAGCTGATGCTGCAAA
AGGTGCAATAGATGGTTTTGTATTTCATGTAATAGATGTAACAAATATTCCTTTTAAACA
AGTAGCGTCAGGAAAAATACCAGATCTTATTTGATGGCACCACCTATTTTTTATAATAT
TTTAAGAACATATAATGAGGCTATGTTTGTATGTGAAAATAATGAGGGTGCTGGTACAAG
CGTGGTTGATTTACTATTCCAAATGTATGAATATGAAAATATATATCAAGAGCCAGATAA
AAAATGGTTAGGAGTCAGGACAACTAAAAGCAATAGAAGTAAAAATCTTAGTAACATGAA
ACTTTTTATTGAAAATAACAAACTAATATTACAAGATGAACCAACTGTTAAAGAGTTGCT
GACATTTGTAATGTTAATGGAAAATACCAAGCACAAAACTCAAAGGCCCATGATGATTA
TGTTATGGCATTAAGTCTTTTGTTTGTACCTTTGTTAGATTTAAATAATATAGTTGATTA
TAATGTATTTTTAAATAAAATAAACGGTGATTCTGAAACAACTGATGGTGATGTAAAATA
TTTACAAATGGGATTTTTGATGATGGTACTTCATCATTTACGGTATTTTGATGATTA
ATATAAATATCTTAAAAAAGGATTATTAAGATGCCACCTATTAAACATATGAGTGTAGCT
GATAGAATAGCACAAAAAAGATATAGAAAACAACCAAAAGTTAAAAGAAAACTAAAAATA
AGAGCTAAAAAAAACGCAAAAGCTCCTTCTGAAAATATGTCATGGTCTTCTAAAAAGAGA
GGATATGTTAGAAAAGATCCAAAACTAAGAAGAACCATGAAATTAGTAGCTAAATTAAGA
AGAAAGTCATAATAATGGGTTTAAACAAGTTTGATTCTGTTGATATGTTTTAAGTTCTG
GACAAAGACCTTTTAGATATAAAGTGTCATTAAATTTACCTGCTAAAATAACAAAAATAT
CAGGTGCGTTATATGACAATGCAGTTAATATATTATGCAAGGGTGCTACTTTACCAGCAC
CTTCTATATTAACTACACCTGTTGGTTTAGATGGTAGAACTATAAATATACCAACATTAA
TGAAACTTGATAACACTACAAATATGACATTTTTTATAGATGAAAAATCAAGTGTAAGGC
GTATATTAGAGTACTGGACTTTTTGTATTGATTCAGGTATAACCGCAAATGAAGAAACAC
CATCAGTTCCTGGTGCTGGTGTTGCTAATATTATAGGATCAGTTGCTAACATTGGAGCAG
GTTTTATATCTGATATTACAAGTGATATACCAATTGTTGGTAATGCTGTTAATAGTTTCC
TAGGTATAAATAAAGGTGTAAGTGGTAATACTGATATTAATATGACTGGTGAATTGAAAT
TAACCTTATTAAATTATAGTGGTAATGCTGTTGGAAGTTATACATATAAAAATATCTTTC
CTATTGATGTGACCGGAAGTGATATGCAAGATGATCAAACAGAAACAATTAATGAATTTA
GCGTAACATTTGGATATACACATTATGTATACAAAAAAGAAACAGAATCTATTATAGATG
CTGTTACAGGAATAGTGGGGTTATGATTTAACCCATACCCCTTGTCCACAATCCCATATT
TTATAATATCCATTAATACTCATATTCTCTGATTCAGTTAAGTTTGGATCAAATTTTTCT
AACTTATCTTTAAGTTTGTGTTTCATAAATTGTTGTCTATTGAGCGTTCTACCATTTTTT
GTATACATGTAGCCAGGTTTAGAAAAATGACTAAATTCGAATCCTAATTGTTTATAGATT
TCACCATTAGAATATAACCTATCAGAGTAACTTATTAATGACCCAGGGTTGTTTTATGA
AAATGTTTTAATAACCTAGAGGCACCACCTATTACATTCAATCCCATCTTAGTGCATAAT
CTTATCAATTCCCAATCATAACTATTAGTGAATCTTGGCTTACCAAAGCTCATTAGGCAC
ATTAACTCATCATTAAAATACAACCCATAACAAATGAACTACCAGTAAATCCTTGGAGA
TGATTTTTTCTAGAAACTCTTTCTCTTCTGCTTTAGATACTTGTTTTAGGATACATTTT
CTAGCCATTATTTTCTCAGACTTTCCTAATTTGTTGTTTATAATTGACTTCCATATATCT
TTTTTCTCTATCCAAGATGATTCGAATATATGTAAAAGCTGAATACCTTTCTCTTTACAC
TTTTCTGTTTATTTAAATGATAGTTTTTGTCTTTAAATTTATCTGAGTGCCAATAAACA
CCATTACATTCTATGGCTAAGTTATAGTCTGGTAAATAGAAATCTAATTCTTTATCACCT
AATACTGAGTAGTCATTTATAATATATGATGGGAGTATTTCTTTTAATTCTTTTTCAAAC
ATTGTATTATTTGGATAACACTCAGGACATAAATTATTTGATTTTATTAAATTATCATAA
GTTCTATAAAATGTATGTCCTTTGTTACATTTAAAAATATTTTTATCAACCATCTCTAAA
CTTATATTATTCAATAGCGATTTCTTATCATTTTCATCACAAAATTTACAAAATGTTATC
CCACTTTTTAGAGTTGGATAACTCTTTTTAACTATATTATTGCATTTGTTACATCTCATA
TGATTTACATCAATTTTTGTAAAACCACATGATTTAATAAATTCTAGTTTTTCTAATTCG
TCACATTCTGGGCATGATATTATACCCCTTTTAAAGTCTGCTTTATTTCTATTAAATATA
TGGTTATTTTTACATTGTATCTCTAATTTAGATAATCGTATATCCGTTACAACATAACCT
```

FIG. 13X. Continuation of (CJLB-10 [organism=Campylobacter phage CJLB-10] complete genome)

```
AAATTATTTAACTCTAATAATAATTTGTTATCATCACATGATAAACATTTATTGTACTTA
AGCATTTGGTTCCAACTTCTTTTTATATTAGAACCACATTTATCACATTTTACTTCTAAC
CCATAATTTAAATTAGAAGAAATGGGGGTGAATCCCCATTCTTTTAACATATTAATTTTA
TTTTGGTTCAACTCTAATAAGTTCATCAATACCAGCCTCTACATGGAAACTAGGTTCTAA
AATAGGAATATAATTCCATTTATTACTAAATGGTATTACTATTGTGCATTGACTACCTTT
TCTAATATTCCCAAAAATATCCCCTTGTTGATATAAATGGGTATTTGGTTCCCCTCTTGC
TGGAACCCATGCTGTTTGAATACAATTAATTTGCTCGTCAGCTATTTGAACTACAGCATA
TTTTTCTTGCAATACAGGTGAATATATAATATTTAATAACCTTTCGTTACAAAACATATA
ACCTAACTCTGTTACTGCTTTTTTAAAGTTATTTGCAAATAAACCTTCTTCAACAGCTAA
CATACTCTCATTATTATAGCTTTCTGTTGGTAATAATTTTTCGTATGTTAAAAAACCATC
TGTTGGAATACGATTATAATGAACATCATAATAAGTCATAAACACATCAATAACTAACGC
ACCACCACGCTCTTTTATTAAATTAAGCATTTCTTCGTTATTTCCTAACGCATTTCGTAA
GGTATATTTTTTCCCTTTTATTTTAAGGACTTCATCATCAATATCATTTACTTGGGTTTG
ATTAATTATAACACCATCAGCTGGGCTTTTAAAGGCACTTGAATTTTTTACAATTGCTCT
GTGTGGATTTCTATAGAACTGGGTTCTAAAAATTTCAAAGTCTTCAAAACTATCAGCCAT
GTTTTTTACATGTGTTCTGCACCATTCTTTTAACGATTTAGCCATTATCACTCCTTTATT
TTAATATTCCCATTAAAGACTCATCACGAATAAGCATATATTTTACTTTATCGTTTTTGT
GTAAGTCAATACCATGTTGTTTTCCAAAAACAACTGTATCACCTATTTCAATGTCTTTAA
CTTCTGATCCTATTTGTAATACTTTTCCTTGTGTTTGTCTATCATCAATAAGTGATGGAT
GGACAGTTACAATAATGCCACTTTCTGATTTTATCTCAGATGGATATGCAACTTCTAACA
AAACATCATGTGGATGAACAATTTTAAATGAATTTACATCAAAGTTATCCATAATCTTCC
TTTCATTAATTTTGCGTAAGTGTATAACACTTACGCTTAAAAACATCTTAATTTATTTCT
TTTATTTCAAAAACTATATTTTCAATACCTAATTCTTTTATTTTTGTAAATAGCTTATGT
GTTATATCTACACTACTACCAACTGTGCCATTATTTAAATCAGAACCTGGTAATATACAA
CCTTCAGTATGTTGTGGTGCATTTCCTGTATGGATACGAATAAGTCTATCATTAAATCCT
TCTACCTCATCAGAAACAACCCATATTGCAATATTTGATCCATTATCTGCTTTCCATTCT
GGATATTTTTTAGCTAATAATCCATTTTTACTTGAATTGCACCATTTTAATTTATACTCT
CTAGCTACTATTCTCCTTATCAGTTCCAGACTCATCAGTACTAGGACCTATATTTTCACAA
CTAGCACACTTAAAAATAACATTATCGTTATCATCTAATAATGATAATTCACCAATGGTA
GAACCTTCTATTTTATCACTATTTTGCCACTTTATACCTGTATATTCTTTATTTCTTTGT
AATATTAATTTTGCCATATTTAATCCTTATTGTTTGTTATTTCACTATAAAAATCATCTT
TTATGCCTTCTAATTCATCCATAAATCCATTTAATTGGATTATATTCATGGTATCATCAG
AAGTATTTTCTAATATATCAACATCATTATCTTCATTTATAAATTTAATAGGAACTACTC
CTAAATTAACACTAATATCACCTAGTGAACAATTTAACTTTATGAAATTACCACTATATT
CTGCGTTGATTCCGCTTATTTTTGGACACCAAAATTGAATATAAAACTTATCCTGCTGTG
GAAAATTATTTGAAAACTTTGGGTCTGTTTTTACTTCATGATAATCTTTAATAGTCGAAA
TTGTTATGATGCTATTATTATAAACTATTTCAAGATCATCTATTGAATAACCATAAGCAA
CAAATCTAATATAGACATTTGATTTAGACTTTTTTACATTATATGTAAAACCAGGAATAA
CTTCATTTAGTGGAAATACAACATTACTATAATACATTAATATCCTTGTAAGCTAGGATA
TTATTCCTAGCTATTTTTTAATTATTTCATCTTTTACTGATTCTATTTTATCACCAATTT
CAGAAGCTTTTCCTTATTGTTATGATAAACAAAATATCCAGCAACAAAACCTATTAATC
CGCCTGCAAAAAATGAAATCATAATTTCTACCATATTTCTCCTTAATGTTTTATACCGA
AATATTTATATCTTACTTAAATGTTTAATATATTGTAATGGCAGATAATAATTACCATTC
ATTTTTTATATCCTAGTTCTTTTAGAAAATTTGTAAATGAAAAGTAATCTGTTGTATAT
TTTATATTTTGTATGTCATTATATGTAAAAATATCTTTTAATCTAATATCTGGATATGTT
ACACAATATTTTAGAAACTTAGCTCTATGAGATAATTCAAGCAAATTAGATGGATTATTC
AGCAAATAGTTTTCCAGGAATTCATTTTTATTTTTATTTAGCGTATAAAATTTAAAATTG
CGAATATAATTAAATAATTTTTATCCTTTTTGATAGCACAAATCAATTCATCTTTAATT
TTACTATTTTCAAATTCATTTAACTCTATTTCCTTAGATATATCAGCTTGAACTATATTA
TAATTTACAATACTATCAACTATGTTTATATTACTAAACTGATCTTGTAATAATAAACAA
AATGACATCTTATGGTTTAATTCAATAGTTTCATAATAATAACATAATTTGTTATAAAAC
TCACTTAAATATTCTAAGTCATCGATTTCAAAAGAATCAATAATATTCTTTTCAACTTCA
AGTGGAGTAATCATATTTGTAGAACCTTCAACAAAAATATGAATATTCGATGCTAATCTT
GATCTTTTTACCATTTGAATAGATGTGATAGCATCTATACTAGCACTATTATCAAAGTGA
AAATGATGACTTATGTTATTCATAATAGAAACACCTACTGTAATGCTAGGCGAAAATAAA
ATACAATCATAATTAACATATTCTTTTTAAAATATTCTGTAAATATATTATCTCTAATG
AATCTGTTTGTATTACTGTTTATAGATATTACTTTTAAATTACTTTTAATTAAAAGACTC
TCAACCGTTTTAAACTCAGATAATGTAGAAAATGACATTGTAACAACTTCATTTCTATTT
TTGTTTTTACAAACATATTCTAATACTGAAAAGAATGTATTCTTTTTTGTATAAAGGCTA
ACATTTGTTTGGTCTTTATAATGGTTTTTTATTCTGCATACATCACTTAAAATATTAGAA
TGATCACTTAAAAATGCATCTAATATTAAAAGGTATTTTGAGTTTAATATATTATAGAAT
TTTCTAAGTATATTTAACGCATATGGTGAATCCTCTATACTAGTGACAATATACATTAGT
AATGTTTCAAACTCATCTAATATTACATAATCAAAGTAGTCTAGATTTATTTTATGTAAC
GAGTTTATTTGGCATACATAATTTTCACCATATAATATTTTTTATCTTCTAGATAATAT
TTACATCCATATTTAATGATATATCTTTTGCAAGAGTTTGCCTAACACTAATGAATAAT
ATTTTTGATTTATCTTTAATATATTGATTTATGACATTTGATTTACCACTACCCATAGGT
```

FIG. 13Y. Continuation of (CJLB-10 [organism=Campylobacter phage CJLB-10] complete genome)

```
GATTTAATACAAACTACTCTAGTATCAGGAATATCAATATTTTTCAGAAATTTTTGGTTT
ATGTGTATATCAGGTGTGTATTTAAGTGATGACAATATTATTTTACTTTGTTTTTCTTGT
AGAAATGCTTTACCATCTTTTGTTTTCAAATACTCTTGTAATATGTTTATATTTTTTGAT
GGGTTTGGATGAAATATAACAAAAGGGTTTGTTTCATACAAACAATATGAATATTTTGAC
TTTTTTTCTGAAGGCAAATTTATTGAATAATAACCAACATACTCTTTTATATTTCCTTTT
AACTTAGTTTTATATAATTTAAACACCATTCTACTTGTTTATTAGAACAGTTTATTGAT
GTTGTTTTAGATTGTGATTTTGGTAGAATTGAAAATGGGATACCTATATCGTTTTCATTC
TTGTAAAATACTGATACTTTTAAAGATGGTGCTTGATAACTAGAATGTCTTGTGGCTGAT
TCATCTATTGAACATAATCCTTTTAACTGTTCTTTAAAGAATAATAAAGTGTTTCTGATG
TTTTCGTCAGTAGATTTGTAGTCTATCTTGCATATAACTTTTAAATTGAAATTATCAACA
AAATTATATGACCTTGAATTACAAATTAAACACTCCCATTTTGTATTCTTAAAATAGTCA
ATTATTTTTGAAAATTACCTTTAGTAACTTTATCAAGATCGAGTATAATATACCCACAG
TCGTGCAAGTAATCCATGTTTTCTCGTTTTCTTTCAAACAATCCATTTGAATGAATAGGG
CGACTTAGAATAAAATTTGACTCAATAAGTTGTGCAAATGAGTTTATAGAAGGGCATATA
ACATTTCTAAAATTAACTTTATTATCAATATCAGTTTTTAATACTTTAGTTTTTGATGTG
TTGTCAATTACTGTAAATATATACTTCATAAATGCCCCTTCTATAAATTGTTATTGTACA
ATATTGTAGCTTAGATTTAACTTAATTATATATTAACAACTACCTCGTCTATAACATATT
GATTTTCATTATAATATTTTAATCTCTCTTCATAATGTTTAAACATATAGTTTTTCTTTG
CATATCTTCCTCTAGCGTCATCAACTATATCATACAAATATACAATATTATTTTTGGTTT
CATGTTTTCGTAGCATTCTCCCTATACTTTGATTAATTTTAATATAACTTTTACCAGGCA
TTGTGGATACAAGATTTTTTAATTTTCTAATATTAACCCCAGTACTCATAATAGAAGTAG
TACCAAAAATAATAGCATCATCACAACTTTCCATAATCTGTCTTATAGATTCTCTATCAC
TAGCTTTTGTTTCACCACTTACAAAAAATATGTTATATTTGTTTAATTTCGTAATTCAC
TAATTTCAACATCAACACCATGTTTTAATTTACACACTTTTCTAGCTAAGTTTTCACCAT
TAGAAACTCTTGTAAATAACACTATACTATTTCCTTTTTGTGAAACTTTGCATATTAGTT
TGGCTATAATGTCATCTCTTTCAGGTATTCCAAGAAAAAATGATACTTCTTGCTGGTAAT
TTTTAACGGTTCTAACTATAGAGCTTGTAGCATCATTATATTTTAGTATTATAGGTTTAA
TCTCCATTTCAGTAGCTAATCCCATATCAATTAACTCTCTTGGTGTAACATATGTTTTAG
CAGTACCTAAAACAGCCATTAAAGATAATTTATCACAATAATTTTGAGGTAATGTCCCCG
TAAATCCAAATCTGTACTTTGCGTTTGTAGCGGATGGAAATATTATACTTTCATGAACAT
CACTGGCAGCTGTATGACACTCATCTTCAACTATAACAGTTATATCTTTAAATAATGAAA
CATTTCTGTATAAACTTTGCCATGTTGATATATTTAACTTTTTTACAAAGGATACTACTT
TGAAATCACCACCCAGTCTATCAACATATTTGTCTATATCTGTAAAACCATATTCTTTAA
AATCAGAATACATTTGATTTAATAACACTACTGATGGAACTATTATCAAAATTTTGTCAT
CTGTATCTTTATATTTTCAATGAACCATCTACATAAAACGTAAATGGTTAATGATTTAC
CACTACCAGTTGCCATTACACATATATTGTTTCCAGTATTAATACTATCAAAAGCAGCTT
TTAATTGAAAATCATAAGGTTCAAAAGGTAGTTTAAGTGATTTTACAAACTTATTAAACT
CTTCTTCAGTAATTTTTTCTATTTCATCATCAAAAGATAACTCAAGTTTATATTTTTCAT
TTAATCGTTTTATAATACCCTTTATGAAACCTTTAGGGACAATTAGATAATCTCCACAAT
CTTTATAAAATATTTAACACCATCAGAATATCCCATCCTTACAGCTGGTAAGAATTGGG
CATTTGGTATTTTAGCTGAGCATAGTTGTTTTATTTCATCTAAATATAATTGTGTTTCAG
AAATTATTTGTAAGCTGATTCGTTTAGTTTTTCTATTTTTATCAATTCAAATCCTTTCA
ATTTTAAATAATTATATTCTTTAATTTACCCTTTACCATTTAAAAATTTTTCTATTTCAA
TATAATTTGATAAATCATATCTTGTTTGTTTAAATTATCTACACATTTTTCAATATATT
CCATTATTAATATAGCTGTTGATTTTTTTACACGAATATTACATAATTCATTGTCTTTAG
AAATTAAATCTTTAATTTCTGTAACTGTGTAATTAATATTAGAGTTTTCTCTATAATGTG
AATAAAGTATCATATATTTTTCATTATATTCTTCATCTATTTGTATTATAATATGTTTTA
ATCTACTCCAATAATTTAGATATTTAGCAATTGTACCTGATAATGTTGTTAAATGATGCT
TTATAGTTGATGGATTCCAGTTGAATCCATGTCATATTCTTCTATTATTTTTTATGAA
AATTTTTCAAATCATCTATTGTCATATCATTTACCTACTAGTTCAACTTTACAGTTTGTG
TTAAAATACGGTGTTAAATCACCCCATATTTTTCCTTTAACTATTAAAGGTTTTTATAA
TCTTTTATTTCAAAATTATATACAAATTCATTATCAGAATTTGTTACTTCACATATAATA
TTAATATAATAGTTTTCTTTTGTTTGTGCATACAAATATTTGGTACTTCCACAAATGTT
TCGTGACTATTTTTAATCTGTTCAGGTTTTATAATAATATTTTCTCTTATTTCGTTTTCA
AGATTTTGTCTAATTTCATTTTCAACTTCATTTTTTGTAGATGTGTTTTAGTTATAAAG
CCATTAAAATATGATTCATATTTATTATTTACAGATGTTTAATATCATCATGTTTTATT
TTATATAAAGCTGTTGCTATATAGCATCCATTAGTAGAAGTTGGCACAAATGTAACAATT
GGTTTGTTATATTTTACATTTTTACCTTTATTGAAAACATATTGTTTCCTCTGTATTGA
TAAACTTCAGATTAACTTGTTGTTGTTCTAAACCATCAATTTGATTATTAAAATGATCG
ATAATATATTCTTTTTCTAAATCAAGATCCTTAGTACAAGATGATAGTTCTATAACAATA
TTACCTTTATCTTCAATTACAGTTGAATCCATATAATTATATGCAAATAAACTTGAAGCT
AGAGTTACTATAAAACATAATTTTTTAGCATTTTTAATCCTTTAATTTATTAGAGGAAT
TATATCATAATGTATCTTAAGATAAACTTAACTATAACCCATCTTTGAGGTTTGAGCTAC
GAGGAAGCTCTTAGGTCTATAATCATTCTCGATTACATTTACCGTTGTCTTAACTATCAA
TCCCCTCAAAAATAGGCAATATTATTAAAAGTCATATCGTTCTTTGTTTATAGTTTCAAA
CATTATTTTTTCAGGGTTTAAATCATTAGTTAATAAACCTTTTACTATTGAAGGACTAAA
```

FIG. 13Z. Continuation of (CJLB-10 [organism=Campylobacter phage CJLB-10] complete genome)

```
CCCTGATATTAAACAAGTTCCATTTTCATCTTTTCTTACAGGTATATTTCCACTTCTCCC
ATAAATATTCCAAAAAATTAATTCAGGCATTTTATAACCACTGTTTTTAAAAGAATCTCT
TATATATTCAAAATTTGTTTTACCTTGTTGAGCTTCGTCAAATTCCATATCACTTAAAAT
AACTAAAGCATCAGGTAAATCTTCTTGTGACAAATTATCAGCTTTTGCTCTATTTAAAAT
CAAATCAAAAGTTTTAGCGAAATTAGTATTCATACCCCAATTAGATTTTTTTATGGATTT
ATATTTTCTCTTAAATCATTTCCTTCTATCTTTACCATTTCAGGATTTGCGGAAAAAGT
TATAAAATAATCTTTAAAATCTTTATCATTTCTTTCACTTAAATACATACCTAAAGAAAT
TGCTATATTTAAAGCAGTTGTACTTCCTTGAACTTCTGTATCCATACTTCCAGAAACATC
AATTATAGGGAATAGAGTTTTCTTAGAACCTTCCATCCAATTCTTTTGATTTTTCCACAT
TTCATTTGCTAAAATATCATTTTTAAACATTAATTTAATTATTTCATAAGGATATATTGC
AGAAATATTTACTTTTGATTCACCTTTTACCAATGATTCTTGATAATTTTCAAATCTTTC
TTTATCATTTCTTTCAAAGGCATCATTATACTTAGCCATTGCTTTTGAAGGAATTTTTTC
ATATTCTATTAAATTCCATTCTTTAGAACACATTTATTTTCAACAACACAAGTATTAGA
AGACAATAACTTTCTATAATCTTTAGCATTTAATTTTAATAATTTCATCAATTTTTTGGC
TAATTTAGATTTACTTGATTTTTCTCTAGGCATCCACTTAGCACATAATTGATTATTAAA
ATCTAGTATTTAATTAATTCATTCCTACTAAGTCTAATTGTTTATCAGTTATTAAATC
ATCAAACCTGCCTAATTCAGGAACTTTTCTAATTATTCTTTTATAAATTTCCTTATCATT
TTCTGCAATAAAATCTAAAAATCTTTTAAATACTTCTCTTCTTCCTGCACCTTCTCTTGC
ATCTCTTGTCCATAACAATATTCTAGAAGTTAATTCCTTATCAATATTAAATGATTCTTT
TACTTTTTCAAAAACATTGTCAATATTATTTTCATTAGTTGTTCCTATAATAAAAAATAA
ATCTAGAGCTACATTTAATGAAGAGCTTAATGTTAAAGCACCATTTTCTGTATAAGATAA
GTTTGATAGAGAATTAACAAATTTCATTTCTTTCCTTTATAAAAATCAGGGTATTTAAA
ATTCAGATATACTGAAAATCACTAAGCACATAAAATTACAAAATATTAATTTGCTGTAAA
TACCCTTTTTAATCATGGTACTTTTTAGAGAATTCATCATTAGCAGTAATGTCCTTAAA
ACTTTGCTGTTAGTACCATTTACTTGTGTTTAAGTTACTTTTAAACTCATTTAACCATCT
TTAAACACATTTAAATCTTCATTGAAAACTTAAATGTGTTTAAAATGGTGTAGAAGGATG
GATTTGAACCATCAATGCCAAAAGACGCCAGATTTACAGTCTGGTGGATTACCAATTATC
CTACTTCTACATTTATTATAATTATAAATGGCTGCAGATAGAGGATTCGAACCTCTGACC
CATCGATTAACAGTCGATTGCACTACCGCTGTGCTAATCTGCAATAATTATTGTGTTTAT
TCACTACAACTTCAATAGATTAGAGTTATTGAAGTTGTGGTATCTAATCTTATATTGTGT
GTTTTTACTCAAAAACTTCCCAAACTGCCATTTGGGATCGGAATTAAACCGATACTCTCA
CAATATAATCGAATAAACACAATTAAAACTTCCTTAAAAAATCTTAATTGTGTTTAAAAA
TGGTGGGCGAAATAGGAATCGAACCTATAACCAACCGGTTATGAGCCGGTTGCTCTACCA
TTGAGCTACTCGCCCTTACTTAATTTTTATATTCGTAATCGTATCATAATAACCTTAAAT
TAACCTTAAAACTATTATTGATACATAAGAGATAAGACAAGCTCTCTCTGTTAGGTTTGA
CTACCTAAGCCGTCTTATCTCTTATATATCCAATTTTTATACCGTAATCGTATCACAATA
ACCTTAAGACTTCCTTAATTATTGTTTATTTGAAATTTAAGAGGATAATATGTACCATC
TTCACTAAATGGTAAATCTCTTGTTTTAAACTTCATTTTATCTGTAACAAATACTTTATT
ATTTAAGTATAATTCTATTTCACCAACTTTGTTAAATTGTGTTTTTTAGTCTTTTCAAG
TAAAATATAATGTCCAAATACAAAGTTTCTTATCATTTGTTAAAAGTGAAAGCTATATT
CCATTCTCTTACTTTTTTGGTAAAATATAAACTTTTATACCTAATGTTTCAGTGATCTT
ATTTATCTCAGAGATACTTTTATACCTAAATACACAAAAATATTCAGCATCTTTTGCTTT
TTTAAATATATTTGGACTTACATATCTTTCAAAATCACTAGGTGTTTTTGGTATTCTTCT
TAAATAATTTTCATCGCTCGGAGTTAATTCCTTAATTTTAGGAAGCATAAATCTTAAATC
TGTTGAGTTAGCCTCATTAAACTTTAAGAAAACAGGTTTATATTTGTCTGCAACTTCATA
AAACCAATAATAAGGTGATTTCGATAAAATATATGTGTTAAAGTTTATTTTATTTTCTTT
TAAATTTTTTATAAACTCATTACTTTCTTTTATATCATAGTAAGGATCAAATGTTAGTAT
CATCATGTTCCTTATTTAGGTATTCAAAATCTCCACCACCTTGCCATTGTACTTCTTTAC
TAATACCACCTTGCTCACCTTCTATAACTTTTTAAGTCTTTCTTTTGTGACAGTTTCTA
TATAATCCATGTATTCTATGCCTATCCATTTGCGTTTCATTTTATGAGCAACGGCTAGAG
TAGTACCACTTCCTGCAAAAAAATCCATTACTATGTCGTTTTCATTTGTAGAAAGATCCA
ATATTGTTTTAATAAGTATTCAGGTTTTTGCCCATTTTTAAAAGTTGTTTTCAGTCCTT
CTCTACATATGCCAATTGTAGATATGTTTGTCCATAAATCACCTAAAGAATAATCAAGAT
TTTCATTTAAAAACAAAACTTTCATAATTACACCATTATTCATATAATAATAATTTGTTT
TACCTTTTGAATTTATTATTTTTTCAAAAGTCCCTTCTTCCATATTAATGTTATTAAATGT
TATTATCAGGTTTTACTAAATATATCAAGTTTTTAAAATAATCTTGTTTATTTAATTTTG
GATCAAAATATTTTATTTCCCATTCTTTATAATCGTTTCCAATGTTTGGAATGTATTGT
TATAATATTTAATATATGATGATAATTCATTTGTGTCTTTTTAATCTAATTTGTTTTA
ATATAGATTTATTATCTTGTTTTTTATAAAGTAGTATGTATTCTTTATTTTTCGGTAATT
TTTTATGACAATTAGCATTTTTTAATCCTTTAGATTCGTTCATCTTAACTACAATACAAT
TGACAAAATTCTCTCTTCCAAATATCTCATCCATAAGCACTTTTAAATAGGCTTGTTCAT
TATCATCACATTGTACAAAGATCACACCATCATCACGCAAAAATTCTCTAGCTACTTCTA
ATCTTTCTTTCATAAATTTTAACCAAACTTTAGAACCTATGAATTTATCTTGTGATTTTA
TTTTTTTAGCTTCTTCTTCATCTACATTAAAATATTTTATAATTAAATCTATAGATTCAA
AATTATCATTATACTGGAAATTTTTATTCCCAGTATTATAAGGAGGATCAATATAAATTA
ATTTTACTTTACCTTTATAAAAAGGTAAAATACTATTCATTACTTCTAAGTTGTCACCTT
```

FIG. 13AA. Continuation of (CJLB-10 [organism=Campylobacter phage CJLB-10] complete genome)

```
TAATTAAATAGTTTTTATCAATATTCATATAATTTACTCCTTATTATAACTACTATTTTT
AAAACTATCGCACATTGATTTAAATTCACACCAATTACATAATATACTTGGCTTAGCTAT
AAATGCTTTTTCATTTTCAATACTCATTATATCTTGAGCAAATTGCTTTTTTATAGGTAT
CAAATCATCACTTGTATAAGTGTAAGTGTGAAAATCATTAGTTTCAACATACACAAACTG
GCATATTATTTTATCTACATTTAAGACTTTTTCAGCCCATATTGCATATAATGCTAATTG
ATTTGCATCTGGTATATATTTTTTATCTTTTGTTTTGCCTGTTTTCCAATCTATTATTAT
TGCACATCTATTTTTAATGGCAATATAATCAATAGTACCTCTTATAACATAATCATTACC
ATAATAATTAGTTGGGTTAGCTTATTATCTAAAGCCCAATTTACTTCATTTCCTAAAGC
TGGTAAGTCTTTTATGTTTTGTATTTTTCTGTTTCTTTAAACTTTTCAAATATCTCATT
ATATTCTTTATATTGATCTGCATTTATTAAAGGATTATTATATGATTTGCTTACTTCGAT
AGGTTCTTCTTTAAAACTTTGCTCTATTAACCAATGTATATAACTTCCTTTAATAAGTGC
AGTTTGATCTTTAGGTACAGATATTTTATCAATATAAGAATATTTAAACTTTAATTTACA
TTGTCTAAAACACTCTAATCTTGAATAAGAATATCTATACTTCATAATTCACCTTTAATC
GTTAATTTGATCTTTTAAGTTTTGTAATAGTTCTTTATCGGATACTATCGAGTTATACAT
GCTTATATTAGCACTTAAACTATCGATACTCATTTTAAGTTCATTTTTAATGTAGATAG
AACCCTGTTAAATTCTGTTATATTTATACCATCTTTGGATAATTTTGCTTTAATATCTCT
TATTTCAACATCAATTTCTCTTTTTGTTTCTCTAAATCAAAAATTTGTTTCATGGCATT
TTTGACTAGCTCATCTTCATTAATACTATTTTTTTCAATAAAATCAGTAACATTTAGTTT
CTGACTTTTTAATTCTACAAACTCATTAATATTTTCCATTTTCAGTCCTTTCAATTTTGA
TACCGTTACGGTATCAAAATATACTTAATTTAAACTTAATCTACAATTTTATAGTCAAAT
TCTTTGAAATTAAGGTTTCCATCTTTTAAAAGCTGCCATTCATTATTTGTATCTAACTGT
TTGAACATAATCTTTTTACCTAATTTATATGCTTAGTGATATGTCTTTCATTACTTATA
TCATCCCTTATAGATTTTGAATAATCAGCTTTATACCATTTCTTTATTTTTATCTGTTTA
CCATTAACTAAAAAATACCAGAATTCCCTATGATCTCCATCAAGAGTAATATCTTCTTTT
CTACAGTTGTAATTTTTCACTATTTCATCTAGTGCTTCTTCATAAGTATAAGCACCCACA
TGTTTTTTAAACTTTCTTTCACTTTCTGAATACTCACCTGTTCTTTCTTCAATTTCTTTT
AAACACTCATCCATACATATTTTTGGGTTGTATCCATCTTGATATAAACTGTTAATTAAG
AATACAATACAATCACATCTCCAATCTATACTTTCATGTTCACTATCCCTTTTTTTAATA
CCTTCATCTATCTCTTCATGTAGATAACCTAACAAAGTTAAATGATCATATTCTTTTTTA
TCTAAATGTCTTCTTTCAACCATTCTTCTAATTTCTCAAATAGTTTCATAATTTTAACC
TTTCATTTATAGTTTTAATGTCGTTTTCATAGTCTTTCAATTTAATGTTTCATAATTTC
GTGCCTCCTAATTATTTTAATAGAAATATTACAGTTTTTCTTTAATATTTTGGAAATTT
TCAAAAAATCTAATAATTCTTTATCCTTAATTTTAGGAAACAAAAAGAAATTGACAATTT
TTAGTCCTTTCTTTATGTACTTTTTTATAGTTAAATCATCATTTTTCCTTTTACTATATA
AAAATGTTGTAATATTAACTGATATTACAACTAATACTGCCACAATTGCTATAAGTGTTC
CCACAACAGATGTATTTGTCTCCATTTTATTTCCTTTCTATAATTAAATTATAACCATTC
ATCTAATGTATTTACAAAAATATTTTTATAATCAAATCCTATATGTTTACTCATAATATC
TAATTTTTGTATAAAATATTTTTCAAACATAGTTTCATAATCAACGAATTCACTGATACT
TGGTATTTCTCTTACAATTTCATCATCAGGAATACATATAACATTATCACCAGTAATGGC
ATTTGGTGTTTCAGATAGACAATATATACTTTTTCACCTTCCATTATTTTTTAAGTTT
ATACTTGTTTGTAAGATTATTATAATGGATTGAACCTCTAGATTGAATAGGACAAGGATT
ACCATTTATTGATGAAACCCATTTACCATTTGATACAATATATGATAAGCTACTTACACT
TTTATTCATACAAATATCGCTTAGAAGCTGTTGTTTAAACTCATTCTTTATGTTATTAAT
AAATTGCCTTAACCCATGTAGATCACTGTCAAGTATTAAATCTAAGCACTCATTTAATTT
TAGTTTTGTCCATTTTGGAGTTGTTTTATCAATCATAGGAAGGCCAGTTATTTTAAACCC
TTTATTTAATTTCTTTTTATTAAAATATCTCCCAACATATCTTTTACGAGCACAACTAAT
TAATCTATCGCATATTGTTTCCTGTTCCATTCCAAGATTACTATTTTTATCTAAACCATT
GATAGCTGTTACAGCTTCACTTATAGCATCATCTATAACAGGTGATATTGTAGTTTCACA
ATAACTTTTCAAAAATTTGGCATTTTCTTGCAAATCTTAGGTGTTTCTAGAAACTTAAA
CTCAAATAGTTAGAGTCTGTATCACATTGAATACTTAAAGGCCTACTATTAACATCAAT
ATTTAAATTATATGTTTCATTACAAAACTTATTAACTTTATATGAAACCCACATATTTAA
AAACCTACCAGTTGTTGTGATTGATTCACTCATTTTTTTACCAAAACTAAAGGATTTAT
TGCTAGTGATGTTGAGCCATAAGCAGAATTCATAAGAATTTTAAACATATATTGCATAAG
ATCATGGTAATCTATTTCAGAAGCAGTTAAATTATCATTTTTTAAAAAACTCTTATGATT
TAATCTATCTTTGAAAAAATTTTCTATTAATTCAGCAAATAATGAAGTACCATTTGAAAA
GTATAAACATCCATTTGGAGTAACATTAACACCATATTTTTACATATCTGTTTTATTTC
ATCCTTATTGTCAATAATATTTTTAAAATAATAAAACTCCTCCATACTATCATTGTTAGT
TTTATCATAGGTTTCTGAATAGAAATAAAAATATTTGTTTAACATATTTTTAAGGTCTTC
TGGTAATGATGTAGAAATAACTTCATTTGGTGCCTCATTCATAAACCTTGCTCTATTTTC
TTCAAGTATTTTAGCTTTCTCATATGGGATATTGCTAACTGGAATATAATTATCCAAACC
TATTTAAACTCGATAATAATATTTGGATATAGAGATGTAAAGTCATATGAACATACATT
TTTGTGTAATCCTTCAATAACTCTAACCCATCCTCCAGGGTATGGTGGATCATAGTTTAT
TATTTTTAATTGCCTTAAAGGTAATATAACATTTTTTGATAAAGCATAATTATACATTAA
TGATGCCCATTGCATAAGGGTGCCTGAAACTTCATCAGCATTTACACCACACTTATATGC
TACTAATTGACATACTTTTAATAATTTAATTTTCGTTCTAATTTATAAGTAACTCAAC
ATCCTTTAAACCATAAGAAACAAACTTATTAAAATCTTTATACAAGTCTTCTATTGAACC
```

FIG. 13AB. Continuation of (CJLB-10 [organism=Campylobacter phage CJLB-10] complete genome)

```
ATCGTAATTTACTTTAGTGTCACCTAATTCAAGTTTGGATATTTCATCCAATGAAAATCT
ACTTGGTTTTTGAGTTGTGTATTTTATATATAAATCTCTCAAATCTAATTGAATTATACC
TTCTATCTTAACACCATCATACTCTATATCATCATTAGTTTTCATTTTTTATGTGTTAT
AGCTTTTATAGGTGATAACTCAACATAGTCATCTATGCCAAGATGGATCATTCTATTTAC
AATATAAGGGATATCAAATAAATTAGAGTTGAAACCAGCTATAATAGTAGGATTTGTTTT
AACTACAAATGTTAAGTATTTTTTTAACATTTGTATTTCATTGTCACATTTTTTGTAAAT
TACTTCCCCTATATCTGATTCCAAATTAATATCTAAATCTTTAGTACCAAAAATTATAAA
TTTATTTAAATAATTATCATAAACTTGTATTAAAGATATTCTTCTGTTGGGTTTGATGG
TTTTGCATAACCATTTATTGCTCTAGTTTCTATATCTAGATATTGTGTTCTGAATTCATG
ATTACAATCTATATCTTTGAAGTTTTCACGAATATATTTTTGAGGTCTGTTTATATTACC
ATACAATGGTGTAGAAGGTGATACATTTTTTAAATACTGATATATCTCATATGTTGCTTT
AAATGTTTTCTTTTTAAATACCCATGTGTATAGAAGTCCTTATATTCTGTTTTTTTCATT
AGTTCTAATAAACAATTCTGGGACATATTCAGTTGATTTGTATTCTTTTATAATTGAGTT
TTTTGTAACTTCATCATAAAGTCTAGCATATAACTTAAAATTATGTTCAAAAACATATTC
ATATTTAAACATCAATACAATACCCCTTATATCTTTTTGGGGTATTATACCAAAAGTTAT
CTTAAAGGTGACTTAAAGTATAGGACCTCTTTAGCATACTCTTTACCATTAAAATTAGGT
ATACTTTTGGTGTATATTTCTTGAAGTCCTTCTACATTTGAAGAATATTCACTTAGAAAT
ATTGGAAACTGCTTAAATTTGTCAAACAAAAGAGGTAATGTATTACTATCAAAATCAGTA
TAATTACCAGATTTAGCTGTATTTTTATATGGTGGATCAAAATATAATACAGTAGTCTCA
GGATCATACTTGGATAAATCAAGATCAAACGCATCTTTATTGCTTATTTCCATTTTTGAA
AAATCAATATGTTTATGATTTCTTAAAAATGTTATTTTTTCAATAGGGTATATTCTACAC
ATTTTGCCACCACCAACAAAAATCATCAAAATTTCCATTAGCTAAATATTTTATTGCTCT
AGCAACTCTTTCTGTCTTTTCATTATATAATGCATTTAATCCCATTTGAATAGCAGTGAT
AGATATTGCACCTGACCCTCCAAATGCATCTACTATTGTTTTAGTATTGGATACATTTC
TTTTATTTTGCTTACAATATCAACAGCTAGGGATCTTTTACACCCAAGATAAGTTGGATA
ACAATCATACACTTTCATATAACTCCTTTACCTTTTAATGGTTCTGGTTGGATCCATTTA
TTTTTGCAATAATTAGTATAATAATTATTAGATTTCAAAATATTTATTTCATTAGTTAGC
ATATTCCTGAAAGTTGTATATTGAATGTTATCATAAAAAGAGTTGTTTTCAACCTTTGTT
ACAATGTCATCATCAGTTATCCACATTGATCCGGTATTAGCTCAAATAACTTATTATCT
ATTTCCCAATTTTCATTGTTAATATCTTCAGAGTTAAGTAAAACATTGTTATTTTTGAA
TCAACAATTTTTAACTTACCATTATCTTTATATATTTTAATATAATCATTTTCTAAAGAT
AAAGAACCGATTGAATTGTTTTCTAATAATATTTGCATACATTCAATAAATTTCATAGTT
TATTCCATATATCTTTAAAGAACTTTGCAAGTGGTTTATAAACTATACCATAAATTCTAA
CCCAAGCCCATACAACATATCTTTTTACAACATTTACACCAAGTAATTTCATAGCATCTA
AAAATAGTTCATCAGCAAGAGCTCTAGGAATATCACCTTTATTTGATTTTCCACATAAAA
AATCATGTAATACATAAGCTTTAGTAGGTTTTCCAACTGGTGATATTATTGATTGAAACA
ATTGTGGAATACTACCAAAATCAGTTCTAAATCCTTTTGGTATTCTTATAATATTATTTC
CAACTAAATATTTTTCTAGTTTAAATCCTTTAGAAGTTACATCAAAGTCAAAAATAAAAT
GAAAATCATTGTATAATTCAAAGTTGTTACCATATCTGTAAATTGTATAAGATCTTTGT
TTATATTTTCCATATTAACCCTTTAATTGTAATTTGCAAGTAGAACATAATATTGTATAA
TCATCTCCAACACATATTTCACCTGTATTTGAAATGTTATGATTGCCATATTCAGATCCG
CATTTTTCACAAATTGAGCTTAACTTATAAATTCTATCTGCATATGGTAAAATATTTATA
ATGTTTTCAAATAATTTTGATTCATAATTTATGTTTAATCCACATAATACCCAGTTTTA
CTGATGTTATCAGTTATAATATTAGTAATTGAGTTATCAAAAATTGAAATTCATCCAGT
AATATATAATCATACTCATTTACAATTGCATTTATGTTATTTGTTTTTATTACATTTAAA
TTATGTAATGTTTATAACTTCTTGATATAAATTCTCTATCATCAATTTCTGGTCTAATT
AAAATGTATTTTTTCTACCAAAATGAAGTTTTTCAGCTTCTCTCAATAACTCCAAACTT
TTCCCTGATCTCATAGGACCAATTATAAGTTTTATCATGATATAAACTTTTCAAATTTAT
TTGCTAAACATATGCTTATAAACATTAATATAACTGTTACTGGTATACCTATTATTAAAT
CATAATATAAAACCCCTAATGATATTATCAAAAATAATATATAAACTTTTAACATTA
TTGCTGATATCAACAATATTAATATGCTTTTAAATGTATCCATTTACCACATCCTCAATT
TGCATTCAGCTATTAATCCATCAAAAGTATGCTCTTTTATAAAATTTCAATATTAACAC
CACTTGATAAATTTCGTTTATATCTTTATATTTTTGAATTTTTCATCATCACACCATA
CAACAAATTTATGATTTGGATTATTTGTATGTTTTAGCATTTCCTTCTACCAGTTTCAT
CATTATCACAACACCATATTATGTATGGCATAGTTTTCATTTTCTTTGGTAAAGTCGCAC
CCAACATAGCTATTTTATTTTTAAATGGGGTACATAACATATCAAATAAACCTTCAAACA
CATATACTTCTTTTGATGGATCAATATTAAAAATAGTTCATAACTTTAAAACCATCATCTG
AATTAAATATATAGAATATTTTATCATTTATACTACGACTATAAAAACTAAAAGCATTAT
CATTTACAGTATTTAAATATATTATAAAATTTGGTAATTTAAATTCTCTATCATTTATTA
CAAATGACTCTTTACAATAATAAAGTCATCAGGGTTTCCACCTCTTTTTAAAATATATT
CTTTTGCCTCTTTTATACAACTAGCTTTAGGTAAGTTTAAATTAAAAAACTCTTTAGGTT
TTTGTGATTCTTTTTTAGTCAGTGCTATATTTTGAATATTTAAATCATCTATGTATTTTT
CACCTATTTCATTTAAATAATTATTAAGGTACATTGGATGAAAAGTTTTAATGTAAGAAT
ACATAGTAGCTGTATAACCACAATTAAAACATTTTATAGAATCATCTGTATAGGAATCTT
TTCTATACAGATGTAATCTTTCTTATTTTTATATTTTGAATCACCGCAAACATCACATT
TGCAGTTATAATCATCAGATTTATGTATTCCTAAATCTTCTTTATTATGAATAATTTCCC
```

FIG. 13AC. Continuation of (CJLB-10 [organism=Campylobacter phage CJLB-10] complete genome)

```
AATATTTTACATTAATTGGATTTAACATTACCAACTCTTCTATCTAGTTCATCAAATAAT
GACTCACTATCATCATTTTTTATAATTTCTAATAAATTAGTACTATATGCTTCAATTTTT
ACAAATAGCTCACCATCATCTGCAACATAAGTATCAACTACTTTTACATTTTTTACTAAT
GACGAACTAACTTGTACTGAAACTTGGCTATTATTAGTTTTAACAATCCCTTATTTTGG
TAATATTGTTTGATCATACTATCAACTTTTGAAGATAATTTTGGGTTAAGTTCATTTTA
GCTACTGCAATAGCTTCTGTTTGTTGTTGAATATAATTTTGACCTATATACATTGCTGAA
CCAACAGCTGTATTAATATCTCCATATTCTTTAACCCAACTAGGTAAATCATCATATTTT
TCTAACATAGGTTTAGCAAATTGTTGTTGTGGAGTAGTTGTTGAACAACCTACAAACATT
AAACCTGCAATCATAACCGCACTACATAAAACTTTTTTCATTTTCTTTCCTTTCATTTTG
TGGTTTTATATAAAACTCATAATACAAGTTGAAAATTTATCAGGTATTCCGTCTTCATTA
TCTGTATCTGTTACATTACCTTGTAAATCTATATCTGATTTACCAGTAGGATTGCTTAAC
ACAATATATATGTCATTCTCATCACTATTGTTTGAAAAATATGAGCAAAACACAGTTGTG
TCAGCTTCTGAAATATCATCATATTCCCAAACACCATTTTTTGAATTAGTTGATAGAAAC
TCTAATGTTTCTTTGAGACTAAAATACATAATTTTCCTTTAAAAGTTTAATTTGAAATAT
TATACCATATTTATCTTAATTAATACTTAAATAAATAATGTAAAAAGGTGTAATATGAAC
TTTAGAAATATTGCTTTAAACTCAAATATAGTTTTTAGGACATTATTATTTTCTGATGAT
ACTCAATATTATTGTCAAAAAGTTAAATTACCTAGAATATCTTTAGAAGGACAAAAAGTA
GGGCATTCAACTGGTACTTTAACATTAGGTGGTGAAGTAGCAAAATTTGATTCAATAACA
TTGACGCTGTTAGTAGATGAAAATTTAGAAGTGTGGAAAAACTTTGTCAATTTAATTAAT
AAGTATAATAAAGTTTCTACAAATACTGGATGTGGCATTGAAGCTACATCATGGTTAGAA
ATATATGATTCTAAAAATAAGTTTTTGTTTAAAGTTGAATTTTACAAAAGCAAGTTAGAT
GAGGTAAGTGAATTGGAATATTCTACAACTGATAATAATATCATAACCTTAGATATAACA
CTTAATTTTGATTATATGAAAATCATATAATCATTTTTTAAATGTATAAATTCTTTAAT
AAGTGACATTGCTTTATCTATACCTAAGTATGTAATTGCACCTGCTACACCTATTTTGT
AAGATATGGCAATTCTAGTGAAGTTAAAATACAATAAATTATAGTACATAAAACAGCACT
GTTAAAAATGTATTTCAAGATGCATTTTATATGTTTTCCAGTACAAGTATCTTCTTCATC
AGACAAATAATTAGATAAGCCACAAATTAGTCCAACAATAAAAATAGGACTTAACTCTAG
GAGGTAATTCATTTAAGTCCTATCAGCTCACACCATGTATAAATCACACAGAATAGAATG
TTTAACCATAATATTCTGTGTGATATTTTATAATACTTTTTGTATCTCTGTGGAATATCA
CAGTGATATTTGCCAATTAAAAACCATCTAAATATAAAAAAATAGTATTTTATTTTATCT
GAAAAACTTTTCATGTATTATCTTTTCTTTTGTGTTGTTTTAACTGAATCATCCCATTGT
ATTTTTTCCAGTTCCTCAATTGTTTTAGCTGCTTCTATTTTTGCTTTTAAAACATTGGCT
TTAAAAGTAATCTCTTGTGTGTTATATGTAACCATTGAGGCAAACTTTAAAAATTCCTGT
GGGTTAAAAGTTACTTTTTCATCATTTATGTCAATCCAAATGATTTCAGAAACTGAATTA
GTTCCACTTTGTATATCAAGCATTAAATTAGTTACAGCTCCATTAATATTTAGTTTATCT
TTTTCCCTTGTTGAAAAGTATGACCATTATATACAATTCCATTTTCTAGAGCTTTATCT
CTATTTGATTGGATCTCATACCTTTTCTTCTCTTTTAAGATATCTAATTTATTACTTTCC
TGAGTAGTTGCTATTAAAAAATCATAATATATATCCATAATATTATTTGATATACAATAT
TCTTTAATTGCTTGTTTTCCAGCCTCAATTTCTTCAGGTGTAATGTCATCAATATATTCA
ACCATCATGTTTCTGAATTTTGCCTAACTGTCATAGGCCTATTTAGTAATGCTAACTCT
GATCCTATATCAATTGCCCATAATATAACATTTTTGTTCAATTGACCTTGATCAGCTAGA
GTTTTTTAGATATTATCATGTTTTATAGTTCTCCTTATTTTTATATTATTTATAAGTAT
TTATTTCCAAACAGTTCCATTTGTAGTTGGTGTATTATAACTTATATTACAATTTGTAGT
ATTGCCAGCAAAAGTAACACCTTGTGCTGCAACTTCTGAACCATTATAAACAGATATGCC
AGTTCCACAATTTTTAATATTTACATGGGCATCTAAACAAGTATCTGATTTCCTAAATGC
ATATAATCCATATTCACAATTATCTAAAGTTAATCCTGGGGTAAATAAATATGAACATGC
ATGTCTAATACCATTATAAAAATTCTTTATAGTTAAGTTATTTCTACAATTGCATGTGA
TGCAAATATGGATCCATGATAATTAGCAAATGCTACACCAAAACTCCTGTTATTTGTATT
TTCAACAGTTAGATTTTTAATTACAGGGTAAATAGACATATCACCATAAAATACAGTATC
AAGTTGTGAATTGCAATATTTTGATATTGTAAATCCATTCCCATCAATTATTAAATTTCT
AAAATCTGTCTTTGCAATGTTAATAGTATAATTAATAGTAAGATTATTTAATAATTTTAA
AGTTATTGCATAATTAGGATAATTAATATATCTTTTACAGTAATTAAGTGCGTCTAGTAT
GTTTGTAAAATTTCCACCATTACCTATAGTGAACTCCAAGTTATAAGCAAATTCAGGAGT
ATTATCTATAATATCTTTAAATGTTGTTTGTCCATATGTTTTCATTAATAATTCCTTTAA
ATACAAATATAAATACATTTATATTTGTATTTAAAGGAATTATAGTTTCAATTTCCTATA
TTTTATTATTTGTTGTAATTGTTTAAATTTCAGTTTTAATATTATATTAAAACTGAAA
AATAGATTTTTGTAATTTGTATTTAAGCTGAAATATATCCATTTTTAGTCCAAGTACCCA
CAACTTGAGACTTACCAGTTATGCTTCCTGAAAATGTTGTATTATAATTATCTATTATTC
CAGAAGTTTCAACACTTTGGCTTAACGCTCCTGAATTTTGAGTAAATTTACAAGTATGAA
AAAACAATTTGCTTCCTATAGATGATATTCCTTTTGAAAAGTATCCACTGCTACCTGCAC
TTAATTCACAAGTTGAACCAAATACATAAGCTTCTGAATTAGTGGATAAAGCAAATGCGT
TACCCAAACAATTTAATATCCCTTTCATATCGTCAAAACAACAGGATGAATTTTTTTGTA
ATAAAACTGCTGTATTGATACTTTTATTATTACAATTTATTTTTAATTTATTAATATTTC
CTAAGATTGAATTATACATAGAAAATCCAATATCATAGGAAGCATTATTTAATGTAATAG
AATAACCATTAAAATCTATATTTAAAAATGGGGAATGTATATTCACAATATTAATAAATT
CATTTATAACTAAATCACTAATTAATTTTATAGTTATACTTTTATCACTATAATTCATAT
```

FIG. 13AD. Continuation of (CJLB-10 [organism=Campylobacter phage CJLB-10] complete genome)

```
ACTTATTGGCTTCATTGATAGCAGTTTGCAAGTCTTCGAACTTGCCCCCCCTGTTCCAAC
TGTCCATTCTAAATTAGAAGTTAAAAGTTTTGCAGAGTTATCAATAATATCTTTTATACT
GGAACTACCATATTCTAGCATTATAAATCCTTTATAAATTTTGATAGTATTTATAAATAC
TATCAAAATTTAAGCATGAATTATTCCATTGGCTGTAACAGTATTGGTAGCAAATGGTAA
TTCATATTTACTCCATGTACAATTAGTTACATTTCTACCTGTTATATTTGTATGAGCACC
ATTATAACATAATAATAAATTTGCTGCTTTTGAACCTGTAAAATTAGGATATTGTAGATT
CATATAAGAATTGTTATTATTTAATATATTAGCAGCAGATTTATTATTTGTAATTGATGA
ATTAGTTAATGTCATTTTAGAACCATATCCACAATAATATAACCATCCATTACAGTTTTC
ACTACCATTATTATCTAATTTTAAATCAAATCCCGTTAATTCACCTTGATCATTACAATA
TAATAATGATTGCTCTTGTGTTCCATCTAAATTGTTACCATTGTTGGTAAAGCTATATTT
GGATATAACAATTTTAGAAGATAATGATAAAACTGCATTTTTATAACAATTTTTAATACC
ATATTTGTATGCATTAGATGTTGAAGGAACCATAGTAACAGAACTTTCTCTAAAGTACCA
TCCTTTTGCTTTAGTTCCTATAGCATTAACCATAATTTTAATATTAGGTGCTTTGCAACC
ATAAAACATAAAGATATACTTTTCGGTATCAAAATTATCAAGCAATATTTCATCATCTTC
TGATAATATATTTATATGATTTGCTAATGCATTTCTTAAGATAATTTGTTCGTTTAATTT
ATATCCTGATTTTAATATAATATTTATGTTGCAATTATTTTAACTGAAATATATTCGAG
TGCTTTTGCTAAAGCATCTGATAATTTGGAGAACCCCCCCCCCTCCTACTGTATAAGTTT
TGCTCTCTGTTAATATTTTAACACTACCATTAATTATTCTTTTATATTTGAATTTCCAT
AATTTATCATATTTTTATGATTCCTTTCTAATATAAGTGTATATAACCACTAGATGAAAA
AACATTTGCAGTAATATTAGTTTTATTAAAACCAGATACAACTATATTACTACTACATGA
ATATTCCCACCATAAGAAACACATAAAGCATATGAATTACTGTTTGAAATATTTTAAA
TATAGGGGTATTAAATCCTAATTTAGATGCAACATGCGAAACACCACAATTAGCAGCTAC
ATTATTATATGTTCCATCAAATGTAACATTTCCAGCATATATTTTACTTGAATCAGCACT
CCATAGTATATTCCACTGCAAGTTTTAAATGTATTATTTTGCCACACATTTAATATACT
ACCATTGTCTGCTACTACACCCGATTCAGTACAATTTTCAAATGTACTGTTTTGTACTAA
TCCTATACATCCAACACTACCAACACCCCATTTTGCATTATATACACCAGAATTATTAAG
CTTAAAATTAGTTTGTAAGAATCCAAATGCCATCGAAAACATAGTAGGTACTGAACTAAA
TCTAAGTTTAAACGATATTGTTGGAGATATTCCAAATGTAAATGAAACTGCAATAGGATT
TGCTGCGTATTGATTTATAAAAGCGGGATTAGGTGTCATAGTTCCATCAAAATCAACATA
ATCATCTTCTGATGTTAAAACAACATGTCCTAGATTTGCATTATTGATATGAAGACTTTC
AGTTAATTTATACGATGACTTCATTGTTATAGTAATTTTAAATTTGTCACAGATATATA
TTTTGAAGCTTCTTGTAATGCATCTACTAAATTTGAAAATGTTCCATTTGTACCAACAGT
CCATTCAAGATTCTCTGTTAATAGTTTAGGTAAACTACTTAAACTTAATTGACTGCTTTT
TGTTTTTGAATAAATTATCTTTTTTATAGGAATTGTATCATTATCAGTATATATTACTAC
ATTATTATTTTTAATAATGTAGTCAAAAGGTACTGCATCTATTGATGAGTTTGCAGTATT
TTCTATATATAATCCCAGAACTTGAATTATTGTATCAGGTTCAATTGCTATTTTGAACAT
TTTTTACCTTTACTGATATTATCAGTTGTGGTAAATTGTGGATCATTTATTACTTTGAT
ACTACTATCAACTACACCTAAATTGCCATCACTTGATAATGATACAATACTATTATTAAG
AATTGCTTCATTTACAGTTGATGTAGCTGTCAATCCACCTTCTTGTTTTTTAAATATAA
TTTATTTTCACTTTTTAGCAATATTATTTTATTGACTGGAACCTTGTCTATGCCAGTTTG
TGAATCATTTACAAATGACCATACATTATCTATACCATATGCCATTTAACTGATCTCCCT
TTTTAACATTATTTATATTCTATTTCAGAAAACTTACCATCATTAATAATATTAACAGTA
GATGTAAATAATCTAATTGATTTTAATTCACTATTATGACTTATAACATACATGCTC
ATTAAGTCAGTATTCTTTGTTAATATTTTAATAACTCATTTTTACCTACACTATCTAAA
GAACTATCTAAAACTTCATCAAGTATAAGTAAATTACATTTTACATCAAACTTATTCTA
CAAATATCTAAAAAGCCAACATTATAGAAATGTTAGTCTTAAAGCTTCACCATTACTC
ATAGATTTATATTCAAATGGTTTATTATCTTTAGTAATTGTTTCTTTTAAGTTTGAATCT
AACAAAAATGTAAAATTAAACTCATCAAACATATTTATATATTTGTTTATGGTTTTGTTT
ATAAATGGTAAGTGCATATTTAAAAATGCACCTTTTAAATTGTTATTATTCAATAGAATT
TCAAGTTGATTTAAATTAGAAATATATGTATTAATCTCATTATACTCATTTACAATTCT
TGTAATTCTTTTTCATTTGAAATAATATCATCATTAGCTGGTTTTTCTATGTGTTCTACT
TTGCTTTTTTCTAATAAATCTTCATATACTTTTTTATTTTCTATTGATGGTTTTAATTCT
AACATTTTTGTATATATATCATCTTTGTTTTTAATATATACTTCATTTTCATTTGTAAT
ACTTCTAATTGTTTAATAAATCATCATGATTAGAAACATCAATATTGCTTGGAATAATT
TGTTTTAACTTCTCACAACCTTTACACATTTTATATTTTCCATTAATTGTAAAGCTGAT
TTTTGCTCATTTATAATTTTTAACAAATCATTTATTTTATTAGAAGGGTCCTGTGTTAAT
ATACTATCATATTGTGTTTTTAATTCTTTTAGTTTTTCAACCTTTCCAGATTCTTCTTTA
ATTTTATTTTCAATTTCATTAATATTATTATTTTATTTTCTATATAGTCATTATAAGCT
TTTAAATCATATTCGTATTTATTTTTGCTTTGATATAACATCTTGCAAAGTGTTTATT
TTAAATAATGTATTTGTTTGTATAGTAGTTTTTTCTTTTTTAAAAGTTTTATTTTTCA
GTAAGTTCTAAAAATGTAGCAGTATCAGAAAGTATAGCAAATACATCTTCTTTTTCTTTT
TTAGATAACCTTACAAATGATTGACTTAACAAATCTCCACCTAAATATATAAGATTTCTA
AAAGCTTGTTCTGTAAATTTTAATATATTATTTTCTAAAAATTCTTGATACGCTGAATTT
GTGCTTAATAATGGTATTAATTCATTATTTTTGTATATTTCAAAAATGCTAGGATTAGTC
CCTCTTTTAATTGTGAACTCATCTCCATTAATATTCATTTCAACTTCAACATACATTCCT
TTTTTATTGATATTATTAACAAGTGATCCTATTGTCTTACCATTATATGTTTTACCAAAA
```

FIG. 13AE. Continuation of (CJLB-10 [organism=Campylobacter phage CJLB-10] complete genome)

```
AGACAATAATGTAATGCTAAAAATAAGCTTGATTTTCCAGCACCATTTTTACCTGTTACC
AAATGAATACCATTAGTAAATTCAAATTTTGTTTTTTTGTTTCCATATTTCATAAAATTT
TGCAGTATTATAGATTTAAAATTAATGTTATTCAATTCTTTCCTTTCAAAAATAAAATGA
GTGATTAATCACTCATTTTAGCTTTTAAATACATAATAATCATCATCTTCATAGACTAAG
ACAACATCATCTATAGCTCTTTGTTTTGCATCATCTAGATCTGAATCATCATCTTCCATA
TCAAAATATCCAAGGTTTTCCAATTCATCTTTTAACTCATCTTCACCTTCTGCAACTGAA
AAATCAGACATAATAGCAATTGGATCAAATTCAATCTGTTCACCAATATCATCTTCTAGT
TGTGTTATATAGTCGAAAAGAACATCTGAAGCACCATAACTTAGCCCTTGTTTTTGCATT
CTTTCTTGGAACATATTTTTATCAACATTAATAATCATTGTTTCTCCTTTAGTTTTGATT
TATAAAAATTATATCACAGTTTTCTTAATTTAAGCTTAATTATTTATAACATCATTTAAT
ACTGACTCTAAATGCCTATGTTCTTTCAAAATATATTCTTTTATAAAATCTAATGACTCG
GCAACAGAGTTATTTAAACTAACAGATTCATATAACTTTTCTTCTTCATATTTGTAGAAT
ACCTTGCTTATTCTTGCCCTAGCACCAAAATATTCTAATATTTTATCTTCTTTTTCATTT
TTTTCTTCAAGTATTATTTTCCCTACTTTACAAAAATCAGGAAAGTTGCCAGTAAATAAC
TCAGGTTCATCTTTATACTGCAAGATTATTTTATCTTTAAAACAGTAACAGTAAAATGT
CGCCTATCCCAAGTATTTTCTACAAACTCTTCTTCTAAGTTTTCATTTAACAAAATTATA
CCAGGTACAGAATTAATCTCATTAAAAGTCATCTGATAAGGTGTTCCTATATAAACATTA
TTTTGGTTAAAATGATAATGTCCCATATAAACTTTTTTATATTTTGAATTGTCAATGTTT
AATCCTTCTTCAGCAATACTTGTATGATTATATTTAAATCCTTTTAATTCAGCATGACCT
AGTAATATATCACATTCTTTAGTAACTCTTCATCACCACATAACCATGGAGATATTCCT
ATTTTGTGTTTGCCAAAAACATGATATGATGGTTCTTTAATATATTTTATTCCAAGTAAA
TCAGCAAATAACTCACTTGAAACAATATCTCTATTATCTCTGTTATACATATCATGATTT
CCAGCAAATGTATAAAAATCAAACCCTTCAAATATAGTTTTAAATCTAGTTGATAAAGTA
TGTAATAATTTTAAATCAATTAATTTTCTATTATCAAACATATCACCTAATTGATATATT
GTACTACAACCTTTTCTTTTAAAATGTCTCTATATTTTCTAGAGAATTTAATTGTACT
TCAAGAATATCATGATCAAAATTTTTACACCCAAAATGTAAGTCCCCCATTAAAGCTATC
AATTTTCCCATATATCTAACTCACTTTCTACTGTCTTTTCTCTTTTTAGGAAAACTAG
GAACATATATATTTCTAAACTTCATGATATCTAATGTTTTAAAGTTTTTCCCAGCAATTT
TGTTATACTCATCAGTTTTTAATAAATAGTCATGATGATATATCATTTTTACTGTTTTAT
TATTGTCAATATCTTTCAAAATATCCCATAGTGTATTAGATTGAATAATATTTTCATTTA
CAATAAAATATCTTTTGAAGTGTCAAGATTTAAATCAGTTTCAACTTTTTTATTAATAT
CTTCTACAATATACAGTTTATTATCTATAGCAACAATAGGATATATTTCTACATCATATT
TTATATTTTCATCATCAGTTTTATAACAGCATGTATATTCTTTCTGTTCCAATCGTAATT
CTAATTCTGTGTAATCAGCATAATAGTTTTTTAACAGTTCCTGCTCAGCTTTTCTTTCAT
TTATAACTTGTATTATGCTATTAACTATTATTTGAGTACAATATGCAAAAGCTTTAACTG
GTTCTTTGGATATTTTTGAAACTTTATTAGCATCAAAATTAGGGATTACATATAACATTA
ACTTTTCAGTAGCCATTTGAATAAAAATCATCTTTATATGTATATCCACTGAATTTAGGCA
TGGTTAATATGTGTTTTATTAGAAGCAAACACATTTCACCAAATCTTGTTTTTTTATAAT
GTTCAGATATCCCTTCTTCTCTTAATTTCTCTATTTGTTGAATGTCATCATCTGTTTTAT
TTTCTATTTTTAGTAATTCTTTTAATTTTTCAACCTTTTGTAATTTTACAATTTCATCTC
TTAAATCTTCTTCCTTTAAGTAATCCATATAATTCCTTTTATTTTATTATAACATATAA
TAACTTAAAGTCATCTTAATAAATATAAATAATATAATATACTTAAATAAAGGAAAGATA
TGAGTAAGGTTATAAATGAATCAACCACAACAGTTGATATTGCTGGTGTTGAATTAAAAC
TTGCAAAATTAATATATCGTATATACACCGAATCTTTATTAAATAGAATAGGAGCAAGAA
TAAATGTAGCAGTTCCTAATGGCAGTATTTTTGCTTTTAAGGGAAAATATTTAACAGATT
ATACTGGAACTGATAAAAGCAGCACCCCTTATGCTACTGTTTTACCTGATTTTGCTGGAA
ATAGAGCTAATAATCAGGAAACTGATGTAAAAGCTGAAATGAATTATGAAATTGTAAAA
GAGCAATAAACTGTCAAACTAAAAAATAAGATCAAAATGGTCAATAGAAGCTATTACCG
ATTTAGTTGCTCTTACTGGTAAAACAACTGTTGAAGATATATTAGAAAAGAACTTTTAA
CAGAAATTATTCAAGAAATTGACTTTTCAGCTTTAAAAATGATGACAACTAAAGCAACAA
AAACACAATTAACATTAAAAGCACCTAATGATCCATTAGTTGGTATAGAATTATTTAATG
CAGCTCAGAAAAAATATTGGAAATGGCTGCTTCAACCAAAAGAGCTATAACTATGTGTA
TTACAGCACCATATGAAACTTGCGCTAAATTGATGTCACATCCTAATTTTAAAGCAAATG
AAGATTTCACAAACTCATATTTCATGGGATCCATACGTGCAACAGAAATATATTGTGATT
ATTATAATTCTTTAAATAAGAATATATGCTAATTTCTTATAAGCATAGAAATAAAGAAG
TCGAAATAGCTGATGGTTCTACTTGCTTTGCATTTTATAGTTATAACATAACAAAAGCTT
TTGACGCTACAAGTGGTGCTGAATCATATTTTCATTTTTTAAGGTATGATGTAGTTCAAC
ATCCACTAGATAATACTAATGATGGGCAATCTATTTTCTTACATTGTATTGAAATACAAT
AGGTAAAATATGGCTTGGAACTTAAATAATAGACAAAATGAGTATCAATTATTTGGTACT
CTATCAGCAGAATAATAGATATGTATGGGTTCAACTAACATATATAAAAACAAAAAGA
TTAGGACACGATAAAGTTCTAGATGATATAATAAATTATGGGACCGAAGCAACATATCAG
ATATTTGCATTACCAGAAAATGCAGAAATGTTTGATGAAAGAGGGGATATATTAAATAAA
TTTGGTATATTTACAATGGATTCTATGAATCTTTTATTAGTGCTAATACAATGAAAAGG
ATATTTCAAGATGAGTCTAAAATACCATCTGCTGTTGGTGATATATTATTGCTTCCAAGT
GGGAAATATATTGAAATAACAAGTATTGAACATCAAGTGCCTGGTGCTAATAACCAATTT
ACTTATTCAAATTCAAAAAATGTTTATATGCTAAGATGTAAATCATTTAATTATAATCAT
```

FIG. 13AF. Continuation of (CJLB-10 [organism=Campylobacter phage CJLB-10] complete genome)

```
GATAATATACCAACTTTAGAAGAAGTTAATAATGAAGAAGTTAATGAATCTTTAGATGAA
ATTTTTAATTTAGTTGGTAGTGCAGAAAACTCAAAAGATAAAATAAAAGAAGAGCAAGAT
AAAGAAAGTCCTTTAGTTAAAGGAACTGATAGTGTGTTTGGTTATTTAGATAGTTAATCT
TTTATCCAAACACCCTGACCACAATCCCACACTCTATTATATCCATTAATACTCATATTC
TCTGCTTCAGTCAGGTTTGGATTAAATTTCTCTAGTTTATCTTTAAGTTTATGTTTCATA
AATTGTTGTCTTGAATATTTGTTGTTACCTTTAATATAAAAATAACCTGGATTAGAATAA
TGGCTAAACTCGAATCCTAATTGTTTATAAATTGATCCATCAGAGTATAATCTATCTGAG
TAACTTATTAATGAGCCTGGGTTATTTTTATGAAAATGTTTTAATAACCTAGAGGCACCA
CCTATTACATTTGTGTTCTTCTTAGTACATAATCTAATTAACTCCCAGTCATACTTATCT
GTAAATCTAGGTTTTCCAAATGACATTAAGCAAACTAACTTATCTTTGTAATAGAGTCCA
TAACACACAGTTGATCCAGTAAATCCTTGGAGATGATTTTTTTCTAAAAATTCTTTCTCT
TCTGCTTTAGATACTTCTTTTAAAATACATTTTCTAGCCATTATTCTCTCAGACTTTCCT
AATTTATTGTTTATAATACTAGTCCATATTTCTTTATTGCTGTACCATGAATGTTCAAAA
ATGTGTAGAAGATGAATACCTTTATTCTCACATTTTAGTGTTTATCCAAATGATAGTCT
TTACCTTTTCCATTACTTTCTGAATGCCAGTAGTCTCCATTACATTCTATGGCTAAGTTA
TGGTCTGGTAAATAGAAGTCAAGTTCTTTATCACTTAACATTGAGTAGTCATTTTCTATA
TAGTTATCTAGTAATTCAGATATTTCTTTTTCAAATGA
```

FIG. 14A. (CJLB-12 [organism= Campylobacter phage CJLB-12] complete genome)

```
AATACTAAAATATTAGCTCTTCAGCTTCAAATTTCAAATTTTAATATAATAAAACAAAAT
CATAAAAAGATTTATAATGTTAAGCAAAGAAGAAATAAAATATTTTCAAACACATAAAAA
TGAAATAACAGACGAACTCTTAGAAACAATTAGAGCTCAAGGAAAACTAGGAAAAGCACA
AGCCTTAGAAATCTTAGATTTACCTAAAGACTCTGATAACTATTACTTAGATGCGTATAA
TACGAGAATTAGTTATAATGGGTCTCGTGGTCTTAAAAAAGCTTACACAAAATTAAACTT
AAGTCCGATACATATCAGCGAGCTTGAAAAATGTGCGAATGATCCACTTTATTTCTTAAG
AAATTATGTGCGAATGACTACACCAAAAGGTTTTGATTTCGTAGATTCTAGGCCATACCA
GGATGAATTTATACAATTGCTGAGCGACGATTCTATCGAAAACGTGATATCAATGCAGCC
TCGTCAATGCATTGAAGCAAATACTAAAATAAATGTAATGGTAATGAAACTACTATTAT
TGAATTATTCAAGAAAAGATTATTGAAAGTTATGAATGTAAAGACAAATATGTAGAAACG
CCTATAGGTAAAGTCAAAATTCTCGAAGTCCATAAAACTATTAAATACAATATTTTTGAG
ATAGAAACCGAAAATGGATTCAAGTTACAAGCATCTGAATTACACGTATTAATAGACGAA
AATGATAACGAATTATATGTTAGAGATTGTTTAAATAAGGTAATTAAAACAAAATCAGGA
CCTTCTAAAATAATATCTAAAACATTTATAAAATATGATCATTGTTATGATTTAACTTTA
GAGCATTATCACCTTTATTACACCAATGGTGTTTAAGTCATAATTCATCTAAATCAACT
ACAACAAGTGTAAAACTTGCGCATTTATCTGTTTTAAAGAAGATATCAACATAGGCATA
GTTGCTTACAGTGGTAACTCGGCACGAGAGTTCTTAGACAAAACAAAGAAAATGTTGATA
GGCTTACCAATATGGATGCAGCCCGGAACAGTTACTTGGAATAAAGGTTCAATAGAATGT
GAAAATAATATAAAGATTTTAACGGACGTACCAAGTTCGGACGCATTCCGTGGAACGTCC
ACAAATATAATCGTTGTAGATGAATGTGCATATTTAGATCCTGCGGGCTGGATAGATTTC
ACTGACGGTGTTTTACCATCACAAGCCGGCTTAGCTTTCAAAAAATTAGTCATTTTATCT
ACACCTAAAGGTAAGAATCATTTTTACGATATTTGGCAGGGTGCTGGTGACACTTTAGAA
ACTTCTATTAATGGATTTGTAAGACATAGGGTAGATTGGAGATTAGTACCAAGGTTTAAA
TCTGACGGTACTAAGTATGATCCTGAAGAATTCAAGCAACAACAAATTAAAACCGGTGGT
TTAGTTGTTTGGAATTCTGCATACGAATGCAAATTTGAAGGTTCTGCGATGACATTGATA
CCTAGTGAAATATTAGATACTTATAAACCACAAGAACCAATAGAAGTTGATAATATTAAG
GATTCTAAAATACTAATATACGAAGAACCAATACCCGGACATAAATACGTTATGGGTGTT
GATACTGCTAAGAAGGTGCTGATTTTACAGGAGTCCAAATATTTGATACTACAGATTTA
AATTTCAGACAAGTAGCATCAGCAAAACTTAAAATAGATTATATGTTATTACCAGAGTTA
CTCAATGAGTATGGTTTAAGGTTCAATCAAGCTTTAATAATTGTAGAAAATAATGAAGGC
TCTGGTCAAGTGGTTGCTGATATTCTCAAAAGAGATTATGAATATGAAAACTTATATTAT
GACGTCAATAAACAAAAACAAAGATTAAAATATCCTGGGTTCAGAACTACAAAATTATCA
AGGGATGTTATTTTACAAACTGTATCAACGTTAGCACAAGCTAATAAATTATTATTAGTG
GACAAAGAAACTATTAAGGAGTTTGGGGTATTTACATTAAATGATAATGGTAAGTACCAA
GCAGCTGTGGGATATCACGATGATTTAGTAATGTCTTGTTGTTTATGTTTGGTATTTTT
ACAAATGTTAAGAACTTTGAAGATATGAAAGAAATTGTAGATTCTTTAAAAAGTTCCGAA
GGAAAAAGTTTTGAGTATCTAACATTTGGAGCTTTTGCAGATGGTCTAGGTACAGAGCCA
GATTCTAATACTGATAATAAGGATTTGAATCTCAGTGATTTGGAATATTATTAAAATTTT
GGATTCTAAATGAAAGAATATATTAAATACAACGATAGAAAATTTACTTTAACAGCTTAC
AAAGTTAAAACTGAAAGAGATTTATTATTAACTGCAAGCTCAGATGATACTGTATGCAGT
AAAGATCTAAATGATTTAAACTTAGACATTTACTTAAGAATCTTAGAACCTTATATAGAT
TCTAATATAAACATTTATGATTTATATCCGGAAGAAAATTATTTTTACTTTATAGATTA
AGAGCAACTTCAGTTCTGACCAATTATCTTTAAATACTAGGTGTGATTGTGGTTGTACT
TTTAAATCTAACATAGATTTAGGAAAAATTGGAGATCTCCATAGTATTGATACAAATACA
TACCCAGATTTGAAAGACGTTTATAGCCCAAATTTAACCGACATATACAGTGATTCTTAC
TTAGAATCTAATATTGTGGATTGTGATTCTGAATTAGATATGTATTTAGAAGCTAATACT
ACTAAATTTAACTTTATTAAAGTTGTTAAATGTTATAATTGTAAGAAAGATCTTGAAATT
GATTTAACAAACCCAGAAATATATAAAAATATATTTTCAGAGAATCCTATAGGTGAGTTC
TACAAAAGTTTGACAAGATTATCATTTCTAGGTAAGTTTACCATAGATGGTATTTTAAAT
GATTTATATCCATTTGAAAGAGAAATCTTTATAAGTTTAATAAATGATGAAGTAGAAGAA
CAAAATAAAGCACTTAAAAAACAATCTTAGTCTTTAAGTGCTTGTGTGAGTTACTTTGTA
TGGTTTTTATCTAATCTACTCTTAATACTTTCATTGATTTCAACAGTTATTTCAGATTTT
AAGTCATTCTTGACTTCTGACTTAACTTCAGATTTTACATCATCCTTAATATCATTCTTA
ATATTTCAGCAAGTTTAGCTAAATCTTTATTTTTGTTTTCTTTGAGCTGATCAATA
ATAACTTCTGGTTTTTTAGAACAACCAATTAAACTACCATTAAGATCTTGTTGTGGTGTT
ACATAATTTCCCGTCGATAAGTATAAAACACCGTCTACACAAACTTGATTAATTCTGGAA
TCCGAAGTTCCACGAACTTCTTTGCCTGTTTATCGCTGGAATAATCAGATCCACACCCT
ATTATAAACAAAGCTAACAAAGCTATAACGAAACATTTTAGATTCTTCATAGACCCTCTT
TTAATATTATTTATGATTTATGATTTTTGATTTAAAACTTTAGTTTTGAATTAAGAATG
TTTTAAGATATTTTATAATATAATTACTCAAAGGAGATTGAAATGAAAGAATTTTTTTAT
AATTTAATAGCACAAATCAAAGGGCTTAAAATTCATAAAAATGAAAAAGATACTTGGTAT
TTAAAATGGGATTTACACACCGGGTATTATATTGAAGGTTTAAATACTAAACGTAGATTA
TATTGTAGTGGTTATTCTGATAGTTTAAACAATTAAAATATTTGTATTGAAGCTTTGTA
TTAGTGTGAATAATAAAACGTTAAGATACTTTTAAGATATTTTACAATATAATATCATAA
AGGAGATATAATGATTAAGAAACTGACTGATAGAGAACATATTCTAAAAGACCTAGTAT
GTATATAGGTGCTATAGATTCTACAAATACAGAAGATTTATTATAGAATCAGGTAAAAT
TAAATACACTACTTTGAATTATGTACCCGGTTTAATTAAAATAATCAATGAGATTATCGA
```

FIG. 14B. Continuation of (CJLB-12 [organism= Campylobacter phage CJLB-12] complete genome)

```
TAATTCAGTAGATGCTGCAATTAGATCTAAATTTAAATCTGGCTTAAATATCAGTGTTAA
AATATCTAATGATACTGTTAGCATTGAAGATGATGGAACTGGTATACCAGTAATAAAATC
AGGTGACCACTATATGCCAGAACTAGCTTGGAATCACGCTAAAGCAGGTTCTAACTTCGA
TGATGATGCTAATCGTGTAACAATAGGTACCAACGGAGTTGGAAGTTATTGTACAAATGT
TTGGAGTATTAATTTTAAAGGTATTACAGACGATGGTAAAAATAGATATATTTTTAAATC
TAAAAACAATGCTGAAACTTATAGTGAAAATATAGAAGCTTCTAAAAAATCAGGAACTTT
AGTAGAATTTAAACCAGATTTAGAAAGATTTAATCTTAAAGAAATCGATGAAACTCATAA
GAATATAATCTATCAAGATTATTAAACTTAGCTATTTGTTACCCAGAAATTAATTTTAA
ATTTAATTCTAAGAAAATAGATTTTAAATCTTTTAAGAATTATTTAAATATGTTTAGTTC
AGATTTTGAACTATATGAAAATCAAAATATTAAAATTGGTATCATCCCAAATGAATTGGA
TGACTTTAAACAATTTAGTTTTGTTAATGGTTTAAAAATACCAGACGGTGGTGTTCACAT
AGATACTATTATGAATAACGTAGTTCAGGGTATAAGAGACAAATTAGTCAAAAATATAA
AAGTATTAAACCTGGCGATATTAAAAATAAATTAATGATTGTTTGTTTTATTAATGGAAT
GCCAAATCTTAAATTTAATTCACAATCTAAAGAAAAATTACAAACTCAGTAAAAGAATT
TAATGAATTCTCTAACATAGATTATGGATTCATCAATAAAATTCTTAAAAATAAATCTAT
TATAGATCCTATTATAGACATATATAAAGTTAAAGAAGCTTTAAATGCAGATAAAGCTCT
TAAGAGTGTAGAAAAATCTAAGAAGTTAAAATCTGAAAAATATTTTAGAGCAACAAAAAG
TCAAAAATATCTTTGTATTTGTGAAGGTTTTTCCGCTTATGGTGGTATATCACAAGTTCT
TGGAAATGAACATACGAGCTTCTATGTTCTTAAAGGTAAACCATTAAATTCTTGGGATGT
CACTAATCAAAAATTTGCAGCCAATCGCGAATTATCTGAATTATATCAAATACTTTCTGA
GAACGCAGAATTTGAAGATCTACAAGATGGTAAATTCTATGAAGTCACAATAGATGGTAA
AACATATATTATGAATGAAAATGATACAATTGAAATTAATAATATTAAATATAATTTTGA
AGATCTACAAAAAGGATTGTAATGAGACCAGTTAGAATAGCAATTTCAGGAGCTCAATGT
TCTGGTAAAACTACATTAATTAATTTAATGAAGAAACATAGTTATTTTAAGAATTTTGAT
TTCATAGAATCATTTTCTAATAAAATAGCTAAAACAAACAAGAAACACTCAGAAAATACA
AACTTAGCAACACAGTTGCAAATGTTGTATTATAGTGTTAATGCTTTAAAAAATATAAAT
GCACCCACTGTGCACGATAGGTGTATTTTGGATGTTATAGTATATACAGGTATTAACAAA
GACATCGATTTAAAATTATTCACAGATTCTTAATAAAATATTATAAACAGTTCGATTTT
ATTTTGTTTTAGATTCTGAAAATATACCATTAGAATCAAATGGTGTTAGATCAATAGAT
CCTGAATTTAGATCTAAAATAAACAATATTTTTAAGAAAGTAGACTTAGAAAACGTCATT
CACTTAGATTCTAAATTAGACCCAGATTCTAGGATATTAAAAATAATCGAAGCTATAAAA
TCTAAAACTAATTAATAGGAGAAATAATGGATTTGAATCTTTATATACATAAAACAAATG
AAGATGCCGTAATACCAGAAATTGCTTATAATGGAACTTCAGCAGCATTTGATATTACTT
GCACCGAAACACTGAAATTAAACCAGGAGAATCAAAAGTTGTTCCAAATGGATTAAGAA
TTTCAATTGATGAAAAGATCCTTTTATATGACCGTTCATTTAAGAAGTTCTTTAGGTT
TTAAAAAAGATCTAATTCCACATATTGGTATTATTGACGCTGGATATACTGGAGATTTTG
GAGTTAAAATTAATAATATTGGTAAAGAAACTATAGTTATTGAAAAAGGTTCAAGATATG
CGCAAGTTTTAATTCATAGAAAATATAGTTTTAAGTTCGTCGAACTTAATAATTCTGAAT
TCAAGGATTTTGAAGCTAAGCAAGAAAGAGGGTCTAAAGGATTTGGATCGAGTGGTAAAT
CTTAAAAGATTTGCACATTTTAATAATTCTTAATAAGGATTTAAGTATGAATACAATAAA
ATTTTATCATAGACAAAAGGAATATGTAGTTCAATCTCAAAATATTAATCAACATACATT
TAATAAGAACTATAATAAAGTTCTAGCATTATTAAATGAAAATGAAATTAAATCTATTAA
TGAATGTGAATTAATACCAGCGGGTAAAACTGATATTTTAAAATTATCTACAATGGGTAG
TGATGGGTTAATACAAGAGTTTGAATTAAGATTAGAAAAACGTTTACTAATAGGAGATATA
GGTGTTAGACTTTGTAGATATTAAGTATTTTAAGTTAGCAGTTCCTGGAACTTATAAAGA
AAGTTCTTTGGATATTGCTGTTAAATGTCCAATTTGCGGAGACTCAAAATATAAAAAATC
TGTTAAAAGACTACACCTATATGAAAAACAAGGAGTTACTTTAGTTCATTGTTTTAATGG
TGATTGTGAATTAAATACTCAAATGAGTTTAAGTAATTCTTAAAGATTTATAAACCAGA
ATTATTATTGCCGTATAAATCAGAGAATTTTAAATTTAAAATTAATTCAATTGATTCTAG
TACCAAATCTAACATAGAAAGTAATAATGAAATAGAGACTATGAAGTCTTGTTTTGATTC
TAGTGCTAGCAATACTAGCGATTCTAATGAATCTAGCAATACAAGTATTGAAAACATTGC
TAGCTCTACTAGCATTGAAAGCTCCAACAATGGGTTCAAATATATTAACTTAACTTCAGT
GTTAGACACTAATACAAGTAAACAAATAGAGTTTTTAAAATCTCGTGGGTTTAACGATGA
TACTATTAACTTTTTAGATTTCTATAATGGAACTAAATCTTTTAATTTAAATGGTGTTTA
TTATGGAATCAAGACTATCTTGTAATTCCATTTTCTAAAGACTCTAATTATTATGGGTT
CTATGCAAGATCTTTAACTGAAAAAGATTTATTAATTTTACATTGAATCAAAATTATGG
AGTTTGGAATCTATTTAATGTTGATTTAAATAAACCAGTTTTATATTTGAAGCTATTCT
CGATGCTTTGTCTTTTAGACAAATATACAGAACTAATCAAATAATAGCTTTAAATACTTC
CACAATAGCAAAGAATGTTTTAGATTTAATAAAAGTGCCCTTTCTTTTGTTTAGATAACGA
CAAAGTTGGAATTGAAAAAATGATAAAATATAATTCGATACCAAATAGTCATTTTATATG
TTATCCAAATGATTTAACACAAAAAGATTTTAATGAAATGCTTCAAAATAATATTAAAAT
AGAACTTGTTTTTAAGAAAGGCTTCGGTGCTTTATTACATTTAAAATCTTTATTATGATT
TTAATTATAAATAAAAAGGATAATAAAATGGTAAAAAGACAAAAGAGTATCGAAAATATA
GTACTTAATTTTCCATCCAAAAATTGTGTATTAAAGGAAGTTCCGTCAAAAGGTGAGAAA
AATAATGAGATTTTCTTTGATAAATATTTTAAATAAAAATGAAATAGCACACTTTTCAGT
CCAAAAGTTTTAGGGAGTTTTGAATTAATTGGCAACGGTGAAAATCTAAACAATTATTAC
```

FIG. 14C. Continuation of (CJLB-12 [organism= Campylobacter phage CJLB-12] complete genome)

```
AAAGAATTATAGAATCAAGTACAAACGAAAACGACATAGTAATGGACTTTTTTGCAGGAA
GTGGCACTACCCTAGCTGTAATTAATTGGCAACGGTGGTGGAAATTTTGTTTATGCTGAA
CTTATGCCTTTAAATGCAATTTATAAAGAAAAAATACAAAATTTAAATGATGAAAAAGAA
TTAGATAATATTTATCAAGAGTTAAAAACTAAAGCTTTTTTAGATTATAGAGTAGATATA
AATAAAATTTTAAAAGATAAAGAATTTGAAAATTTAGACTTAGAAAGCAAAAAAGAAATT
TTAAAACTTGTTTTAGATTCTAATATGGATTATGTTTTGTATGGTGATATAAAAGATGAA
GATTATGTCATATCTGAAGAAATAATAAAACTTAATAAAATATTTTATGAGGTGTGCTAA
ACATTCTTAAGATATAAAATCTGTAAAAATTTGTATCATTTCATAGATTTGGGTCGTATT
TAAATTTAATAATCCACTATGGTGTAAGTTTATATTAATGTTATAATTTTAAATTAAATT
TTAATTTTGTATCAAGCTAAAATATATTATAATTAAGAAAATATTAAAAGGAGTTCAATG
ACAGTAGATTTAAAACACGATATTTGGGTAGAAAAATATCGTCCTCAAAAAATTGATGAC
TTAATTTTACCAAATGTTTATTTAGATAAATTTAGAAAATATATTGAAAAACCGTCAAAC
ATTTTATTAAGTTCAGTAAACCCAGGAACAGGAAAAACAAGCACAGCACAAGCCATTATA
AAAGAAGGTAATTTTGAATCTTTATATATTAACGCTTCATTAGAATCTGGTATTGATACT
ATGAGAAGTAAAATATTACAATTTGCTAGTACTGAAAGCTTTGATGGAAAACCTAAAATT
GTTTTAGCAGATGAATTTGACTACTTTGGCCAAAATGGTCAAGCAGCTGCAAGAGCACTT
ATTGAAGAAGTTGCTGCTAATTGTAGATTCATATTAACTTGTAATTATGTTTCTAATATA
ATGCCTCCTATAGTTAACAGATTTGAAGTATTTGATTTTGATGTTGTTCACGCTTCTAAT
AAACAAGAACTTGTTCAAAAAGCTTTTAATTTACTAAAAGAAATCTTAGATAATGAAAAA
GTTCTTATACAAATGAGGATCTTGTTAATATTATTAAGAACTATTATCCAAGTATAAGA
GGTATGATTGCTTGTTTACAAAAATGTAATTTCAATAATAAATTAGTTCTTGACATTCAA
AAAGATTCTGATTTTGAAGGTTTAATTAACTTAATTAGATCTCGCGATTTCGATAATTTA
ATGAAAGTAGTTTATGGTTTAACAAACCCAGATGCTTTTTATGAATATGCATTTAAAAAA
TTAGATATTCAAATAATAATAAACCACAAGCTATCATAATACTAGCTAAATATCAATAC
CAAAGTGCTTTCTCAAGAGATAGAAACTTAAATTTAGCTGCTTGTATTATGGAATTAGCA
CCATTATTGTAAGGATTATATATGATTTTATATGATTTAAGTTCTTTGATTCACAGAGCT
TTACATACTAGTATTAAGCAAATGAATCCACATAAAAAAGACGGTAAATATATTACTGAA
GAATTCATAAGTGGGACTATTTTTAGAATTATAGAAGAATTATTAGAAAATTATAGACTT
TATAGAGGTAAATATAATACTATGGTTATTTGTATAGATGATCATAGTGTTCCATATTGG
AGAAAATCTTTATATCCAGATTATAAAGCTCAAAGAAAAACTCAAAGAGAAGAATCTGAA
GTTAATTTTAAAGAAGTTTATAAACATATTATATACTAATAATATTCTAAATGATTAT
ACACCATTTAAAGCTATTGGTGTCCCAGGAGCTGAAGCTGATGATATCATTGGTGTATTA
ACTAGGAAGTTCTGCAAAGCAGAATCTATTTTAATTCTAAGTCCCGATAAAGACTTTAAA
CAATTGCATAAATTAGGCGATATAAAACAATATTCAGCAATAACTAATAAATGGATCATT
AATGATGATCCAGAAGGTTGGGAAAGAATACATTGTTGTTTAGGTGATGCTGCTGATAAT
GTACCACGTGTTGTGGATTTTTCGGAATTTACACCTGAGTTTAAAGCTTATTATCAAGGA
ACCGAATTAGATTTCTATAAGTTAGATGAAAACTTAAAACTAGGTATTATTAATAATTTT
AATGAAATTTATCCTGATGTTGAAGTTTATAAAAAACAAAGATTTGGTGAAGCTGCTTTA
AATAAAAAGATTAAAGAGTTTGGTTCTTTAGACGCCTTCTTAGATTCTAACGAAATATAT
AGACTTAATTATAATCGTAATTATAAGTTAGTTATGGATAGTGAAATACCTATTGATATT
GAATTAGAAATCTTAAAGAAATATACAGAATCTAGTACAGATTTTAATATGGAAAATCTT
AATAAGTATTTTTCATTTTATAATATAACTACTTGTAGTCAATGGTTTAGTCAATTATGG
AATGAAATGAGTAAACCTATAGAAATGACACCTTGGAATGTGGATTTTAGTAAGATCTAA
AATCCCTTCATATCTTAACAAAAACAGGGTTTAAATCAATTTTAAATTAAAGGAGTGTTA
TGATATTCTTAACTGGAGGAAATGGTCATTTAGCCAGTTTATTGGGTAGGGTGCCCTAGC
AGTACAAAAGATATAGATAGCTTTGCATTTGTTATAAATTATATTATAGATCGGAAATAA
ATATCCAAAAAGGCTCAGCAGTGAACGTAAGATTACGTATTATTAATAATCAGCAAGTA
CCAGAATTACCAAGTTTCACAGATTCTAAAGAAGATAACTTAACTACAGATGTTAAATTA
GATGTCTTAACACACCAAGAAGTAGATAGAAACTTTGCTAATATTATTACGTGGTTAAAA
ACTGTTAGTGATAAAATAATTGAGCAATCTACAGTTCTAAAACAATTAGATCCCGAAAAT
ATGGAGAAACTTTTAAAAGCTGCTGAACAAATACAAACCATTACTGATGATATTAAAAGC
TTAGAAACTAAATACAACCAAGTTAATAATGATTTAACAAATTATAAAACTTCAAATGAT
TTAGCTTTATCTAAGAAATTAGATTCTATAAAAACTATAAATGGAACTGATATCACAGGT
TCAGGAAATGCTGAAATTAATATAACAAGAACTCAATTCACAAATCACTTAACTAATATT
GGCATTAATGAAATTGGCAGTATAGCTATATTAGATTCAAAAACAACTTTAGTTTTTAAT
AATTTATATGCAGGATCTGGTTTATCTACAGACACTTATGCATATATGCAAGGTACTTGG
AAATGTACTGGTAAAATAAGCGATACTAAAGGCTTATTCATCAGAGTATCGTAATCAAAA
ACTTAAGCAGATTTTAAGCATTTATATAATATATAATAATAACAAATAAGGAGATTTAAT
GGTATTAGAATATAACCCTATCAAATTAGGTAATAGATCTATTAAAGTTCGTAATTGGAA
AGTTAAAGATAGAGAACTCTATAAAAGTAAATTAAAAAATACTAGTTCCACAGAAGACGA
ACTTAAAGCAAGATATGAATGTTTTGTTACAAATGTTTTAGAAAACCCGACAGCTTTAAA
TAACGACGAATTAGAATATTTGTTTTTATTGTTAAGAATTATAAATCTTGGTGATGATTT
AAATTACAGTTGGTGGTGCAGAAGTTGTGAAAAAACTACTGATTCTAAAATTAAATTAAG
CAAACTATTTACAACAAAATCAGGTAAAATCCAAGATATTGATATTGGTGATATCAAAAT
TGAACTACAAGATGTTCAAAATATCGAACTCTATAATAACAAATTAAGAACTTCAGATTC
ACCAAGCACAGATGATTTGATTTTCCATATTAAATCTATCAATGGGGATAACACAAAAGG
```

FIG. 14D. Continuation of (CJLB-12 [organism= Campylobacter phage CJLB-12] complete genome)

```
CTTCCAAGATATTAAGGACTACTTCAATGAGTTAGATATTAATATAATGGATAAGATTTC
TGAAGCATTTGAAAAAATGATATTTAAAATTGAATCTAGGGAACATACAGTAACTTGTTC
ACGTTGTGGTGCTAGTTCAACTTTTAATTTCGATGTAATACCAGATATTATACCCCCAAA
ATGGTTAAAACGTTAAGAAAGGATTAAATTATGAGTATGTATATAACATATATAGATCAA
GGTGCTTATAATATGATTGTTTCCGCGCAAAGAGACAATGCTTTTTTGTTACCGGGGTCT
AGCACATTAGAAGTTTTTGATAGTAAATTATTTACAGCAGTTTTGGAAGCATTAGCAGAT
AAAAAAACTTGTAAATTCTATAAAGATATTGATGTGTTAACTTTAGAAAACTTGGAAATT
GACGAGAGTGCTAACTTAGTTAAGAATTCATATATTTTCCAATTAACTTCTGCAATTAGT
CAGATTTTTACGAGAATACCACAATATACTTATTTTAGATTCCAATATCTTAATAATATA
TTTGCTTCACAAGGTTATTTTATAACTGATGATAATCGTGAAGAGATGTATATTAAAATT
CTTGAAACTGATAATGATAAATTAATCGCTAGTCTTGAAGAATATCTTAAGATTGTGAAT
CAATTAAATCAATATGAAAAAATGTATCAAGAATTCTTAAATGGTTTAGATGAAATGGAA
ATGACAGATGATGAAGCAACTTTAGATCAAATCTTACAAGAAGCTTTAAATTATTTTACG
AACGCTCAAAAGAATTTCGTAACTATGGATTATAAAGGATGGTTTTCAACAATTAAAGCA
GATTATGAAAATCGTCAAAATTCAGCTCAGCCTTCAAATCAAACTAAAAATAAAGATCTA
AGATAACTTAGATCTTTCTCACTTTAACATTTAAATTCTAAAATTTTAAATTTCTAAAT
TCAAAAAACTTTAAGTTGTTATATTATATAATATGAAAAAGGAGATTAAATGATTTTCAA
AACAAGAACTAAAAAAGTTCCATTCTATGAATTTTTTGGTGACACCATTCAAGGTGAAGG
GCCAAGATTAAAATCTGCAGTATTTGTTAGAGTTGCTGGTTGTAATAATACTTGTAAAGG
TTTTGGATGCTCTGCAGTAGCTCCAGATGGTTCGGTAGTAACAGGTTGTGATACTATTCG
TGCAGTATCTCCAAAATTTAAATCACAATGGAAATACTTTGATAATTTCAAAGATTTAAC
ATCAATTATTGACCCATTAGTCACATTTAAAAACTCTGAAATTAAACATACCAAAGATAT
TATTTTAACTGGCGGTGAACCTTTATTATATTGGGATACTAATGTTATTCAAGATTTCTT
AGCTTATTATATTTCAAGAAAACATCAAATAACAATAGAGACTAATGCAAGTTTGGATAT
TGAGTTCTTTAAAGAATACCAAAAAGAAATTATGTTCAGTATGTCAGTTAAATTAAGTTG
TTCAGGAGAACCTAAAAAGAAAAGAATTAATATAAAAACAATCAGTAAGATTCTTGAAAA
TTGTCCTAAATCTTATCTTAAATTTGTAGTTAATCCAGAAACTTGGGATACGGACTACAC
TGAAATAAAAGAAATACTTTATGATTTACCTATATATACTGAAGTATATCTAATGCCTAT
GGGTGAAACTCGTGAATTACAGATTAAGAATACACCATTTGTGTTTGAAAAATGTGCTGA
GCACGGATTTAGTTTTAGTCCAAGAGCACATATTTTAGCTTTTGATACTAAGGAGGGTAT
ATAATGTTAAGTAATTATGCACAATATAATATATTAGAAACAACTGGTTTAATTATTATT
AAATTTTTGTTATTATTAGTTGAATTAGGCTTCTATGTGTCGGCTTTATTTTTAGCAGTT
CTTAGCATTATCAGTGTGTTTAAAATACCAGGAGTATTTTATAAGTTATTCGTTTTTATT
GTTTTAGGTTTAGCAGCGTTTGCTTGTTTAAGTTTAGGCTATACTATAGGTTTAACTAAT
ATTGAATTTATATTTAAGATTTAAGGAGTTAATATGAACTTAATAATTGGTTTTGGTGTA
GTCGGACAAAGCTTAGGAAATTATTTTGATTCTAAAGGCATTGAATATAATATAATAGAT
CCAAGATTTAATGATAAAGATCTTAATGAAATTGGTTTAAATTGTTATAGCAAGATTTTT
ATATGCATTAATGTGTTAAATGATAATATTGATTCAAATCAAGACACAAAAACATTATAC
GAAATTTTAAATACCATAGAATCAAAAGATTTTAGTGGTTTAGTTGTTATTAGATCAACA
TTGTTGCCTAGTAATGTAGATTTTATAGAATCTGAATACAATTTAAAATTTGTAACCTGG
CCAGAATTTCTAACAGAAGTTGAATCATTGAAACGAGCAAAATATCACGTGATAGGCGCT
AATAATATTATGTATGCTAAAGAAATTGCTGAATTAATAGATACGCCTTATGATTTTGT
AGTCTTAGAGAAGCAATGGAAGTTAAATACGCTAGAAATGCTTTAGGTGCTTTAAAGGTA
TTATTCTTTCACGAATTAAATGAAGCTGGGTTCAATGTTAGAAAAATAGAATTATTATTA
AATGAGTTCGAAGATTTTGATTCTCAAGGATTAATGGCTAAGTTATGTGTAGATGGTAAA
AAAGGTTTTGGTGGTAAATGTTTTCCTAAAGATGTCCAAGCACTGACGTTTGAGTCTAAT
AAACAATCTAAACAAGCTGGAGATTTCTTTAGAAATATTTTAGAAGCTAATAATCGACTT
AGATATTGTTATAAAAAATCATAAATATATTAAATTTAAAGGTGTTAAATGAATATGAAT
GTACAAAATCCAAAATTTTCTTTTACTGAAGATCAAACAAAACAAGTTCTTATGACAGCC
TATCATCTAAGTCAAGCTTCAGAATATATTCAAGAAACCAATGGTATGATGTCTTTAATG
TTTAATTCTATGGCTATTGAATTATTAGATCAAGCTGGATTATCCCAAGCATTTTTAGAT
GAATTAGGATATACTAAAACAACTGAGCCTAAGATTCAACTTAATAAGAAAGAACAAGGA
GAAGTAGACTCTTTATTTGATGAGATTTTAAATGGATCTAAATCTACACCAAATGTAGAA
ACTGAAGTTAAAGATTCAAAATTAAAGATTCAAAAGGAATATAATGGTTCAACAAGAATT
AAGAAAAATAATTTTTATATTATTTGATGAACGTTTGCTTTCACAAGTTGTAGAAATGTT
CGAAAAATACGAATATATCATAGAAAATAACCCAGAGGGTATAGAAACAAGAACTGCGTA
TTTAATTTCGAAAATATATACAACTGATGATAAATCTAAAGTTTTAGATTATTTAAAACA
ATTGGGTGAATTAGAAGCTACTGATATTTTTCCAGATATCAAAATGCTCCAATGTAAATT
AGCTATGAATTGTTATGAAAACAATTTAATTGAATATAGTAAATTAATAGCAACATTTGA
TAAAAATGATTTGGATTACGCACAAGCAAATAACCCAGTAGTTTACAACACACCAGCGTT
GTACAGAGTTTCTATCAATGGTAAAGATTTTGATGATAATATTAATAATATCAATAAATG
TCTGACTTATTTAGGTGATAAGGTTGTATTTAGACAAACAATTGATAAAGTAGATAGACC
AAGTTATAAAAATTATCTTAAGATTAGACATTCTTTAGAACTTGGTGATTATGATTATGG
GTTTGATGCTGTTAAAGCATTACAAGAATTATTTTATCAAGAAGGTTTAGATGCTAAAAT
AAACTCTGTTAATTATAAAGAACTTTTAAGTGATTATATTATAATAATGGATTTTATGAG
TGCTTTCCAATTACTTGGGTATAAGTTTACCGATAAACCAGAATATAACAAATTAAAGCA
```

FIG. 14E. Continuation of (CJLB-12 [organism= Campylobacter phage CJLB-12] complete genome)

```
AATGTTTAAAGATATTATTATAGAATTAAGTGTAGATTCTTTATTAATTTTAGAAACTTC
TCAAGAAAATGTTCTCAAAATTATTGCAGAAACTAAAAAACGTCTTATAAATGATGTAAA
ATATGATGCTAGTGAAGTTGATGCTTATTTGGGTCCAATTTTACAAAGGATTAAAGACAG
TGGTAAAAGATTTAATAGATAAAAATCAAGCCGAAGTTCAGTTAAAAATACAAGATTTGC
AAGACATCAGAGTGGGTATAAAATATGCTTTGCGTTGTGCTAAAAAGATTAGTTTAAATT
CTGAATCTAACTCAAGTTTAGATTCGGATTTAAGCCAAGAAGAACTAAACTTTTTAGCTT
GTTTAACTTGCTTACCTAAGACCAAAACTAAAAACAAAGGTTAAAATGGCAGGTAAACTA
ATAGTAGAATTTAGCTTAGATACTAAATGTAACTTAGCTTGTAAATATTGTTATAGTGCG
CATACGCCACCAAACCCTATGTCTATAGACACAGCTATGAAATTCTTTGATAGAATTAAT
TATATGTTAGATTATTATGATAAAGATAGCTATCATATTTCATACTTTGGTGGGAACCT
TTATTAAACTGGGAAGTGATTGAAGCAACTTTACCAAAATTCCAAGAAGATCCAAGATGT
ACCAGCTATGTTGTGATAACTAATGGTGCATTATTAGACCCTAAAAAAGTTCAGTTCTTA
AAGGCTCATAATTGTGGAATTTCACTGAGTTTTGATGGTCTATGGCAAAATACTAATCGA
CCAGTGGCTGAAGGTACTTTTGAAGGAACTTTAGATTATTTTAAGCAAAATAAAGCATTA
ATTCATAGCATTACAGATACCTGTAAAGTTATGATACAACCCAAGAACTTCACAACAATG
ACTGAAAATTTTGAGTTTTTTGTTAACGATTATGAATTCTTAAGACCCGATTTTTGTTTA
GTTCGTGATAACATTTATACTAAAAGTCAAATAGAAACATTTGCTATAGAAGTTGAAAGA
TTAGCACATAAAGTACTTGAATATCAACATAAAGGAATACCAGCAAGTGTAGGATTATTT
GATTTATATGCTTTAGATATTTAGCAGGTGCTAGATTGGTAAAAGAGACCACGGTTGT
TTCGTAGGAAATAACGGTTGTTTATATGCGGTAGATCGTAAATTCTCGCCTTGCGAGCGA
TACAGATCAACTAATAAAATGGTTCTATATAGTCCAGAATCTGGATTAAATCTAAAGAAT
CTTAAGTTTATGTCTAAATACGCTGACCCAAGAAAATTCAAGAAATGTATGAAGTGCGAA
ATTCGTGAGTATTGTAATGTTGGGTGTACACACCAAGAAATGCGAGAAGCTAAATTCGAA
GGTAGAGAACCAATAGATTCTGTATGTCATTTATTTAAACATTCTTTTAAGTGGGCTATG
TTTGTTTTTAAGAACTCTACTAAAGAATACAAAGATTATCTATATAGAAGACTTGAAGTT
GGATCTTGATACCTTTAGTATATCTAACACTCGAGTGTTATTTTTAAAAGCCTTTAATCA
AAATTTAAACAAAATTAGGATATAATTAATTATGGCAAATATATTCGAACAATTTACAAA
CTGTCTCAAAGACAAAGATTATAATGAGAGTTTAGGTTTTAATAGCTTTATGTTTTGTAG
ATTTTTAGGGTCAAGCCCTAGCACTTTACAATTAGCTAATGATATTAATATATTATATAA
AAGCTTACCAGATGAAGCACAATATAATTTAGTGAGATACACAAAAAATAAACCAAAATT
TATAAGATTTGCGAAAGCGTTAGCTGAATCAGAATCTATCAAAGAAATACAATTAAAATA
TAAGGTAAATAAAGAAGTAGCTAAATTATATGCAAGTATTTTAGATTCTATGTGTAAATC
TTAATCAAAGGAGCTATATTAGCTCCAATAATTAAAACATTACACTCCATTGAATTCTGA
ATGCAACTGTTGATTCTTTTACTTTACCTTTAAAGGTTCTCATAGCAATTAAATTTGTAC
CACTATACAAACCAGCTTCAGTATAAACTACACCATCATTAGCACAGTTAAAAGCATCTT
GCGCAATATTAATAGTATAAGTTACTACAGGCTCTGCTTGCTCAATACCAGTAACTGTAA
TATCTACTGTAGAGTTATTATTAGCACCATCCTGAACGTTTGTAGCAGCAGTGTTAACCA
TATTACCACTTGGTGTAAAAATTACTTGGTTCCAAGTTCTATTAATATCACCTTGTTCTT
GACCACTGAAAATATCAGTAACAGACGCAGTAAATCCAGTAGTTTCATCCTTTGGTGTTA
AAATATCAGAACCTTGGTGTCCTTTGGTACCCATAACAAATCTATTAATAGCATTGCTTT
CATTGATACCAGCAATCAATTTAGCAAATTCAGCTCTTGCTACATTTGTAATAAGATTTT
TCTGTTCGAATTTATCTATAATATTACCATTAGCATCTAAACTTTCAATACAAAAATAAC
CTCTGGCAGGTGTTTTTTGAACTTCTTTAAAATTCATATTAGACCTTTATGATTTTTGA
TATATTTATTTAGTAATAAATAAAACAAAAAGTGAATACAATGCAAAAAGATCAAATTGA
TATATCTATATTAAATGCAAACAAATATTTAACTAGCCAAGCAAGAAAAGAAGCTTTTAT
CTATGATAAAGTTAAAGTAGAAGAAAAATATGATGGTATTAAAGTAACTATAGTTCATAT
AGATAAAACTGGTGATTATAAACAAGATTTTATTGTTTCATACAAATCCAATATTATATA
TCCTGATGAGTTTGAATACGCAGCCAAATCCAAAATAAGACCTGAAAGCATTAATAATTC
ACAATTTACATTTATTTTCGATATTCTTAAAAAATGTGATTCAAAGAGTTTACCTTTAAA
TTATGAATTCTTTGTAGAATTCTTGATGAAAAAACCTACATTACAACATAAGTATAAGAA
GATGGGCGCAATTTTATTAGCTTATAGCCCTTGTACTTATGAAGTCAAATTTGGGAGATT
ATTCACAAAACCAAAAGGTTTCTATACAGATTCAAGAGAAACTTATGCTAAGAAATTAGG
ATTTGATTACCCAAGAACTATATTTGAAGGTAATTTCGCTAATTTCGAACGTGGTATCAA
ATCACAAGAACTCAATGATATTTTTAGAACTTATAAAAATATTCTTAAAATAGAAAACAT
AGATTTATATATACAACAATATCTGAAATGTTTCTTAAAATGGAATCTAAGTATGGTGG
TAAACCTGAAGGTTATGTTTAACTTATCCTGGATTCTTATTAAAAATTCAACAACCTTA
TCAAGTGGATCCTAAAGCAAGAGCAGAAACACGTTCACAATATCAAGGAGATCCTGATAC
TGAAAATGCTTATTGGGCTAACGTTAGATTAGCAGCTTTAATATTATTGGAGCTAGTAA
TATTAAAGGTTCTTTAAATGAAATACTTCAAAGGTATGGGAAGCTCTTAAGAAATATAA
GTTGAATTTTACACATCCTAAAAAGACACAATTTCAAATAAAAGATGATATTCAAGGTAA
TATCAAAATGATCGTTATTAAAAGACTTAAAGGAAATAATAACTTTTTATTCTTAGGCAA
GTTTAGAATTTTAACTAAAGCTCATTATAATATTATTAAAAATGGATTAAAAAAATACGA
TAATGGTGTAGTCTGTTTGGTAACTTCAAAAGATACTAAAGAATTTGAAGATCTTAGATT
AGAAATGTTAAAATCTTGTTTTCCTGAAATTGAAATTATACAACATAGTACAGGAAATAT
TATTAGTATTATGAATAAATCTAAAATGAATATAAATGCTGTTTATGTGGTAGTGATAG
ATATAATGACTATGTAAACCAATTAAGAGCTAACCCAGATATTCAAGTTGTCGAAACGCC
```

FIG. 14F. Continuation of (CJLB-12 [organism= Campylobacter phage CJLB-12] complete genome)

```
TAGAGATACTGGCGCTATTTCTGCAACTGCAGTAATTGAGAATCTAAATTCAGAAATTTT
CTTTAAAAGAAATACACCAAGTGAAATACATTCTATGTATAATAAAATATTAAAAAGATT
TAAAAGCTTAGGTTTAGTATCAGATTTGTCTAAAGAACCAGAAAATAAATAACAAAAAAT
GACGGGCAAGGTTTAAAATGACTGAGTTAAGATTAAATGTAGATTCTAAAGATATCATAG
AAGCGGGAGATTATAAATCTACCCAAAGAGGTATGTTAACATTTTCTAAAAATGCCGTGT
ATTTAGGTGATGGTAACAAAGCTAATAAAATTATAGATGCAGAAAGCTTAAAAACCGAAA
TAGAAAAAGTTCAAAATAATGTAAATAACACTATAACTCAGCAAATACAAAATGTAAATA
ACACTATAACTCAAGTTCAAAACACACCTGCAGTTCAATTTTTAAACATATGTGATAATG
CGACTGATTTAGCCACGTTAAAATCAAGTGTTACATTAAAAAATGTTTTGATAATTGGG
TAAGACATTCTATTATGAATTCTGCTAGTGGTCCTAAATTAGATGATGATGCTGGTCAAG
CAGAAGCTGCTAAATGGTCTTACATAGAAGCAGAAGATGCTATAGCAAGTAATATAAATT
CAAGTTATTATAATATGTTTTTAAGTAATGGCGTCAAAGATACTTATAGTGTGCAAATAT
CAGCTGTGGGCCAAGATAATGATGATGATGTTTAAGTATTGTTGTAGCAGCTAAAATGA
TCAATGGTAAATTATATACATTAAGCGCAGTGAGATCTTTACAATTAAACGCTTTACCAG
GTGGTACTTCGTGGGGTTTATTTTTTAATTATTGTGGCAACAATGAAGAACCTTATACAA
CTTATAGGTTATTAGCTTCTAAAGGCAATATTACAGATAATTATCCTAAAACAATTTGGC
GAGCAGGTAAACATTTATTAAAAGTGGCTAGAACTAAAAATAGAGTACAATGTTGGACTT
CAGATCTAAACCAAGCATTGGATGACAACTCATTAATTGATTATACATTACCAACAACAA
AACCTAGTGTTTTATCCGATAATGAATTTAATATATTGAAAGAATTATTAAATTCACCTT
GTCAAATGGGTTTTGGTAATTGGTCTCAAAATATTAAATTTTATTTTGATTCACAATCAG
GTGTGTATGATGATACTATAATAGATATATCAAACAATCAAAAATGGACATATAATAGTT
CTAATAAAACTTGGGTGTCATCTACGTTAGATAACTCAACAATACCAGAAAATGTTTTAA
TTAGTTCTAAGAAAACTAAAAAATTGTTTTATAATAATGGTATTGAAATATCAAGTTTAA
ACTAGGATTTAACACTTGTCAAACCATTTAATTAAAACTTTCTTAAATATGGCTTAGCT
ATATCAGTGGGTATAATTTGTTTTTTAATTGATTTTTATATGCATCATACATTATCCTGG
AAAATGTTCTTAATATTTTGTATAATAACTATATATTATGATATTAAATTAATTCGTGAT
GTTGTTAATGAACCGTCAAATACTAATATAAAACATAAAATATAAAGACTAAAAATGCA
AGATTTAAAACCTCGAGAACTAAAAACTTATGAAATAGAAGAACTTATAGTTCTAAATAC
AAAAACTGCAAAAGAACTCAGAGATTCTATGGTAGAATCAAACCCAATTTGTCCTTTATG
CGGTTCTAAGATCTTCAATCCTGTACTTGATCACAAACATAGTAAAAAACAAGAAAATTT
AGGTGTGCAAGGCGCTGGCTTAGTCAGAAATGTTATTTGCAGTACTTGTAATATTTTCTT
AGGTAAAATGGAAAATAATTATAAAGATATAGAATTCAAAACTTGGCTGATTTTTTAAG
AAATGCTGCAAATTATTTGGAAACTGATACAACACCGTATGTATACCCAAGTGAAGCAAA
AAAATTAAAAGAAATTTTTCCGAAGTCTTTATATAATAAACTGATTAAAGCAATTCATTT
AGAAACTAAAAAAGATATTAATTATATTAAAAAGAAAATTAAGTATACAAAATATCTTAG
TCAAAAAACAAAAGATTTATTAATATCTTATAATTTGTATTCTTAAAGTTTAAAGTATAA
CTAAAGTTTAAAAGTTTAGTACATAAATATTAAAAAAAAAAGGTTAATAATGGGGTTATT
AGAAAGTATAAAAAATAGTATTATAGGTGAAAAAATAGACCATTCTTAGAACAACC
TATTAATAAAATAGATACTACAGTTCCATTCGGTAGAGTAATAAACACTTTATCTGATGA
TGAACCTTTAAGATTCCAAACCTTTTTTGATAATGTAAATGACATAACTTATGTTGATAA
TCTACAAAAAGCATCAGAACAAGCTCAAAAAATTGATATCTACAGACAAACTGCTAAGAT
TGCTGAATGTTGGAGTGGTTTAACAGAAATTGTAGACGAAGTCGCATATTGTAGAGATTT
CAAAGATCCTATTAAATTAGAAGTTGATACTTCGAATAAGAAAATAGACATAGCAATATC
TAATGCTTTTGAAAAAATAATGAATTATTTGGAACCCAAAAATATCTACATTCTTTTAT
CAGACAATCTTATATAGACGGCCAAATGAATATATTAATTAAATACCACGATGATAAGAA
AAAAGGTATAAAAGAATTATATTATTTAGATCCTAGATATCTTTGGTATGATTTAACAGA
TTCTAAATACAAATACATAGATATAAATTCTTCAGTAGCTCTTAAAAATAATTTCTTAGG
AAATCAAAGATATATCAATATCAATGGTAAAGCTCCAGTTCGAATAGATCAAGCGGCTTT
AGAATACGATATAGAGGAAATAGTTCATCAAAATTTTGGTTTATTTTCAGATTCTGGTAT
TTGTTTAAGTGAATTAGAAGCTTCCGTTAAAACAGCTAATCAATTAAAAACACTTGAAGA
TTTGTTAATACCTTTAAGATTTTCAAGATCAATTTCAAGACGTGTATTTAATATAGATTT
AAGTGAATTACCGAATTCTAAAGCAGAAGCTTATATGAGGGATTTGACTAATAAGTTCAA
ATATAAAAAACAATACAACCCAGAAACTGGTGAAGTAACTAATAACCAACATATTGTCAC
TATGGTCGAAGATTATTGGATTGGTAATAAAGCTGGTGCTAAAGGTATGCAAGTAGATAT
CTTGGATGAAACTGGTAATTTAGGAGAACTTGGTGATATTATGTTTTTTACAAGTTATT
ATATAGATCTATGGGAATACCAGTTAATAGAATCTACTTAGATGACCAATCACAACAACC
ATTATTTGATTTGCAAGCAGATGCTATCACAAACGAGGACATCAAATTCTTCCAAAAAAT
AACTAGGATTCGCCAAGTATACACGGAATTCTTTATGCAAATTCTAAAAAGAGAATTAAT
TTGTACTAAAGTTTGTACTGAAAAACAATTTCAAGAACTTAAAGATTCTATTAATATATA
CTTTAGCGAAGAAAATCAATTTATTGAAAGAATGAACTAACATTGTTTATGAAACGTAT
AGATGCATTCTCAACAGCTAAAGATTTTGGAGGAACAGTTTTACCTGTAGATACATTATA
TAAAGAAATTTTAGATTTAATGATGTTGAAATCAAAAGAATCTTAAAGCTATTCAAAA
AGAATCTAAAAATCCATTGTATAAACAATTTACAGAGATTTTGAAAGTGGGGATGAATT
CAGTTCAGATTCAGATTCTGATTCTGGTGATGAACCTAAATACAACGATTCTAATAACAA
TGCTAATAATACAGATACCGAAGAAGAATATGATAAAACCGGTTTATCTATTAAAAAAGA
CTCACTGATTTAAAACTTTAGTTACATTCAGAAACTTTTAAGTTATTTTATATTATAATT
```

FIG. 14G. Continuation of (CJLB-12 [organism= Campylobacter phage CJLB-12] complete genome)

```
ATTTCATTAAAAGATAAAGGAGCCATAATGAATAAAATAGCTAAAGACCCTAACAACTAT
GCACACAATGTTATGAACGATTTAATAGATCGCGTTAGAAATGAAAAATTAATATTTACA
TTCAACGGTAAAAAATATTTTTAGATCATGTAGATTCTTATCAACACGGTGAAGATTTT
GGTCTATTCTTTAGAGGGTTGGATTCAGAATCAGATCGATGTTGTATGGAAGTACTTGGT
TGTGAACTTTTTATATTCAATAAGAAAGATTATATAAATTTAGATTCATTTGAAGTTTAT
GAAGGCTGGCTATCATTTTAGGTTTTAAATTATAATATTAAAGGAGTTTAAATGAAATTA
ATAGATGGTTATTATGTAGATTCTAACAACAATAAATGGGATGCTGAATTATATTCTGAG
GACCAAGCTAAAAAGCTTCAGAATCTTTAGTAAATTGTAAAGACTGTGTTAATTGTTTT
AACTGCGAAGATTGTTATGATTGTGAAGACTGTGAATAATATTGTAAAAACTGTGTTAAT
TGTGTAGAATGTTGTGGATTCTTAGAACGAGAAAATGCATAATTAATAATTTTTTAAGTT
CAATTATATTATAATATATCAAAAGGAGATAAAATGCAAATTATAACAGATTTTTTAAAT
GAATTAAATGCTTCAAATAGTTCTAATTATAAATTAGAAGTTCTTAAAAAATATAACAAT
GAAATCATTAAAGAATTTCTTTCATTGGTTTATGATAAAGTCAAATATTCTTACGGAATT
AAAAAAGTACCAGAATTTCAAAATAATAATGAAACCATAGATTTCAATACAATTAAAAAT
ACGTTCATAGCGTTGCATAATCGCGATTTTACAGGGAATAAGGCGATTAGTGTTGTTCAG
TCATTACTTAACAATAAAACACCAGAAATAACCAGGATTATTACTTATATTTTGGATAGA
GATATTCATTCAGGTATTTCAACTAAACAAATCAACAAAGTTCATAAAAAACTTATAACA
GAATTTCCATATATGAGATGTTCATTAATGGATAAATTTAAGAATATTAGATTTCCAGCA
ATGATTCAAATAAAAGCGGATGGAACTTATAGAACTTTTATTAAAAAAGGTGATAGTGCC
CAAGCATTTTCAAGATCTGGTGAAAGTTATGATCACCCTAAAGTATATTCAGCATTATTG
AATCTGCCAGATGGTGCTTATATTGGTGAATTAATTTGTAATGAAGTTGAAGGTACTAAT
TCAACTGAAATCAGATATAAATCTAATGGTTTACTTAATAGTTTAACACCACCTGAAAAT
GTAACTTTTTATATGTGGGATTATTTGACTTTAGAAGAATTTGAAAATGGAAATAGTAAA
ACACCATATAAAGAAAGATTTGAGTTTGTTTGGAGATTAACTGAATCTTTAGAATCTGAT
ACATTAACTGTTGTTAGAACCAGAGTTATTGACAATATAGAAGCTGCTAATGAGTATTTA
AATACTTGGTTAAAAGAAGGTGAAGAAGGTGCTATCTTAAAAAATTGTGACGCTGTATTT
AAGAATGGTACTAGTACAGAACAAATAAAATTAAAACCAGAAATAGAAGTTGAAGTTCGT
TGTATTGATTTTACAGAAGGTAATGGTAAGTTTAAGGATACTTTTGGTGCTATTGTTTTT
AAAACAGATGATGAATTAATTCAAGGTAAAGTTTCTGGGATTAGTGATACTGAAAGAGCT
GAAATATTTAAAAATAGTTCTAAGTATTTAAATAAAGTTTTTACAGTTAAAGCAACAGCA
TTGACAAAATCTGAAGATTCTGAAATATATGCTTTAATGCATCCAAGATTTAATGGATTT
AGAGAAGATAAAGATTATACAGATACTTTAGATAGAGTCAAAAATATGGGATTAAAATTT
TAAGAAATCAATTTAGAATTCAACTAGGCAATTCACTAGCTGCTTGAATTCTAAATACAA
CTTCTTCAATTAAATACTTAGGTTTATAATAAACATCTACATAAATGTTATTATCCTGAG
TAGGATTATTAGAAATATCACAAACTATTTTAAAATCTTCTATATTATTATCTGCAACAT
AACTTCTACAAATTTCTTTTATTTTTGAAGTTAAATCATTTCTTGTATATTCATCATTAT
TTTCAAATACATAATATAATGCAGCATTTTCACATTCTCGAACTAAATTGAAATATATTA
TTCTATTTGTTAATTTAGATCCTTTTAAGGTATTTTCACTTAAAGCGTATATACCGGAAT
ATCCTTTTTTAACAATATTAATATTTAAATCATATAAATCTTTTATTTGTGATTCTGTTA
AATATATATCCAAATCTATTGTATTTAAGAAACTATAAATTGTTTTACAGTGAGATACTG
ATAATTCTTGTGAATTAATTAATCTGGTTCTTAAACCAACAATATCGCCTATACAATTAA
CATATATATTTTGATTATTAAATGGATTTAATTGTAATTTAGAACCATAGTAAACAACAG
CATTGTTTGAAATTTGTAATTGTTTAATATATTCTTCAGGTTTGATACCTCTGGGTATGC
CTACGAAAGCGCAACAATCACCACGAGTATCTGCTAAATTGATAGCAGAATTTGGACTTT
GTGTATTAGCGATTATAAAAATCAAACACATAATCATTAGATTCACCGACACTTTTATATG
TTTCATCTATTTGGGCTGCACTTGGTAAACTTGCGTACCCGTTACTTAATTTAAGACTAT
TAGAACCATAAAAACTGTTTTATCTGAGTTAGGTTCATTTCCATCAGCTAAGCGATTTA
AGCCATCCACATAGTGGATATTACCATCATATAACTTGTATTTTTTAGGATCGAAAACAA
TGAATATATAATTAGAATTTTCATTAATAGTATCTACCATATCCTCAGCTTCTTTTAAGA
TATATTTTTCCATTAATGTATCTTTTAAGAACACACAAATACAATATTGATTTGAACTCA
TTGAATTTTGAAATATCTTTTGCTAAATAATTGCTGTGTATTTGACATATTATTAAGAACTT
CATATTGTGTAAAAATACAAACTGTTAAATCATTTCCCCACTCTCCTGGGTTTCTAGCAA
GGATTCTCAAGAAATTATTTTCAGAAATTATACGTTTACTTCTAAAATCATCTAAGTTAT
CTATTCTGACGTCAAAGTCATTAAATGGATAGCTAATACTAGCATTAACTGAATTTTCAC
CAATAGATCTCGAAATAACTATTTCATTATTATCATATAAAAAATAATTATAAATTTGAA
ACCAGTCATTTATATTATTTTTGTTTGGTTTACCAAATTTTGTTTTAAAATCTAATATAG
AATAAACGGATGTTAAAGTATCTGGTGAACCTTTATCGAAATATCCAGCATAGAATACTC
TTCTTGGTTGTGAATAATTTGATGTTGAACTGGTATCACTATCAATAAATCTAACACTTG
GGACTGGCATCATAATCCTTCATATAAAAATATATAAAATGAATGTAACTACTAAAAGTA
GTATTAATAAATCTACTATTATTAATTGTTCATATTCTTGGCCATTATGTATTAACATAT
TTTATACTTTAGTGTTTACTAAGCCAACTAGTTCAGATTCTTTAGATTCTAAAGCTATGC
CTATAAAATATTTTCTTCTTTTTTGCTTGGGTTTACACAGGCATAACCGTCATACTCAG
CATATAATTCGTCGCCGGCTTTTACAGAACCTTTAACAATTACTGGTGTTTGACCCTTTA
AAGCTATTAACACACCTTTACAATCTTTATTAAGAATAAACCCTGGTTTATCTGAAACTA
CACCTAAAGGTCTATTATGTTTATAGATGTCGAAATATTCAATTTCTGAATTTTCATTAA
TACCCAGAACAGCACCAACTTCAAACTCTTTATCGGTTTCGTAGACCTCAGCTAAGTCAG
```

FIG. 14H. Continuation of (CJLB-12 [organism= Campylobacter phage CJLB-12] complete genome)

```
CGTATTTTGCTTTTAAAGCAGTTCCTATAAAATCTTGAGCGTACATAGCTTTAAATTGTT
GTGTTGTTGAGCCAATTGTAGATATTAAGTTTAATCCTGGTAATAATCCAGCTTCTGTGG
TTAACCAAGCTTCTTTTTTACTTTTACGAGTTTGTAATTGTTTAGATTTAGAATCAACAA
ATACATAATCCGTTAACAAATCATCTATATTAGTAATGCTTTGTTTTACTTCATCTATTA
AATTATCTACATATTTTTAGTTGTTACGTGAGCGGGTTCAGATACTTCTAAATCTATTT
TATTATCTTGTTTAATATAGATACCTGCGAGATAACCATCTAAGAAATCTTTAAATTGTT
CTAAAGCCCATTTAAGATACTTTAAGTTAATAACATCGTAATCGTCGTTGATGGGCCAAT
CTTTATCATTATCAGTTTTAGTAGGATAATTATCTACATCTAACCAAGGGTATAATTCAT
TTAAAGTAACTTTTTTCCACATATCAGGATTAGTATCTGGATAATACCCTTGATTTTCGA
TATCACTAGGCAATGCTAAATAATATGAATTTTTAATGGTTTCTACATCTGGATTATCTT
CTGTTATATAAGAAACTATTTCACCTGCTTCATAAATTATGCTAGCATCCCATCTGATAG
ATTCTTTTGAAGTTAATATTTTAAATTGGCCGATTAATTGATTAACCTCTCTTTTGAGTT
TATTAACCGACTTGTTTAGTGCGTCTGCACTAGCTCTTGGTTATCCATAATATTGAATT
CTTGAACGAACTCTCTAAAACTAGTTAAGTTAAAATTATAGCCTTGGTATCTAAAATCAG
ACATTAAATCTCCTGCTTATATTTTAGTATTTATTTTTGATCAGAGGCTTAAATAATTT
AAATAGATTAATTAGTATTTAAGGTTATTGTATAAGTTTCAAAGCTTGAAGTTTCTACTC
CTGTAAAATTATAATTAATACTTAATATAACCCTGTTGAATTCTTGGTTGTGAATAAATGT
CTACACTTTGAACTTTGATTCTAGGTTCGTAAACTTTTAGACATCTTGTAATTTCGGTTT
GCATACTATTAATAGTAATATGGTCAATCATTTCAAACAAATAAGCATATAAATTGCAAC
CAAATTCTGGTTTACCAGCTAAGGAACCTTTTCTAGTAGTTAATATATTAAAAATACTTT
GTTCTATAGCTCGTTTATCTATAACTACAGCATTCAAAGAATCATTATGAAAATCTTTAT
AAGTTGTCATTTATATACCTATTATATTATTTTAAGGTATAAGCCGATTTAATATCGACT
TATTACCTTAATTTTCACTATGTAATCTTCAGACTCAGTTACTTCAACACTTAATTTAA
CAACTTTTTCAGAACCACCCTTAGCTGTAGCTTTTACAGTAATTTCAGAAGTTCCTTTAG
TTGCAGCAGTTATAGTGAATTACCTGAACCTTTTTTAACTGTAGCATTGGCATTGTTAG
ACTCAACTGTGAAATCACTAGCATTTGTAGTTACATTAATATCTTTAGTCTGACCCTTCT
CAATAGTTTGTTTATCAGCTGGATTTAAAGATAAAGTAGTTTCTACTGACGGTGATTCTG
GATCACTTTCTTCATTATCAGCCAAGTTTGCTTCAGTTCTTTCAGCTATAATAGCTTTAA
CCTCCGCCTGTGATTTTTCATAGATTGAACCATTTATGTCAACTTTAACTGGATCTGCAG
TAATATGTTCTAATGCCATAAAATACCTTTCATAATTATTAATTATTAAATATTTATTTT
ACATTCTAATGTTATATGTTTTAAAACTAACATTAAGTATATTTAAAACATTCTAATGTT
ATATGTTTTAAAACTAACATTAAGTATATTTAAAATATTTGAATGTCACAATTTAGAATC
TTTATCTTTGGGAGATATGTTATCTAATAATCTATCAATTATACTTTGTATTTTTCATA
CCCAGCAAATGCTATAAAAATCGATACACCTATTCTACTCGAATAAGTTAAATCAAAATT
ATCAGTTATTAAAAAGAAGATAACGCTAAAATACCAGAGGTTGAAGAGGTTTTTATAAA
AAGTTTGAATCTCGTTAAAAAATTGGTTTTAGATTTAGCAGCTTTATCTATATGCAAGAA
TTGTACAGCACCTATAACAGCACCTATAAGTAGTATAGGAAGGGAGCTAAACAGCGCATC
ATAAATATTCAACATTTTACTCCCTTTAAAAAATTTAGTGTTATTTATTAACATAAAATAT
TGATAAGCAATGGGTTAATCAATATAATTAAAAAAACTAGCTATTGCATATATTAATGAA
AATGTAATGACACCCCATATGGTTCTATTACATATTTTCCAAACAGTTCTTAATGAAATG
GTATAATGTTCACCACCAGAACAATGATATCTACCTATTAAAAACCATCTGAAAACAAAC
CAATAATATTTTAGTTTCTTTTTTAAATCTTCTGATTGACCACTCATTTTAAACCTTATT
TATTGTCATATTTTTCTTTTAATTCATCGTATTCTTTTTAAGAGCTTCATAAAGAGCTT
CAGCTTTTTAGAGCCGTTGACGCGAATACAATAACCTACAGCAAGACCGACAACGAATA
TAGCAACGTAAATAGCAATACTTAACATTGATAATCCTTTAATAATTTTTTATTATTTAT
TAAACAAAAAATTGGCCGTAAAAATCAAATAAATATTACAAAAATCAGGATTTCAAATGG
CTATTATAAAAGAAACATTACCTTTTACATATGATGAAATATATCAAGATATAGCTAAAA
GATTAATTGAAAAAGGCTGGGATGGAGGAGCTTATGAAGGTTCTAATGGAGCAATCTTAG
CATCTGTTTTATCTTATATCGTAAGTTCTTTGAACTTCAATACAGCAGTAAATGTTAATG
AGAATGTTTTAACTTTGGCGACCAAACGTAAAAATGTTATACAAGATGCTAGGGTTTTGT
CTTATGAACCTTCTCATAAAAAATCTACAATACTCGAAATAACATTAAGTTTTACCAGAA
CTGGTTATTTTAAAATACCAAAATACAGCACATTTATCATAAATGGTTTTACTTACAATT
ATTTAGGCGATGATTTAGAATTCAATATAGATAAAATAGGAGCTACAACTACAATACAAG
TAAAGAAGGTACATTAATTAAAAACGAAGAATATCCTGATATTTTAACTTATAAAATAG
ATGAAAAATTTGAATACATAGATATACCTTGGAATGATGTAGAAGATGATGGTGTGGAAT
GTTATGTTACTTATTATGATACTTTTGGAAATTTATCGGATAATGCAACTTTTGTAAAAT
CTTCTTTTAATTTAATTGATATTAAGGATAGTACCAATAATAAGTTCTTTAGAAAAGATG
ATGTGGATACTGGCAATGCTAGGATATATTTTCAACTAGGGACTGCTGGTACTAAGTTGC
CTTCTAATACGAGAGTTTATATTAATGTTTTAAGAACTTCTGGAATAGACGCATATTATG
AGAGATGTGATTCAGCTTCCGTTAACGGTGATCTTGGCTCTTTTTGTAAAATATTGACTT
CTGGTAAAGATGTACCTGTATTAGTTTCCAAGCTCAGGATGAAGAAAGTATAGAGTCTA
TTAAAACAAATGCACCAATGTTTTATAATAGTGCTTCAAGAACAGTAACTATACACGATT
ATAATTCAGTTATAAAAACACACTCTAGTGTTAAAAATGTAGTGACTTGGGGAGGCGAAG
ATGAATATCCAGTTGCTCCAGGTAATTTGTATTTTCAGCTGAACCCCGAAGAAAAGAAC
CAGAATTTACAATCTTTAAAAAAGTTCAACAAAGTGATGGAACATATACTTACAAAAAAG
AAAACTCTACTTTAGCAAACGGTGAATTATTGAATACTACTGAAATGAGTACCAATCAAT
```

FIG. 14I. Continuation of (CJLB-12 [organism= Campylobacter phage CJLB-12] complete genome)

```
ACTACATAAAAGAATCTTATAATGATCCTGACACATTATATTTAAATGATGGTGAAGTTG
TTTCTGCAGAAAAAGATGCTAACGGTTATAAAAACCCAGGTATTTTTGACTTAGTAGATA
CATATAATTTACCAGCACTTAAGAATAATCTTAAAAATCCAACATATGTTAATATAGATT
TACAAGTTCTTATTAAACAATATCCATTTGGTACTCCAAAATCAGATATTCGTAAAAAAA
TCTATGCAAAGATTCGTGAAAAAATGGCAGAAATTGAAAAATTTGAAGGTGAATTTATCC
ATTCTAACTTAGTTAGGCATTTAGACAATGAATTGGGTCTGGGTAATGGTATAGAAGTAA
ATCCATATTTTAGTTTATTACTAAGTGAAGAAAACTGTGTAAAACAATTTAAAGAAAATA
AAGACTTTAGTAAAGTAAATTGTTTTTATGCTAAATCATATGACAAATTATCTAAGAATT
TAGTTCTTAGTGTTTATTTTAGTTTATTGGCTAGTGTGGGTGATAAATTAGAAGTTTATT
TTAATAAAGAAAGTTTGCCGTTTATTTTAGACAATACAGATCATTATACTTATGAATTAA
CGGATACTGATATCAACCAATCTTACAAATCTTTTTATTTTAAGGATGTGGGATTTGATG
AAGAATCATTAAATGTTAGAATAATATCATACGATGGATTGACCACCTATGGGGGAAACG
ACATTAATTTATCAACTTAAAAAATAAAACCGTATTTTTAATGTTAATATAGGTAATG
AATTATCAGTTATTAAAATAGCATTGCCAAGATTTGTTAGTGTAGGTGATAGTTTTAAAG
TTTACGGTTTATATGGTTCTCGCAAAGCAGAACAATTAATATATGATTTCTATATTACTG
AAGAGATACTTTCACAAGGCTATCTACAATGTGATGATTTACAAAGGGGTAAATATGCAG
GTCTTGTAGGAGCAAGTGATTATAAAGTTGTTTATACTTGTAATAGAGAATCTTTAAAAC
CAAGTGATAGTGAAGAACCTGATAGCAATGGGTTAAAATCTAATCAACTATTAGGAACTG
CCAGTGGTTCTTGGGAATCTGCAGTTAACCAAACTGAAAGTCAAGATAATGTTTTTGGTG
ATATAGAAACTTCTAATTTATATTATAACTGGTATGAAGATTCTGACGGTCAAATAGATA
TTAGAGTTTGGATACCAAGCTCAGTAAAAGCCAATGATACATTATTAATAGATTATGCTC
AAAAAACTACAAGTATTGTTATAACAGACGCTATGATAGCTCAAAGGCAGTTTGATACAA
AAATAGATGGTATATTATTAGATGTTACAAAAATTTCATTTGGTAGTGCTGATGGTTCTA
TCGGTATATATCCTACTTACGTAGAAAGACAAAATGAATTAACACCTGTAGAAGATGATA
GAATTCAATTTGTTGCTAAACAGTTTGAAAATATAACAGAATATGCGCCCACAACCACAT
TTGATAGAGAAGTTCAATTAAAATCTAATGAAAAAATTACATTTTATGTTAATTATAATA
ATAAATTCGACGTCAGGAATTTAATTGCAAATCACGATGATGCATTAGATTCATATACAG
TCAGTATACCGGAAGGTTCTCCATTAAAATACGAAGCGCCATACGTAGTATTAAATAATT
ATAGAAAAACAGGAACTTTTAATTTTAATTTAGACGTTCAAGTAAAACGTGGTGATTTAT
TATATCAAATCAAATAGTATATGTTAAAGAAGCTGCGGTAGATTTATCAGTGGATGAAG
GCCCAGGAGGAGCTTATGTATATTTAGATTTACCAATTGAAGGTATATATGATACCAAGG
GTCAAATAATACCAGAAAATATACCCACAATAGAATGGGCTTTATTTGCTAAAGCTAATC
CTGCAGAAGGTGAGGATAATGAACCTATTTGTTTTGAGGAAATACAAGAACCTAGCAAAA
CACATAAAGTTATCCCAGCAAATTTAACAAATTATGTGGCGGAACAAAAAATAGTTGCTA
ACTATGTTATAGATGAAGAATCTGTTAAGACTATGTTACCATTTTATACAACAGTTGAAG
AATATATTAATTTGGATCTATCTAAAGTTGCTTATATAAGAATACCTATTAAATTAATGA
ATAGAAGTGCTGCTACGCCAGAAGAAGGTGAACAAATTGTAGGTTCTTATACAATATTTA
ATTCAAGGATACCTTATATTAGAGTTAAATTCCAAACAAAAATTTTTCAACCTGGATATA
ATTATGAATTTATGTTAAATTATCCATCACATAATTTTAAATTAATAAGAAATTCAATAT
TTAGACTTAGATCTGTAGTTTTTGATGATTTATTGGATTATCAAGAAGTTAGAGATAGTT
TAAGAGCTGGTGATATTGATATGAGCACTATGAGTGTTTAATTATCTAATTAAATATATT
TTAAGTTATTTTATGATATAATTATGCAAATTAAAATAACGAGGCTATGATGAAGTTTTC
AGATTTTTTAGAAGAGCAAGCAATTGCTAAATCAGGTGATTATGATTTTGGGAATTTAAA
CTATATAGGCGCTGGAGGTTTGATATCAAAGAAAGTTGTGAAAGTTCTCCATAAGTTCAA
TTTTGATATAAATGGTGATAATACAGAATTATTCATTATTGAATGTAATGCTAACCATCC
TAAACAAAAATATTATTGTGTAGCTAAAGAAGAAATAGATAAAAGATTTGAACCTTATAC
AACAAGATTTAAGATATTAGCTGCTATACTTTTGGAATATACAACAAAATACAGAGGTTT
AGGTTATGGTCCTCTTAGAATAGTTAAAGGTGTCGAAACTTTAAGATCATACAGAGGTGG
TGGGATAGGTAAAAATTATATACTATTTTAGTGGATGATTTAAATGGGTATTGATGGG
TGATTCTGAACAATATGAAGGTGCAAGAAACTTATGGACTTTCTTGTCTAAATCACCTGG
GTTTAACGTTGATATAGTTGAGTTAGCAACAGGTAAAATTATTGCTAAAAATGTTAAATT
AAAAGATGCTTTAGATCCAAGAATTTGGACCGATGAAGATTTATTTTTAACAGGAACTAA
AGAAGAAAGAATACGTGGTAGATTTAATAGATTGGTATTAACTAAAGTTACAAATTAAAG
GAGCTAAATTGAAGTTTTCAGATTTTTTAGAAGAGCAAGCAATTGCTAAATCAGGTGATT
ATGATTTTGGGAATTTAAACTATATTAATAAGTATGGTCTGACTTCGATAGAATATACAT
TTGATAAATCACCTTTTGTATATAAAGTTTATTATAATGGTAAAGAATATTTTTTTATC
GTAGAGAATCTTACCATATTTTAGCTACTAAAGTACCTGAAGATTACCCGACTAAAGATA
ACCCTAATGGTACCAAAGATAGATTTAGTCCTATAGCTATGATTAGATTATTGCCTACAG
ATAAAATTAAAAGAATGGATTATAAAAATGTTTATACAGTTAGTGCTGTAGAAGTTGATA
GAGACCATAGAGGTATCAGATTAGGCAAATTATTATATTATCTAGCAACTACCGTTCTTA
AATATACTTTATTAGGTGATTCTGAACAATATGAAAATGCTAGGAGAATATATTATTCTT
TTAGTAATAACCCAGGATTTACAGTGGATATAATTAAATTAGATCAAGGTATCTTAGCAA
AGAATGTAAATCTAAATGATCACAACGATGAAAGAGTTTGGAGTACAACACCCGATAAAG
TAGGAACTTTACATAGAGTGGTTCTTAAAAGTGTTCATATGGAATCTAAGGTAGAAGTCA
AAAAATTAAAATAATTTAATTTAAGACTAAGAACCAAATAAATATACTAAAAGCATAATT
AAAGGTTTGCTGTGTTTAAAAGTATAGCTAAAAAACTTAGTACCAGAAAATTACAAATCTA
```

FIG. 14J. Continuation of (CJLB-12 [organism= Campylobacter phage CJLB-12] complete genome)

```
ATAAATTTATTATGGACGTCCTTGACGTTTTTGTAGATTATATCTATGATAATTCAAGCC
TAGCGATTGACATCAATAATTTATATAATTCTAAAAATGAAGTTCTATATGAAGAAATTA
TTAAAACATATGCTGCAAACTTTTATAAGACTATAACCGATGGTTCAAAAAATCATAAAC
TTGCAGAAGCTGTTAGAAAAGCGCACAAAAAATATGGTTTTGATTTTAGTGAAACGCAAT
TAGATATAAATGTAATACACTTATTATCACAAGAACAATTAGAATTATTTAAAAACTTTC
AACAATCTAAAGGAACTTTAAGATCTATTGAGTTTATATATCGTATTATAGAACAATTAA
ATATTGAAAGTTTTGTATTAGAAACCGACGGTCAATTAACAATAGAGCCCGGTGAAAATA
TATTTGAATACCGCGTTTACGGATCTATGTTACCAGAAATATTCGAAGCATTTGTTAAGC
CTTTAGCACATCCAGTAGGTTGGACTTACTTATTTACAAGAACTTACGTTCTTAAATTCG
AAGATTATTTCTTATGCAAAGAAGTTTACGATGTAAATGTTTTTAGAGTAACTTGTGAAG
ATTCTGATTGTGAAGATAATTTTAAAACAAATACCGGATATCTTTTTGAAACTGACATTA
ATAATAATAATATATGAAAATAATAAACCAAAAATGTATAAAGCTGATGGAAATCCAG
TATTTAATGTTACAAGATTTGGTGTCAATTACCCAGAATTAACATTAGAATCTGAATTAA
AATTAGTTAAAGATCCTACTATTAGAACTATTGAAAAATCCAGCATAAAAGGTAATGACA
AATTAATTGTATATTTGAATCTGGTGAAAGATTAGAACAAAATTCAAACCCTAAGAATT
TAATATTATATTATTATAAAGGTATTAATTCATTAAATCAAGAAATTAAAAAAGATTATA
CTGATTTCTTAAGCAAATGTGCTTTGGAACTTAATTAGTTAGAAGAGTTGTAACCACAG
TTAAAGACAAATATCAATTTCAAGTAGATTTTGGTTTAGCTAGCACTACTGGTAAATTTG
CAGCTATTGGCGCTGGTAATATGTATCTAGGTTCAGATACTTGGGTTCTTGGTAAAAATA
GAATCAATGCAAATACACCAGTAACTTATGGAACTAGAGTTCGTAATAAGTTTTACAAA
CTTCTGACTTTAAAGCATTATATAAGAAAAATGATAATTCTATTAGACAGGTATTTGATA
AAGTTTATTCTGGTTTTGATGATCACGTAAAATCAAGTACTTGTAATTTTATTTTAGAAT
CTGACAATTTATATCATTATAGATTATATAATCCAAATGCAATATTTTTTGAATTAATTA
ATACTTACGGGTATAGAGTTCGCGCTAAAATAAAATATAACGAAGATTCATTAGAAGTTA
TAGCTGAAGATGAACTTAAAAATACACAATTATTATATATAGATAAAACATTATTCAGTA
AATACAATTCACAAGTTTACAAAGATTTTAAAGAATCTATGAATAAGCCTTTAGGTCAAT
ATTATACAGTCCTTAAAAAAGGTGTTAATTACTTGAATATTGTAGATTCTAATGGTTATA
TAGTTAAAGGTAATTATAGGCTTGTAGATTCTGAATATAGGCTTTATTTAAATATAAAAG
ATCCTGTAACTATTCAATTTATTGATGATACTTATGAATACGATTCAAGACCATTTCAAA
TTATTGATGCCGAATTAAGTTATAATAAAGATTCTAAATTATATGAATATACTACACCAG
AAAAAGAATACTATTTTGTCAGCGTAGCTAATCGTATTAGCAATGTAGATTTGGACATTA
TGTATATTGCTGGTTTACAAAAAGGTTTTAAAATAACTTCAAGCACTGCTCAAAAAATAA
GAGTATATGTTATAGATAATACTTCTAAAAGATTTCCGATAACTATACTGAGTGCAACTA
ATGAAACTATACAAGCAAAGAAAATAGTATATTCTTAGGTTTAATCAATGCTGATAACC
AATACGTTGAAGGACAAATAGTTTACGATTCTGAAGGTAAATTAGCAACATTAGATTGTA
ATGCAAAACAAATAATTTAAGTTTATTATACTTAGATTATTCTGCAAGTATTAAAAATC
CAATAACTATTAAATCTACAACATTTGATATTGCTGGAAATTTTTCAGAAGTTAATGATA
AAAGAGGTAAATTCCTTTATAATTTTAGAATCGAAAATATTATGATTGTTAATATATTCG
ATAAAATAATCAAAGAATACAATTAGACTATGATATTGAAAATACTGGGGTATCTTTTT
ATACTGATACAAATGAAGCTATTACAATACAATACTTTGATAATATAGATGAAGGTATAC
CAAGAACATATACAATAGATGCTGAATTTAAATTAGATACTAGTTACATTAATTATAACG
CAAAAATATTTAAATATAAAGATATATTATTAAATATGGATACTAGTACAAACAAATATG
TTTATAAGCACAACGAAATGAAAACTTATCCTTTAGTTGTTATGGATACTGATGGAAATG
TTTTAGACGTTGAAATAGGTATTTTAACTACTGGATTTAAAATATCTTATTCTGAAGGTA
TAAAAGTAAGAATATATTATTTAGATGATACTAAAAATAGGGCTGATGTTACTTATTATA
AAGCTGGAGACCCGGACTCCACAAAATTATTATATGCTGTTAAAAATGGTGTCATAGTTA
AACAAGATATCAATACAGTGTCTACTGAAGATTTTTATTCATTTCAAGATTAAAAACTC
TTAAAATTAAGAAAGCTGATTTAAAAGCTGTGGAAAGTAACGACCCAGATTCAAAACTAG
GTAAATATAAATTTATTAAAAATATTGAATATGGTTTGCCAGTTATGGCCGGTTTTAACA
ATGATTTAAAATTCAAAGTTAATGAAGATTCTATAACAATTTACACAGCAACTAAAAAAG
ATATTAATATTAGATACGCAGAAAAAGTTAACGAAGAAAGTTTCTTATATACTTATAGTA
TAAGAAAAGATGATGATTTATTTATAGATGCGCAAAAAGATTCTATAAAATATTTAATAG
ATTATCAATATGATTATTTAAATAATAGAATTATTTTTACAAAAGAAGACGATGATATTG
TCAAATTGTTTTTCTTAAAGAATAAACACAATAAGAAAACAATACTTAGTATTAATAACG
CAAACTTTGAGGATGTTGATTTTCCAATTAAAATTTATTTAAATGACGACTTTGTTGAGT
TTGAAAATAAGGAATCTATGCAATTAGATGTTAATCCATTAGATCTTAAATTCAATCAAG
ATATTAAAAATAGAAATTCAACAATTAGAGCTATTAATAAAGATCTTGAAGTATTGGAAC
AAATAGATTTTAATTTGGCACCACAATATACCTTTAAAGCACTTGGTGATTATCTCTATG
AGATAGATTTTAATAAGATTAAATTCAAAGAAAATAAACTTAATGAAGAATCCTTGTGGT
ATAGAGAAAGTTCAGTTTATCATAATCATTATGTAGGATATTTTGCAGCTAATAATGTTC
AGCCAACTCAGGTATTTACTGGTACGTCGAACAAATTAGATTATGAACTCAGAGAAACAA
ACCCTTGGGGATTAACAGCCATAGATACATTTGAATTAACAGGAACTGCTACAAATGATG
GATTTGATGTTAATTTTGAATTTATTGATTCTTGGCCAAAAATCACAGAAGTCTATAAAA
ATGATTATACAGGATTCTATCAAAATAAATGGGGTTGGCAATCGGGATATGTTGACGTTT
ATAAAACTACTAGGGATCTTGAAAGATTTAATGAAAAATACGAAAGATTAGAACACGCCA
GCGTATACCAAATGGATGATTATATTGTTATAGGATCTAATGATATAACAAAAGATTATA
```

FIG. 14K. Continuation of (CJLB-12 [organism= Campylobacter phage CJLB-12] complete genome)

```
TGTTTAAATGGTATCCAACTAGTAAGTCAAATGATTTTAGTGATAGTTTCTTAAGAAATG
GTCAAGTCTCTGAACCAGTGGCACCTAATAAAATATATACTGGAAATATGATAGAGAAC
CCGACAATATAATTAATAAAACAAATACTTGATTATAAAGGATTTAGATGGCTGATATTA
TTCAAAATAAAATGAATCAAGTGATGGGTGATTTAGCTCGCCCCACTAAGTTTAAATGTC
AAATATTTCCACCTAAAGAAATTAAGTGTGAATTAAGTATTTTAAATGAAGGAGCTTCTG
CAACATCCAGTACTTCTGAAATAGGACAATATTTAGACTATTTTTGTCACGCTACAAGTT
TTCCGGGATTGACTGTAGAAACAATAGATTTTAAATATAGAGGTAGAACCCTACCAGTCA
AATCAGTACAAACTTATCAACAAAAATGGACAGCAACTTTTTATAATGATGAAAAACACG
CAGTTAGAAAGTTATTTTTAGATTGGATGACTTATGATCAAGCTCACCAATTTGAGGATA
AAACTAAAGGTAATTTTGAAGGTATATTACCAAGCATTTCTATATATCAATTAGATTTTG
AAATGTCTAAAGATTGTGTTGTGTATACTATGATGAATGTATTTCCAACAAATGTAGGAG
AAATTTCAGTTCAATACGACGGGTTAAATCAAATTGAAACTTTTACAGTTGAGTTTGCAT
ATACTCATTTTGAAATTAATACAATTTCTAGGGAAGGGTTAACTAGTTCTGAAGTCACGA
GTTTGATCAAGAATACTATACAGAATACTATTAATAGTGTTACCAATACTTTAAAGGATG
CTGTTTTTGGCGCTTTGGACGACCTAGTTTCACCTGTATTGGATTCTGTTTCAGATTCAT
TTGAAAATTTTATAAGTACAAAATAAGGTTTTTTATTATATAATATATTTTTGATCTTTT
TAAATTGTGTTGTTACGAACTTTTTTTGAGTTTTTACAGTTTATACTATAGTATTAAATC
TAAAACTTAAAAGCAATATTAAAAAGTATAAAAAATGCTTGAGTTTTTACAGTTTATACT
ATAGTATTAAATCTAAAACTTAAAGCAATATTAAAAAGTATAAAAAATGCTTGAGTTTTT
ACAGTTTATACTATAGTATTAAATCTAAAACTTAAAGCAATATTAAAAAGTATAAAAAAT
GCTTGAGTTTTTACAGTTTATACTATAGTATTAAATCTAAAACTTAAAGCAATATTAAAA
AGTATAAAAAATGCTTGAGTTTTTACAGTTTATACTATAGTATTAAATCTAAAACTTAAA
GCAATATTAAAAAGTATAAAAAATGCTTGAGTTTTTACAGTTTATACTATAATATATGTA
ATTTAAGTTTACTTTAAGTTTAAATATGCAAGACTAAAGCTTAATAAATACTTAAAAATG
AAGTTCAAACAAGGCATTTATATACCAAAAAAACCCAGAGAAATATATACATAGTTATACA
AAAATGAATGAACACACTGAATATCCTGTTTATAGGAGTTCTTGGGAGCTTAGTTTCTTC
AAATTTGTGATTATTCACCCTCTATTACTAAATGGTCTTCTGAGCCAGTCGGTATAAAG
TACTTTAATCCCGTCAAAAAACGACAATCCACATATTATCCCGATGCTATGATTATTCGT
AACGATATAACATTTTTAATAGAGATTAAGCCTAAATCTCAATTACCAGGTTCTAACTCA
AAATCCAGTTATGATAAACTTTCAGCGGCAGTTAACGAAGCCAAGTATAATGCCGCAAAA
TCTTATTGTGAAGCAAACAATATGCAATTCATAATCTTAAGTGATTCTTTCTTTAAATCT
TGATTTTAAAGTTTTAAGCTTTTTTTGGTTTTAAAACTTAAGTTTTTTAAGTTTAGTATT
TAAAAAATTTTTGCACTTTTAATATGATATATTATAATATAAAAACTTTTTTCAAAAATT
TTAGTAGTTTTACAGTTGTTTAGAATTTGTTTTAAAATCTAAACTAGAATTTGTTTTAAA
ATCTAAACTAAAGTTTCAGTTTAAAACTTAAAGCAATATTAAAAAGTATAAAAAATGCTT
GGCTTTTTAGTAGTATATACTATAGTATAATATCTAAAGCTTAAAGCAATATTAAAAAGT
ATAAAAAATGCTTGGCTTTTTAGTAGTATATACTAATGCTATATATCCTATATATGTCTA
AAACTTAAAGCAATATTAAAAAGTATAAAAAATGCTTGGCTTTTTAGTAGTATAATAACAA
TGCTATATATCCTAGCATATGCTTAAATCTTAAACTAATATTAAAAAGTATAAAAAATGC
TTGGCTTTTTAGCAGTATATACTAATGCTATATATCCTAGTATATGCTTAAATCTTAAAG
CAATATTAAAAAGTATAAAAAATGCTTGGCTTTTTAGCAGTATATAACAATGCTATATAT
CCTAGCATATGCTTAAATCTTAAACTAATATTAAAAAGTATAAAAAATGCTTGGCTTTTT
AGCAGTATATACTAATGCTATATATCCTAGCATATGCTTAAATCTTAAACTAATATTAAA
AAGTATAAAAAATGCTTGGCTTTTGTTAGATCAACACAGAAGACTGCAAATATTTAAAC
CATTCTAATAAATTTAAGAATTTTTTAAGCTTATATATTATATAATATACCAATTGAAAG
GAAAATAATGAAACTGACTTACAAACACAAATTGTATACCAAACATCAAGATATTATTAA
CACATATCTGCGTTTAAAAGTAGAGTTTAATTTATTCAAGCTGGATTACAAACGACTTAG
ATATTCAAGTTTATTCACACAAAATACAAGACTTAAAACTCAAAAACAAATAGAAGAGCT
TGAAACGAAACTAACCAAAAAGGTCTCAATACACAAAAATTACGCAAGTTATACACTAA
AATTGTTAACAAAAAACCTTTCAATGATTTTGAACAAATCATCATTAATAATTTGTAGA
AAATGGCAAAAAAGCACCACAATTATTCAAACACGAACGTAAATTCGATAATAGATTTAC
AAGCCTACTATTAGAACGTAAAAAACGTCGCGCTAAAGCAGCTAAAGAAGTATACACAAG
AAGACCATTATCTCCAGAAAAACAAAAAGCTCAGCAATTAGTTCCATATATTTTTCAATT
CATTAAACTCAGAACTATGGAAAAATTTGGATATAATGAAGATTTAGCAGTTGAAATAAC
TGGCAGAATTTTTGGACCTGGGTGTGAAGAAGCTCTTGATATGTATTTAAAAGAATTCAG
AGATTTGTATGGTAATACAGACCAAGCTTTAGAGCATTTCAAAAAAGCTGAACTATTAGC
TAATTAAAAATATATTTAATTTATATTTAATATTAAAACTAAAGTTTAAAATCTAAAGGT
GGTAAAATGAGTGAAACTCGTATGAAACACGATTATACTAACGAACTTGAACTAAAATCG
CTAGCTATTCGTGAAAAAACTTCAAATTAAATCTAGGCTCTGAAGATCCTGATGGTTCT
ATAAATGAAGACTTAGACATTAAGATAAAAGAATATATTAAAACAAAAGATCCAGATCTT
AAAGACTATATTATTAGTATATCCGAGGGTGTAAAAATATCACCAAAATCTCACGAATAT
TTTGGTAACATTGTTATTCTAATGATTAAAAAAATATTAACTAAACCTAATTTTCCGGG
TATACTTGGCAAGATGATTTTTATAGTGATGCTTGCTATCGTGTATTTAAATATATTCAT
AACTTCGATCATACATTAAAATCTAAAATTACAAACCAATCAGTATCTTGTTTTAGTTAT
ATTTCACAAATAATTCATAATAGTATTTTAGCTATTATCAATGAGAAAAACAAAAAGAT
AAAGAACTTGAAAACTTAGCTTGTATGTATAATTCTGAATATGATATACATAATGAATCT
```

FIG. 14L. Continuation of (CJLB-12 [organism= Campylobacter phage CJLB-12] complete genome)

```
AGGAATGCTTCAACTATAGATATTGTTAATGAATTATATGTAGATTACACAATACCCAAT
TTTAATTTAAAAATGATTGAAAATATTTTAGATACCACTGAAATCAAATACAAAAATATT
AATATTAGATACAATGAAGGTTTTATATCATTTGATGATTACGCTGAACTTAAAAACGTT
CTAAGTAATTATAAACATTTTAATGTAAATCTAACTAAAGGTGATTCAAAATGAATATTA
GCCAAGATTTAATAGCAAAGGAAATTAAAACATTAAATAAATTCTACAAGTTTTTAAGAG
AGCATAAAAATGAATGTGTTATGGAAATAATGCAAGATTTTTGTGATTTAAATGATATCC
CTTTAGAAGAACTTGGTTTTTTGATATCAGAGGATGCATACTTAAAGATTATATAGAAG
CAAATCTTATTAAATATAAATTCTATAAAAGTCCTAAAAAAACTGTTTTTAGTGATGATT
TTTAATTTTATGTATATAAGCAATATCATAAATTACACGAAGTGTTAAAATTGATATTTG
CTTCGATTCTGCCAATACTAAATACTACTAATACTACTAACACTACTAACACTACAAAAA
ATAAGCTTAAAACAAAATTAAACCGATTTTAATAAATATAAAAAAATTCAAAGAAAGGTA
CCTAAATGTTAGACAAAGTTTTAAGCAACGATAGCTTTAAAGATGTTCTAACAGAATCAG
TTAAATCAGAAATTGAATCTGTGTTTAATGAAGCTGTTGAAATTAAAGCTGTTGAAATAG
CTAATGAACAAATCGAACTCGAAAAAATCAAGTTAGTAGAAGAGTTCAAAGAAGCTAAAA
AAGAACTTGAATCTAAAATTACTGAAAATATAGATTCATTCATTAATGAAGAACTTTATA
AATTTAAAGACGAAGTTCTTGAAAAATTAGACGCTGTTGTTGAGAATGAAAAGGCTGCTA
CTCTAGTAAGTATATTTGATAACTTAGTAGATGTTGCTGGATCAAACATACTCGAAAATT
ATGCAAACAAAGATTCTGAATTAAGTGATCAATTTGATAAATTAGTTGTTGAAAATAGAG
AACTTAAAGCTGAACTTGCGATTCTTCAAGAATCTAAAAAATTGATGAATTAGCTGCTA
ATTTAAATCTTGTAGAAAGTGAAAAATTTAAAAAATTAGCTACCTTGGTAGAACGAGGTC
AAGGTTTTGAATCTAAATTAGAAGCGTTATTTGAAGCTTGTAAAAAAACAAACGAAGATG
ATTCTGATGGATTCTGATGATTCTGATGATTCAAAGGATTCAAAGGATTCAAAGGATTCA
AAGGATTCAAAGGATATCAAAGAAAGTTTTAAAAACAAAGCAGGCGCTGACATTAACTGG
GCTAACTACTAAGTTCAACTAACAAGCTCAGTTAAAATTCAGTTAAAAAATAAATATATA
AAAAATTAAAAGGTTAAAAACAATGGATAAAAATGTAAGTCTTAATGAAAAAGTAGAGTC
TTATATTAAAGATTCAAAATACGCTGCTTTAAATGAAAGTGAAGCTGTATTGATGAGTAC
ATTGCTCAGCAACACTGCTTTAGCATCTCAAGGTGCACTTGTAGGTGAAAGTGTTATCTC
TAGTGATATCGCTCAATTTACACCAATCTTAATGCCAATTGTAAGAAGGGTTTACCCAGC
ATTAGTTGCTAATCAACTTTTAGGTATTCAACCTTTAACAATGCCTACAGGTTACATTTA
TGCATTAGTCAATAGATATACAGGTAATAAAAAAGACGGTGCTATATCTCCAGTTTCTAA
AGCTCAAATTCTTGTGTTTGAAGCTAATGTGACTAAAGGTGATACTGTTACAGGTACAAC
TTCAAGTGCGACAGGTAAAATTATACACGTTGAAAAAGATGGTAAAACTGCTTTAGTTCA
GTTAACTAGCGATAAAAAATTCCAAAACGAAGCTGCTAATAAAGGAACTAAAATCGTTAA
CGTTTATTCTAACGAAGCTACTTTCCATAAAATCTTAGAAACTTATTCAGGACCATATAG
TACAGCTGACGGTGAAAAACTTGCTGAAGATATGAACACTGTAGGTTTTGGAATTGAAAA
AGATACTGTTGAGGCAAAAACAAGAAAACTTAAAGCTGAATATACTTTAGAAATGTATGA
AGATTTAAAAAATCAACACGGTGTGCTTGCAGATGGACATTTAGCTAATCTTATTGCTGC
TGAAATGCAAACTGAAATAGATCGTGAGATTATCAATTTCGTAAACAATACAGCTACCGT
TGTCGCTGATACTTTAAGTCCAGGTGCTGAACACAAAGAAGCTGGTAGATGGGAAATTGA
AAGATATAGATGTAATGCTATCAAAATAGATTTAGAAGCAAGAAACATCGGGTTAATGAC
AAGACGCGGTTCAGGTAATACATTGCTTGTATCTCCAAAAGTTGCTACTATGTTAGATCA
AATCGGTACATTTAAATTTGCTTCTAGTTCAAGCAATATAGCTACTGATGTATTTACTGG
TGATGTAGGGACTTATGATGGTAGATATAATGTAATTGTTGATCAATATGCTAAATCTGA
TTATATCACTGTTCTTTATAAGGGTACAACCGCTCAAGATAGTCTCGGATTCTTCTGTCC
ATATGTACCATTAAGCTTCCAAAAAGTAATGAATCAAGAATCAGGACAACCAGGTATGAT
TGCAAGAACAAGATATGGCTTAGCTACTAATCCACTTGAACCAGAAAATTACGCAAGAAC
ATTCGGTGTAGATTTAACAGGAACTATTTTAGCTTAATTGCTTCAATAATTTGGGGATGT
TAAATCCCCAATCTAATTTTTAATACATAAACTGAAAAACTCTTAAAATTCAATTTTTA
AATCCTTAAATAAATAATAAGATTCCAATATACTTTAGTCGTTTTAGCCTAAAGGCATCG
AAATTGGTTTAAGAGCTCAACAACGAAGCTTGATGCAGTTCGAGAGACTTTTTGTAATAT
CAAATCATATTAAAAGGATTAAAATGGCAAATTTACTTAGCCTCTGGTATCCAGGTTTCTG
AAGTAGATCAATCTCAAATTACGCCTGTTGAAGGTGACTCTGCTGCCGTTTTTGGTGGTG
ATTTTGAGAAAGGACCAGTTGGTGTACATACTTTAATCTCAAGTGTTCAAGAACTCAGAG
ATAATTACGGTATGCCTAATACAAAGAATTATAATGATTATTATCAAGTTCAAAATTTCT
TAGCTTACAGTGGTGCAATTTATGTTTCTCGTGCAGCAGACATCAATGGTACACCCACAC
AATTAGATGGCTTACAATTTGAAGAAAATGCATATAAAACAAATGTTAACGCTAGTAAAA
TCGAAGGTGTTAAAGTTATCGAAGCTGACTCTGTAGACGTTAAATTCGAAAAAACTGATA
AATTCGAAGTTGGACAAGTTCTTAAATTCAACGATTCTAATAAAGAATATAAAATTAAAT
ATGTTAGAAATGAAGTTAAGCAAATACCAAATCCGATTATCAACCATTAACTCAATTAG
TAGTGGACCCAAGTCAAGTAAGTGCTTATGTTGATGAAGTTGTTAGCTACGTAATAACAG
CCGATGCAGAATCTTATACTGTAGAAACAGATAGACCTGATGTGGTTCTTGTTAACAAAT
CTAATAAATCTTTGACTGCATTAAAAGTAGGGACTGCTATTGTAACTTTTAAAGCTACCA
AAGAAGGTTCGAGAACTAATTCATTTGAATTAAAATTCGACGTTCAAGAAAAAGAACAAA
CAAAACTGCCGTAAGATGCAGATCCAAGTGGTAGAGCTAACCAAAAATCTAAAGCTAAGA
AAGGATAATAAATGGCAGATATCTACGATATACCAGAGTTTATAACTCAAGAAGTAACTA
TTGTTACTTTAGACAAAGAACCAGGTGAACTAAATGCAGACACTTCAGTATACTTAATGG
```

FIG. 14M. Continuation of (CJLB-12 [organism= Campylobacter phage CJLB-12] complete genome)

```
AAGGTGAATCTCAACCAGATTCTAATTATATTTTAAGTCTTAGAGGTGCTAACACTGAAT
TAAAACGCGGAGATATTATAGCATTTTCTGATGTTTTAACTGATCCAAGATTCAGAATCT
TAGCAATCTCTGACAGTATAGTCAATGGTGAAGCTTTCACAAATATTACTTATGAAGGAA
CTGAGGATTCTGAAGCTATTGTTGAAGCAACTAAAGGTTTTCCAGTTTATTTAGTTAAGG
CTACTAAATCGTCTTGTGTTGAAGTTCCTGTAGAAGGTTCTGAAACCAAATACGATGCGT
CAGAATATGAACTTTATGATCATACCATTAGTAACTTCAATACATTTGATGAAGATAAAT
TATCTAAACCATTTGTTTATAAAGATGCAAAATTAAAAATATTTGCTAAAACACCGGGAG
AGTGGGGCAATAAAATTGATGTCGCAATCGCACACCCTGATGATTTCAACAAAGGAAAAT
ATATCACTGATGGTATACCATTAGATTCTCAATTTGATTATATTCCTTATGGTGATCAAT
TTGCTGTTATTGTTATCTACGCAAACGAAATTCAAGAATCATTTATTGTAAGCTTAGGCT
TAACTGATAAAAATGAGAAAAATGAATTTACTTATATAGAAACAATGATTAATGGCAAGT
CAAGCTATATCTTAGTTTCTGTAAATGAAGCAGTTCAAGGTAAACCAAAAACTTGTTTAG
GTGAAGATTTACTTAAACTTGAAAATGGTATGGATTCAGCTCCAGGTATTGGCGATATTA
TAGACGCTTATACAATTTTTGACAACAAAGAAGAAATCGATGTTGATATCTTAATTTGTA
ACGAAACTTATCCAAAAGCAGCTACTGATATTGCGATTACTCGTGGTGACTGTATAGCAT
TTATGGGTGCACCAAAAAGTTGTTCAGTGGGTTATAAATCTACAATTGCTAATCAAAAAA
CACTTGATTTTAGAAAATCTTTAAATATAGATTCTAAATATGTAACTTTGTGTAGCAATT
ACAAATATCAATACTGTGCTGAGCTTGGTGGTTACAGATGGCTGAACTTAGCTGCAGATA
TTGCAGGTCTTAAAGCTCAAACAAATTATAATCAAGCTAACTGGTATGCAGCTGCTGGTC
TTAACAGAGGTCTCATTAAAAACTGCGAGGCGTTGGCATATAGCCCAACTGGTGCGATGC
GAGATTTCTATACAAGAATGGTATAAATCCAGTAGTTATGTTTCCAAACACTGGTGCAGT
TCTTTGGGGTCAAAAAACATTACAAACTAAAGCTTCAAGCTTCGATCGTGTAAACGTTGT
TAGCTTGTTTAACCATTTGGAAAGATCTTTAGGGCGTATGTCGAAGTATAGTCTATTTGA
GTTCAATGATAGTTTTACAAGAAATTACCTTGTAAGTATTATCAAACCTTTCTTGGCGCA
AGTAAAAGCTGGCCGCGGGATCCAAGACTACCTTGTGATATGTGACGCATCAAACAATCC
AGCAAGTGTAGTTGCAGCGAACCAACTCGTCATAGACGTATATATTAAGCCGACTTATGT
TGCAGAGTTCATTCATCTCAGATTCACGAATGTCGGTTCAAACGACTTCAGCATTGTTGT
AAGCTAAACCCAAGGTTCAATTTACAAAAGATTCAAGGATTTTACGATCCTTGGATCCAC
TGAAACTTCATATTTCCACAATCGTATATTATTCTATAACCATTTAGCATCATATTAGCA
CTTTCTGAAAGACTAGGATCGAAAATCTCTAACTTTTCTTTTAGCTTATGTTTTTGAAAT
TGATGTCTAGCCAGCAATTTTAAATCTTTGAAATAAAAATAATTAGGCTCAGTATTCTCT
ACGAACTTAAAACCTAAGGTTTTATATATTGACCCTTTACTAAATCTTCTATTAGCATAA
CTTACTATACTTTTTGGTTTATAATTGTCTAAGAAATACTTAAATAATTTAGAAGCTCCT
CCTATAACCGAACAATATTTAAAGTGCATAATCTTATTAATTCATATTCATAGTTTTTA
TTAAATCTAGGCTTACCAAATGTCATAACTTCTACTAATTCGTTATTATAAAATAAACCT
AAATTAATTTTTGAAACTGTCGATTTCTGTAAATGATTCTCATTTAAAAAGTCAACTACT
TCATTATAACTTAATTCTTTTATAATACATTTTCTAGCATAAATTTTTTTATTTAAACCT
AGTTTGTTATTAATCATAGAAAACCATATATCTAAATCATCAGATTCAAAAATATGAAAT
AATTGTATCTCCAAAGCTTCACACATTTCTGTCTTTTTTAAATGATATTTTTTATCATAA
TCAGGTGTATTAAACATTCTATGTTTATGTAAACCTCTACTGTGAAAAAATAAACCATCG
TATTCAATTGCTAAGTTATAATCAGGCAAAATATATCTAATTCATCCACACTCATAACC
ATAACGTTCCAAATTAGTTTGTTTTCTTTGATCAGCGATTCTTTGTATTTCTTCATCGGA
TTTAGAATCCCAGGTTTTACGAACGGATTCTTTAAATTCCTTTGTTTGAGAATTACAGAT
AACTCCAAACTTTTTAGATTTGTTTCAATTGTTTTATTTTTAACAACTTCACTTTGTGT
CGCATATTCAGTATTATATTTACTTAAATTGGTTTCTTTTCTTTTATTGTTTATTTCGGT
ATAATCTGTATTGGCTTTGGTGTTTCTAATTTTATCATTTACTTCTGGTATCTGTGATAC
GTTTTCTACATTGTATTTTCTTTTATTGTTTCTTTATGTTTATCTATATTATTGTAGTT
AGCATCACCATATCTTTCTAATTTTGTAGATTTGATTTTAGCTATGCGTATTTTGTTAAA
ATCTGGTGATTTTAGACATTCTTTACAATATTGTGTCCTTGTCTTAGTTCCACAAATTAC
ACAAAAATTAGGATTGTTTTGTAAATCCTTGTAGTCTTTGTATATTGAATGAAATTCCCC
ATTATATTTAGGGTCTTTTAATAGAATATCAATAATTTGTTTCTATAAAGTGGATACTG
TTTTAATTCAATGAGTATTTCTTTGAAAGTTTTGTTTAGATCTATCGTTATATTTTATA
AGTTACTTTCATTTAAATCCTATTTTTAAATAATATTATTATATAATATTAAAACTTAAA
AATATATTAAAATTTTAGATATATTTAAAATATTAAGTAAGTTTTAAGCTTTAATATA
TTATAATTACAAAAGGAGATAACAATGTTGAACTTAAAAGATTTAAATCACAAATATAT
TGATGCTTTATATCGATGTTTGAATGGCACTGAAAATACACCAAACAAATACCACTTAGA
ACCGAACGTTGGTATACACACCGAAATGGTTATGGCCAAAGTCAACGAATTATATAAAGA
TGATCCTGATTATAAAGTATTAATATTAGGAGCAGCTTTCACGATATTGGTAAATAAT
AACTAGAACACCATCTAAAAATAACCCAGAAAAAATACATTTTTTAAATCACGAAAATGC
TGGTGTGTTCTTTGCATTAGATGTTTTACACGATTTGGATTTAAATCTAACCAAACAAGA
AATAATAGATATAATTAAAATAGTAGCCCATCACGACATTTATAAATTCGATTTAGAAAC
ACTTAAAAAACGTTATGTTTATAGAGATTTAAAATTATTATCCAAGTTTTCAGTTGCTGA
TGCTTTAGGTAGAATCACTGAAGTTCCAAAAGAACTTCCCGATTTAAATATTGAAGCTTA
TGATAGATCTAATGTTGCCAATGAACAGTTTTAGAAGTATTAGTAGGATTACCAGGTTC
TGGTAAATCAACTTATGTTTATATGAATGATAAAGCAGCTATATCAAGAGACGATATTTT
AATGAGATACGGTTTTAAAAAATACAATCAAGTTGAATATTCAGATATTTGGAGAAACTT
```

FIG. 14N. Continuation of (CJLB-12 [organism= Campylobacter phage CJLB-12] complete genome)

```
AACAGATTCTGATCAAAAAGAAATCGATTCTTTATTTAATGATAAGTTTTTAAGAGCACT
TCAAAAGAATCAAAATATTTTAATAGATAAAACGAATACTTCGATTAAATCGAGGCGTAG
ATTATTTGCTACTTCGAGCTTGGTTAGAAATTATCATAAGAAAGCAGTAGTATTTTTAAC
ACCATATACAATGATATTAAATAGACTTGAAAAAAGAAAATGCTACAGGTAAAATAATTAA
TAAAAGTGTTGTGGATGCTATGATGAAATCTTTTGTAATACCTACTTATGAAGAGTTCGA
TTCAATAGAGTTTAGACTTTGGTTCTAAACTTAAAAGCTTAAATTTTAAAATAATTTAAA
CTAGAGTTTTAGTTTTTAACATAAGATTCATAGAACTTTAAGTTCAATTATAATATAATA
AACAAAAAGGAGTTATATGCTTGTTCTCACGAAGTTCCGTTAAGTCTTTTAGAAAAATC
AAGAACGTTTAATGATTATGATTATGCTTTAGTTCATTTATTTGAAATCTACCCAGAATA
CAAACAATTTTACATAGATTCATTAAAAAAGCGTAGAACAGTTTATTTAGATAATTCTTT
ATTTGAATTAGGAACATTATACGATCACGATAAGTTTGCTAAAGAAGCAAATGAATTAGG
TTCTATCAATCCTAGTAATTTCTATTATATAGTCCCTGATGCTTTAGGCAATGCTAGTGC
AACAATACAATCTTTTAGAGACTTTTCTAAGTTTAGTATACCTGGTAAGAAAATAGGCGT
TGTTCAAGGTAATACTTTAGAAGAATTAACAGATTGCTTTAAGTTTATGAAAGAAAATGC
AGATATGGTAGCTATTTGTTTTTCAGGAGACTACTTCTATGAATACGAAGGTGATACTAA
AGAAGCTAAATTAACACAAGCAAGGATAGATTTTATAAAACATTTAGATAAATTAAATCT
ATTAAAAGATTCTAAAATACATTTATTGGGTTGTCAAGTTCCTCAAGAATTTAAAAATTA
TAAGAACATTCCAGAGATTGTATCTTTAGATACTTCTAACCCAATTGTTCACGGTATATA
TAATGTAAGATATTCTAAAGATGGTTTAAGAACTAAAATAAGTACTAAATTAGTAGATCT
TATAGATTATAAAGGTTCCGCCAATACTATTTTATTAAATATTATGGATTTTAGAACTAT
TAATGGCCTTTGATATGGTTTAAATAGCCAAAATTAGGTTTTAAAGGGGTTTAAATGAAA
ATAGGATTTACAGGAGTTTCAGGTTCTGGAAAGACGACTATAGCCAAATTATTAAAAGAA
CGATATAATTTGGATATTATTCCAGGGCCTGGAAGAAAATTAAAAGAATTGGGTTTTAAT
ATAAATGAAGATGGTGATATGGAAATCAAAAAGCAGCTTTGCAAATTCATATAGAAGAT
CTTAACAAAGATGGTATATACGAAAGAACAATATTAGATGCTGTAGTTTATACTAAGTAT
TTAGTAGAGATTAAAAAATCAATACCTGATGTATTTTTAGATTTAGCTGAAATAGTTTCT
ATTGAATTAATGAAAAATATGATAGTTTTTTATATTAAACCAGAATTTGATTTAGTT
CCGGATGGTGTCAGATCTACTGATTTAGAATTTAGAAATATTTGTAGTAATTACTACGAT
TACTATATAGATACCTACGGTATTAATGTAGTTAATTTAAGTGGTTCTGTAGACGAAAGA
TTTAAAGCAGCTGTCAAAATTATCGACAAAAGATTTGAAAATTTAAGGAACTTTTAAGGA
TACTTAGTATATAATTATAAATATAAATAAATTAGATCTTTTAAATATCATTGTTAAACA
GATTTAGAATATAACCAAAATTGTGAGCATTTCGGATTTCCTGACAGAGAAAATCATCAT
AGTGTGCTCCTTTTTCTTTAGATTGCAATGTAACTTAATTGAAAGATTAAAAAATTTAAA
AAGTTTAAAAATCTGAACAGAGAGATGCTCACAATTTTGGTTATATTTTAGTTTTAAATT
CTAAACTTAGAATGTTAGAACTATAAAGACTTTTATGTGCAGAACATCATACATACTTCT
TATTTAATCGGGAATTTGTTAGTATAAACTTAGCACACCGGAAGTCTTTATAGTTCTAAT
CAATGTTCAGAATAGTCTCTACCTTGCTAAGATAAGCGAACTGTGGATACTTCTATAATA
TTTTTATGAAGGACTGGGAGGTAGAACACTACCACAAACTCAAGACATTCTTTAGAACTC
GTATATCTTTTCTATCCTTATATTTTGAAGGACCATTACTTGCTCCTATCAGAAGATTT
CACACTATAGTGTAAAGTTTAACACTATAGTGTCGTATTTAATTTTAGAACTTAAAATA
ATCTTAAACCATAAAAATCATCAAAATAATAAATAAAACAAAAGCAAAGGAATGGTTTAA
CAGTTATGTCTAACAAAATTGAAGAAATTAAAAACGCACTAAAATCTGGTGCAAAAGCTA
CAAAATACCGTGTTAAACTTTCATTTCCAACAGAAGTGCAACATAAAATGGAATTACAAA
GCTTGAACTGCTTAGCTAAAGCTACTAGTTTTCCAGGTGTAACTATTGGACAAATTGAAG
TATTTAACCAAGGAAGAAAGCTTCCTATACCTGGTGATACTTCGTATGATACACAATGGA
CTGTGACATTTATATGGATAATGCACACCAAACTCGTAAAGACTTCTTAAGTTGGATGA
AAGCTTGTGATAACTTCCAAGCAAATACACATTCTGGTAATCCAGGAGGTTTATTTACAG
AAGTTTCGGTTTGTCAATTAGATTCATTAGAAAATGAAGTTGCTGAATATACTTTAAGAA
ACTGCTGGCCAAGTGGTGTTGGTGAAATTAGTGTTGGTGCTGATCAATTAGATACATTAC
AAGAATGTGATATCACATTTAGCTTCTCAGATTGGATTATTCTAATGGATCTGAATTTA
ATATGCCACAAGATGGTAAATCAGCTGCTACTAACGTAGTTTCTGTAGACCAATAATTCT
TAAGAGTCTGGAAATCCAGACTCATAAATACTTCAAAACAGTCAGAAAATGGATAGTTTA
AAGTTAGTTAAAAATCTTATTAAAACCAAATCGGTTGAAAAAGGACAAATTTTAAAACCT
GGTAATTTAGTAATTTTTAAATATAATCCTAAAGATACCAGTGTTAAATATGATAGAACT
CCATTGTGCCTGGTACTCAGAAAATCTAAATCTTATACCTTAGGTATAAATTTTCACTGG
TGCCCGATACCAATGAGAAAAATGCTTTTAAATGCCATATTTCGACTAAATAAAAAGAAT
ATTAAAGAGAATAAACCATTAGATATAGATTGGTATAGAATTAAGCCTATGCTCAAAAAG
TTTGGATTTTTTCCAATAATAAGACTTTATATTAATAGCAGAATATATAGAAGAGCAGTC
AAAATACCTAATGAAAATATGAAACAAATTATAGAAACTAAAACAGAAACTTTTATAGGT
GTTTCTGCAGAAGCTTTGTATAAGAAAGCGCTTAGGGATTCAAAAGTTTCAAGTAAATCT
AAAAAATGAAACATTTTTTAATTTAAAGCTTATAAGATTATAATATTATAAACAATCTAA
ACTAAAGTTCAAAGCTTTAAAACACAAAGCTCATAAATAAAATCAAAAGACAAAAGGCT
CCAATGAAAACTTATGTCGTTGATACCAACATCATTTTAGATGATGTAAATAATCTCTCA
CGTTTATACGATAGTGAAAATCGTATTATAATCCCCGAAACAGTTATTGATGAATTAGAT
GCTAAAAAATCATTATTCGATGAAGTTGGATACCAAGCCCGTAATTTTGCAAGACTTTTA
TCAAATCTTGATGTCATTGAACTTAATAAATTCAATGACTATACTGAGACAACACTGGGT
```

FIG. 14O. Continuation of (CJLB-12 [organism= Campylobacter phage CJLB-12] complete genome)

```
GATTCTCTTTTAAAAGTAACTATTACTAGTAAAAAAGAATATAAACACGCAGATGAACCT
ATTAATATTCTAAATGATAGAAAAATTATAGAAGTTGCTAAGTTATATCCAGATTGTATT
TTTATAACATATGATAGTATGTGCAAGATAAGAGCTATATCTGAAGGGGTAAAAACTGAG
ACATTCGGTTTAAAAAAAGATTTTAATGAAGTTCCAGAGTTTTTTAAAGTTCTCGATGTT
GAGAAATTACCAGAAAATCTTAGCAGCATTTTAAGTGTAGATCCAGATTATAAACACGAA
AATTATAACTACTTAATACAGAGTAAAGATGGTAATAAAAAACTAGCAAGGATACAAAAT
CACAGAATTAATTACATAGACGAAAAACACTTGGAAAAACAAGATGTCAAACCTATTAAT
ATCCGTCAAAAATATTTCGTGGATGCTATGCTAGATACTAATGTAGATTTACAAGTTGTT
TCTGCAGTTTCAGGATCAGGTAAAAGCTTATTAGCTATTGCGACTGGTATCAGATTAGTT
AAAGAAAAACAATATAGTAAAATTGTTTATATACGTAACTCAATTGAATCTTTAGATAAA
GGTGAAGATATTGGATATCTTGCTGGAAATGACGAAAAGTTTGCGGTTTTTAATCACCCA
CTATATGATTCTTTAGAATATATTGTTAGAAAAAGACTTGAAAAATCTAATGATAATAAA
TCAAGAAAAGTTAAAATTGATAATTTAAAAATACAAGAAGGTATTAAAGAAATTATTGAG
TTATCTGGTATCGAAACTATGTGGATTGGTGCTTTGCGTGGTAGAACAATTCGGATGCG
TTTGTTATTGTGGATGAATAATCCAGAAATTATTAAAAATTATAACAATTTAAAAATTTG
AAATCTAAAACCATATTATAACAAAACATAAAACAACAAAATATCTCTACTAAGTCAATG
AGCACCATATTAACAAGAGTTGACAAGGATTGTAAAGTTATAATAATTGGTTCAAACTCA
CAAATAGACAATCAATATATTAATAAGTATAACAACGCTTTAACAGTTCTTCAAAATGCA
GTTAAAAATCCTAGCATAATTAATACTTGGGGTGGTGAGTTAATTAATGTGGTTCGTGGA
CCTATAACTGAGTTTGCTGAACAAATTTTTAATAAAGATTCAAAACAAGAACCAGAGACT
ATGAAATCTTTTGTAGATTCTGGTATTAGCACACTTGAAGTGAATACAAATACTGAGAAC
TTAGAAATAAAATTAGACTCTGCTAGCTAATTTAATATTATTTTAAGTTTATTACTATAT
AATTACATTGATAAATTAAATCAAAGGAGATTAAAATGAAATTTGAAATGATGATAATTA
ACGCAGATGAGTTAAAAGGCGTTACAGCAGATGAAGCTTTTGTAATTTATGAAAACTTGT
ATAATACAGAGCAAGAAAAATTCATAAATAGTTTTTTAAAAAATACTGACAAGATAGAAA
TTGTAGAAAAAATACTAGAAAATTGTTCCAAAGAAGAAAAAGAAGAAATTAAAAAATTGT
TAGAAGATTAAAAATGAAAATTGGTTTGATAAAGATGGAAAGAAGATTAAAAGATTTTGA
TTTTAGATTTAGTATATAGATTATAATATTGGAAAGAAGTATATTAATACATAATTTGTA
ATAAATAAGTTTATTATAAGGTTAATCTGTTATAATTATGTATAAAATTAAACTATTAAA
AAGGGTAACAAATGACGTTTACGAAATTTATTAATGAAGCCATTATTAATGAAGCTGCTA
TTGATGATATGCTCAAGGAGATTAATGTAGCCAATAACAAATCAGGTCTGCCTTCAAAA
AAGATTATAAAGATATAGAATCGCTTGGGAAGAAAGCTTTAAAAATTCTACACAAGCTTG
CTGATGGTCCGCATAGCAACAAACAATATTATAAACTTTATAATGACTTACTGAACGAAG
TATGGAATATAAATCAATATCTACTTAGCTATAAAGACAAGATGCCTTGGTATAGAGAGG
AACTCCAATCACAAGAATTGAAAAGATACAAAGAAATCATCAAAGATTATATAGATGAAA
TCAAGCAAGCTATGAAAGAGTTAAAATCCGATTATGTTTCTGTTTCTCACATTAGTAATA
GAAATCTGGAAGCTATCATAAAATCTATTATAGACGAATATAAAGATTATATAAAAATAG
TTGAAAAAATGGCAAGACAAGCCAATAAAGCCAATAAGTAAAATTATTAGAAAATAAACT
TATTGGAGAACTTTATCGTATTACAAGAGTAGGTTGCTTATGAAACGTTAAAAAAATTAAA
AGAATCGTTAGAAAGGAGGTAACAAATGAAACTACAAGATTTTGATTTTAGAGTTTGGGA
TAAGCATCACAAGGGTTGTGGTAATAAGGATTGCAAATGCCAAACAAATATGTTTATGG
TGAAGAAGCCAAAACAAGGTTATCTGAGTTTAAAGAGGATTGTGAAATAGAGCTTTTTAC
AGGGCTTTATGACAAGAAAGGTAAAAAGTATACGAGAATGATATTGTTAATGCAAAGAA
AGATGCAGCTTAAGTATATTTTAAGTTTTATGAGTTTATTAAGTATAAGAGTAGATTTAG
AATGTGATAATGAGAATAATGAAAAGGTTGCTTATGAAACGTTAAAAAATTAAAAGAATCG
TTAGAAGGTAAAGATCAAGGAAAATATTTCTGTGAGATATTCAATAATAACGTTGATATC
TTGGTTATTGATGTGGTATGAAAAAACACGAAGCTATAGTTCAAGTTTTAGAAGATGTG
AAGATGTTATACAGAAATGATTAAGTAAGAATTAAAAGTTTAAGGGTTAACATATAGAAT
AATTAAAATTTAAATTAAAGGAGATTGATTGAAATCTTATTTAGAAGACTACTTAGAATC
TATCTATGAAAACGAGGACAAAATTCCTAAATACAATGTAAATCAATATTTTAGATCAAG
TGAAGAAATTGAATCTTTAGATATAGATTATGAACTATTCTTATAGCTAAGGATATTTT
GAGAAACCCAGATGCTTATACAGAAGAAGAAATAGATTTAGTTTTAAGTGGTATTTTTTA
TATTGCAAATAATTTAAATAAAATTTGTGAAATAATAAACACCTCAGAAACAAATTATCT
CTTAGACACAGAACACTTAATTGATATGCTTATGTTAGGTGAAAATAGACTACAAAAATT
AGACGACGTTACTTTAAAATTTGCGTTGAATGCTATAGTGGGTGCTACTATCGATTTGGT
AGATTCTTTGTTATTTGGTTTAGAAACTTTAGCTTCAATTAAAGCTGAGTCTAAATTGA
ATCTAAGACTGAAGCTAAAACTAAAATTAATTTTGTTTTAAGTAATTTTAATATATAAT
AATGTAAATCCATTCAAGGAATATTAATGAAAACAGAAAAAGTTATTTTAGGTGTAGACA
TAGGTTACAGCTTTGTTAAAGTTTGTGTAGGCACTGGTGATGGTCAAATAATTAAAAAGT
TTAAATTTCCAAGTGTTATAGGCCAAACCAAAAAACTTGAAGGTGTTCAAAATGATAATA
TAGTTCATTACAATGAACGTTATTATATGGTAGGTGAAGATGCCAAACATTTACCAAGTT
CTAATATCATAGATTTAGATACTTATAAGAATTTAGAATATTTTGGACCATTGTTATTGA
ATCACGCAGTGAAAATTGCTAAACTCAGTAAAGTAGATTTAATAGTTTCAGGATTAAGTA
TTGCAGAAATTAAACAATCTGGATATTTTCAAAATGTACTAAGTCATTTTGTGGTTGATG
GTACTGAATACAATTATAATGTAATGTTGTTACCTCAAGGAGCTGGAGCTAAGTTAAGTT
ATGAAAAATTCGGAAATGATTTTCCAAATCTTCAAAAAGAATACTTAGGTGATTCAACAT
```

FIG. 14P. Continuation of (CJLB-12 [organism= Campylobacter phage CJLB-12] complete genome)

```
ATTGTATTGTGGATATTGGATTCAATACATTAGATTTAGTTCTTGTTAATAAAGGAGTTA
CTTCACCAGAATTATTCGAAGGAATTTCACAACACGGATTGATGAAAATAGCTTCGCAAG
TTGCTAAATTAGTAAATGAAAAACACAACAGATCTATTTCATTGCCAGAGGCTAGAGAAA
TCTTAGATACGGGTGTTTATAAACTAAGAGGCCAAAAATATGATTATACTAAAGAAATTG
AAGGTATTAAAAAGAATACTTAAGAGAAATTTTAGCATTAGTAAATGAAAGATATAGCA
ATATATTGGATAAACTAGATTTCTTGGTTGTGCTAGGCGGTGGTGCACACATTTTCAAAT
CTTCAAGTGATGGTTATATTCGTTGTGTTATTAAAGATACTGAGTATTATAATGCTATTG
GAGAATTTATATTTGGAACTAATAATATAGATTCTATTGAAGTGAATGATTAAGACAAGG
AGATTTTATGTTTAATATAAGTAAAACATTTGAATGTTGTTACGGCCATAGGGTTTGGAA
TCAATAGCTGGGAACACCAAAAATTTCAAGGAGCTTTTACAGCTCCTTAATTAATTTTT
AAGCTTTTTTTTATATAATAAAACAATTTTAGATTCTAGTTCTAAGCATACGACACTTTA
GTGTTATATGTCTGGCTCTAAAATATAAAACTAGAATCTAAATACGGTTATAACCACTCA
AAAACACGGTTAAAATCGACTTTAATTTTTTTGTTATGTAAAAAAAAACATTTAAAGGAG
TTTAAAAATGATTTCTGCAATTGAATTATCTAATATTGCCGTCAACCCAAGTATTCAAAC
TATTCGTTCTTTAAAGACTACGAAGAAACAAGTCCGGGTAAGTTCGAATTATCCGATGA
TTTTGATCTAAGTACTGAATTATTTTTTATAGATACTAAAGAATCTATTGATAATATTAT
TAAATTAATTATTTTGGATCCAGAATTAACACAAAGTGTAAAGTTTGGTTCAATTAAATA
TGATTTTATTATAAACAATAAAAATTTATATAGAAAAATTGTTATTGACTCAGGCTCTAT
TATTGACAAGTTTAGTACTATACCATTTGAATATGGTTATGAAGAACCATCTAAGGATAC
ACTAAAAGAATTCAATGAATTTATAGAATTAACTACACGCAATTATTTATTCAATACAAA
GAACCCAAAGGGTATAATTATTACAAATACAAAAGATTTAAAATTCGATGAACTTAATGA
TTTTTTAAGAAATTCAGGATCGCAAACATTTTTCAATACCGATGCTAGAGATTTTGATAT
TCTTAGACGCGAATCAACTATGGTAACTCCGGATAATATTTTCTTTAATCGTGAGGGTGA
ATTAGTTTGTGTTAATGATTTTATTGACCCATTAAATGTTTTTAAACGTACTACAGCAAT
GCTGTTAGCATCTTAAGTATTTTAGTATTTAGAATGTGCTAGCAGCTTAAAATGTTATAA
ATATACATAAAGGTACCTGATGAACTAGCTGATATAACAGATTTAAATTTAAGTACATTT
TAAATTAAAACTTAAATGTTATTAATTTTTAGTAAGCTTAAAATGTTATAAATATACAT
AAAGGTACCTGATGAATAAATCAGAATTTAGAATATATCGTGGTATTGTTGTTAATAATG
ATGACCCTAAAAAAGGAGGTAGAGTTCAAGTTCGTATATTTGAACTTCACGGAATGAGTG
AAAATGCTACTCCTGGCCAATATCCAGTAACTTCTGGAGAAAAGGACACTAAATATAATC
AAATACAGGAAAGTGATTTGCCTTGGGCAGAAGTTATGCAAAGTATTGATTATATTGGTT
ATTACCCAGCACCTTCAGATGGTTCTGATGAATATGCCAACAATATAGATGGTAAAGGTT
CTAAATCTGGATACAAAACTATAACAAGATCTGGAAAATATCCAGGATTGGTTATAACG
TTATATTAACACCAGGAACTTGGGTATTTTGTGTTTTAGACAATAATAACCCAAACTTAC
CTATTGTTATAGGCTGCATTGCAAGTGAAAACGAAATACACAAAAATACAAAACCTAAAA
ATACTAGAGTATATGATAGTATTACAGGTCATTACGAAGAATGGAGTGACGAAGATGGTA
ATATTATTTTTCACCACAGAACTGGTACTACAATTACTATGAATAAAGATGGTGAAATGA
CTATCAATACTGTAAAGAATAAAAAAGAATATACACAAGAAAATAATTTATTACATATCG
ATGGTGAACAAAATGAATACGTTAAAAAAGACGTTAATGAGAAATATGACGCTAACCACA
ATTTAAATGTTAAGTCAAACGAAAAGTTAGAGGTAGGTTCTGATAGAACACGTAAAGTAG
GAGGTAATGAAAATGTAACAATTTCTGGTAACCAGAATATAAATGTGTCCGGCAGCGAAA
CAATTTCAGCAGGACCTAGTATTACTATGTCTGCTGGAGTCATCAAGCTAAACTAAACTA
AACTAAATTCAATGAAAGGAATTAAATGAAAATATTCAAAATATTAAGTTCTCATTTTA
TATAATACTAATAATATCAATTATTTGTGATATAGTGTCTTTAATTACAGCAGGTAAGGT
TGTCGTAGAGCCAGCAACTTATGCTTTGATTTTAGTAGCTATTTGTATAGAAGAAGTTAT
ATGCACTCGCAATAAAATTATAGAAGAAATTAAAGGTATTGACGTTCATATTAAATTAAA
TGATTATTTAATATCTACTAGTAATGCCAAAACTAGATATTTAAATACAAAGTCTGAAAC
CGAAGCCGGGATAACTAAAACTAAAACTAAAGTCAAAGATGTTAAAACTGAGTCTAAAGC
TAAAGAAAGTAAGTCTAAAGCATCAAAAGCTAAAACTAAATCTAAAACTGATAAAGAGAT
ATTAAAGATATGTTAAACGGAGCTAAATAATGCCTCCTTTAACTAGAGTTGGTGTTGAT
TTTAGTACAGGGCATTCTTCGTTCCGCCTAATACAATTTCGAGTGGTTCTACGAATGTC
TTGACTAATTCAATTAGTACAGTTAGACAAGGTGATCCTATACCACACCCAAGTCCT
AGCCCGTCACCACCACACGGTGGAAGCATTGTTACAGGTTCTGGTACTGTTATGGTCAAT
TCAAAACCTGCTTGTAGAATAGGTGATGCCATTAGTTGTGGGCAAGCTGTAGCGCAAGGA
TCTGGAAATGTTATTTGTGGATAAAAATTTCTAATTAAGGAGTAATATATGTATTTATT
TCTTTTAGTGAAAGTATAAGCAAAGATGTTGAATTAACGTTATTTGATAATAATTTTCAA
CGTATTGCTAATAATTTTTATATAAACACTTCTCCTAAAAGTATGGCCGATACATATAAC
TTCCTTTCTGAAAATTATTTTGAAAATGTAAAAATATATTATGGTAGACTTGGAGATCTT
TCAGTTTGTGAAGATGGTAATCTTAAATTTTTAGAAGTTGATAATATATCAAAGTCTAA
CCTATGCTTGTTATACTAAAAAGGCTGAAAATACTAGACTTATAAAGCTATGAATACGAA
TGCTATTTTAATAGGACCTTGCAAATCGAGAATCCCCATAGATGGGTCACTTTCGAATGC
TTTTGAATATTTTATTTCTCTTGGTTATATAATAAAAATATTATTCTTATAATAGATAC
TACTTTTGAATCTCTTGAGATTGTTAAAAAATATCTTGAAATTAAATATAATATTAATAA
AGATTGTTTAAGAATATTATAATATTTAAAAAATGTTTTATGTCTATCAATAATTTAAT
TTTATTTGAAATGTACTGTATAGATCATTTCGATAGATATAAACCATTTTAAAATGCAA
GAATTTATATGCTTTAAGTGGCTCAAAAAATCATACACTCGAGTGTAATTATTTTGTGGA
```

FIG. 14Q. Continuation of (CJLB-12 [organism= Campylobacter phage CJLB-12] complete genome)

```
ATACGAGCATTTAAAACCTGTCGGTAAATCAGTTAATTATAGAAGTAAAATATTTTTGA
GATATTGAATAAACCTAGATTTCAAAGAATCAAAAATTTATTAATACCAGAGCAAAATA
CATTAAAAAAGAATCTGAAATAACTAGAAGTGATTTAAATATTATGTCTAATATATTCGA
ACAATTTAATGAAATGTTATATATACAAGATCCTGTATTTTTTGATGTAAAACCTAGATT
ATTTCAAGAATGTCAATATTTTGGTGTCCCTTATGAGTTTGTTGAACATAAAGATTGTTT
TGATGGTGCTAATTTGAGAGCATTTGACTATGATTTAGAATCCAGATTTATGAGCCTTGA
AGACCCTATAATATCATTATTAGTGGATTCCAATAGTGCTGGTAATGTTAGTTCATAAAT
AGTTCATAAATATATCAAAGGAGTTTAATGAAACTTATAGATTGTTTTAAAGATAATAAT
GATTCTGCTTATATTTTTAAAGGTTTTATATATTATTATATTTTTAAATATAGAATACAA
ATGCTTCAAGGTAAAAGCTATATTATCATAACTTGTTATCGTGGTAAAGATAATGAATAC
GTAGCTATAAAACCAAAAAATTCAAAAAAATTATTAATAAATTAATGGAAGAAAAACAA
GCAGATATATTCGTGATGGAAGGAACTATTAAATTAAACTCAGTGAATTCTAAAAATTTT
AGATTTACTTTAGATTCTGGAATGTATTTGTATATAAGAAATAAATCCTAGATTAATCTG
GGTACGAAAGTACTCAAGATTTTCAAATTACGAACCGTATTCGCATTTGCTAATCGTAAG
CTAATAGTTTAATAAACTTTTAAGTTATTTCTTTATATAATATAATTTTAATAAAGGATT
TTAGAATGAATTTAAAAAGTCGAATTTGTAATATTTCAGTGAGTTTTCTTTTGAGAAGT
TAATAGAAAGATTTTTTACGGGGTTATTTGTTTTGCTTATAGCTATATTTGTAGTTGTTT
TATATACGTTTATGTTCTCGTATTTAGTCAGTGTCATAGGTTCTATAACTATTGCTATAT
TATTGTGTGTAGTTTTTACAATTATAGTGTTGTTTTAGGATCACTCTTAGCTGTATAAT
ATATAAATAAATTAAAGTTGTTTATATAATATTGAATGTTTATAATAGGTCAAAATTTGT
TTAAAACACTAGAAGTTAAAAATTATAATAATAATCCAGATTTGAAAATAACGTTAAAAC
CTACTTATAAATGTAACCAAATGTGTTCGTTTTGTTGTGAATACGACAATACATTCCCGG
AATGGGATAGATCGACCATTACACGACTCGTAGATAAATTAAAAGATACCCCAGATAGAT
TTCAAAAAATATTTGTGTACTATTATGGGGGTGAACCCACATTGTTTAAACACCTTGAAG
AACTTACCGAAAATCTTTTTGAAGTTTACAAAGATAGAGATTTGTTTATACAATGTCAAA
CAAACTTAAGTATAGATAAAAATAGACTTTATAATTTTAAATATAATAATTTTGAGTTTT
GTTCCTCTTATCATATGAATAAACAAAAGTTGAAGATTTTATTGAAAACTTAATATAT
TAAAAGAATTAAATATATTAGGTTATTGTTTTATGAATACGTATTTAGATCAAGAACAAC
AATTCATAAAAGAATTTAATGCTTTAGCGCAAGCAATACCTGATAAATTAAAAATGAGAT
TTACAGTAGATAATGCTAACCCAGGTTCAAAACATATGAATTATGAAAAACTAATAAAAA
CTTATCCATTTTTAAATAATTATTTGGAAACACAATTTACATTTTTTAATAGATTCTAAAG
AAGTTATTTACGATAAAGCATATAACGAAGGATTATATAAACAATGTAGATTTTGTAAAT
GTGAAGTTGGATCTAAAAGCTTGGTTATCAATTATGATGAATTGTGTTACCATTGTGATG
ATGAATCTAATAAATTTAATAATAAAGAAATAAAAGGTTTACCTTTAAAAGACTTAGATT
TAAATAATTTTTTGTACCTTATAAAATTTGTAGAGTTAAGCAGTGCCATAGAGGGCTTG
AATTTAAAAAGTGGAGATGAGATGATCGAAATTTTTTGCACAACCAAATGTAATTGGAAT
TGCTATTATTGTTGTGAAAATATACATAATTCTAAAAAAACACCTAATTATGAAGATATT
ATATTAAAGTTAAACAAAATTTGGATAACCCTATTATATAAGTGGTGGTGAACCTGGT
CTGATACCAGAAAATATAATTAAAACTATATTCAGTATACATAGTGATGTTTCTGTTAAT
ACGAATGGAACATTTATAAAAAAATATAAAAATTTTGTAGATAAAGCAACTAAAATTTAT
TACCATTGTACTGTAGATTTGGAACCCATTGAAAATACATACACTGAGAATAACATAGAA
TATTTAGTTATCGTAACTGATGATAACATTCATAAATTAGATAATTTTTTAAAAACTTAT
AATTATATATATTTGATGTTATACCCTGTAATATACCACAAGATATTAAATATTATAAA
AATTTATCATTAGAAAATATAAAATTATTGAAACAAATTATTAAAAATAATAAAAATGTT
TATAAAAAATCTTTATTGTATTTAATGAATAAAAATAGATATAATATAAAAAAATTTATA
TAGGATTTAGCTTTGATTGATGTTAATTGTCACACAACTTTTGGTGACCTTAAAACAGTA
ATTGTCGGCATAGAAACAAGTAAATTAGTAAGAGATTTAACATCTATTGGTGCTAACTTC
TATGGTATTAAATCTAAGCTAATAACACACCCATTAAATAGAGTGTTAAAACGTATAGAA
CAATTAGATTCATTAAGTTTAATCTTAGAACAAAATGGCATAGAAGTATTGAGACCAGAT
TATATAAATGATGATATAATTCCTTCAAATGTTAGAGATATATTATTCTGCTTTGGTGAT
ACTCTTTATAAAATGGCTTTGCCATTAAAATACAGAGTAAATGAATTTAAATGTCTTGAA
AATATTTTTAAAAATATAAACAAAATTGTAGAATTTAAGCAAATACAAAATGAACCATCT
GTAGAATCTTTAAATTATATAATAAAAGAAAATAACAAGGTTGAAGCTTGTATGGATGGT
GCTAACATAATACCTTTAGGTAAAGACTGGATAGTTAATGTAGCATCAGATTCTCAATAC
AATATGTTTTTAGAATTAAAAAAAATTAATCCAGATATTAATATGCATATAGTTACTATG
GATACTAGTCATTTAGATGGTTCTTTTAGAATAGTTAGACCGGGGTTAATATTTGTAAAA
GATTTATCTTATATCACTAATAGGATACCGAAAATATTTAAGAACTGGGAAATAGTTAAA
ATTGAACATATAAAAGGTCATCGTAAGGATGGTGTTTGTCTTGTTCTGAAATGGGTATG
AATCTTAATTTTTTAATGTTGTCTACAAATAAATGTATAATATCAAAAAGTAACAATTCG
TATAATAAAGTTAAAATAGAATTAGAAAAACGTGGTATAGAAACTATAGAAGTTGACTTA
GAAGATTCTGAGTTTTTTGGCGGTGGTATACATTGTTCTACTTTAGACTTGAATAGAGCG
GATGAATTAATAAAATATGTGTAAAGTCATAGTTTTAAATTTAATAGATTATTGTGGTTT
TAATTGTGAATATTGTTCATCAAGTCAAGTTAAAAAAGTGAATTCAAACCCTCTAACTAA
ACTTAATTTTTTAATGTTGATAAAGCAAATTGAAAAAGTCTAAGTCGTTTTATAATAAA
AGTTACTGGTGGGAGCCTACTTTACACCCTAATTTTTTAGAATTTATTGAAAAATTAAA
TAACGTTAAAAATATACAGCGGGTGATAATAACTACTAATGGTAGTTGTAATAATTTAGA
```

FIG. 14R. Continuation of (CJLB-12 [organism= Campylobacter phage CJLB-12] complete genome)

```
AAAATTAAATAATTATAAAAAAGTACATACCATTATTAGTTACCATCCTAATCAGATTGA
TGAAGATAGTTTTATAAACATAATAAATAAACAAACAATAAAACAACTATATGTAGCGTT
ACCAGTTTTAGGTTACCCTACAAAAATAATTGATTTTCTCAGTACAAATAATTATCATTT
TTTTCTAATTTTTTTAACGGATAAAAAAGGATTGAAAGTTCCTGTTGAAGAAAATGTTT
TAATTTTTTTGAACAAATCTTCTTAAACAATAAAAATATTTTAACCAATAGATTTAATCT
AACTAGGGATGAACAATATTTTAATATTTTTAAAAATAATCTGAATAAATCACTGGGTTG
TCTATGCAACCCCAAATTGATATATTATGATAATGGCATATTTACGTCTAAATGTCGTAA
CTTAAAATCTAATAAATTAGAAACAATGTTCGGTGTTGATATAAATTGTAAAAAAATAGC
TTGTGAAGATTATGAAATAATGGAGTACCGCAAATGAAATTGGTAAGAGGTTTTGAAGAA
GTTTTACCTATAATTAGCATAAACGTCACAGACGCTTGTAATTTCAATTGTTCATATTGT
ATTGGTTATCACAATAATATTAATAAATCTAAATTTATAAAAATATCAACTTTGATGTTA
TTTTTAAAAAAACATATCCACAGACCAGTTAATATACAATTAGTTGGTGGGGAGCCTACT
TTACACCCCAAATTGAATAAAATTGTGGAAATACTAGTGCATAATAATTATATAAATCAG
ATTGCTCTCATAACAAATTTAACAGCACCTCTACATTCATATAATTTTAACAATAGCAAA
GTTTTTATAGTTGCATCCTACCACGGCAAAAACTTTTTTAAATTTATTTTAAAATATTAT
AAAATTAAGACTCGTAAAATAATATCACTTAACACGGTAAAACTCAAACTTGTAGAAAAT
GTTGTAGCGTTGTTCGATAAACATAATATTAACTATTTTATAAATCCTATACACGATTGT
AATGGAGTGCCATTGGATAGTATTGCAAAAAAACATAGCAAAATTTTATATATGTTTGAT
TGGAATCTCAAATACAAAACACACGACAATATTTTGGATGATAATTTTGAAATATTACGA
CTAAATACCAAAGATATAAAATGCAAACCTTTAAATTTTTTATTAGATATTGATGGCACT
TTTATGAATGATTGTTTTAAGCATATTAAAAATATAGATGATAATATTGTAGTAACCTGC
CCACATAAAAATTGTAAATGTTTAGAACTATGTTGGTATCCAAAATATGAGTAACATTTT
AAATTTCTCAGAACTTGAGAATATTGAAAGAAATATTGTTTTTTTTAATGTTTACGATTA
TTGTGGTGTAAAAGGTATTCTTAAATACTTAAATTTTCGCAATCATAATGTATATACATA
TAGTTATGATGATTTGAACCAATCATTTTATAATAATGTATTTGATACTAAGTTTAATTT
AAAAAAGTTTAAAAAATACTATAATATTTTAAAAAATTTACAAGCAAAAAATGATTTGTG
GTTAAAAGGATTGGCTGAGAAGCGTGGCAAATACGAAGTATTAAAATTTGACATAAAATA
TTTTAATTATTTTGATGATGACTGGTTAAAAATATGTGTGTGGCGCGACCCTGTGATAGC
AATATCTTTAAACTTTTTTACAGCTGAGAGTGACGATCAATATAACATAAATATAATTAA
AAAATTTAAGAAGTTTATGGTTGATATCAATGAATACGCAAATGTTATTTGTTATGATGA
TTTTTTAAATCATCTTGGTATAGACAAATATACAGACATTGATATAAAAGTGTGGTGACCAG
AGAAGCTTTAAACTACTCTATAAATTTATGTAAACAATATTTAAATTTGAATTATGACGGT
TTATAATGAATTACTTTAATGTGAATAATTATTTAGAAATGAGAGAATCTTTACACAAAG
AATCAAAAAATTTTGAAGAAATAGAAATTAATATATCACGTAAGTGCAACCGAACTTGTA
CAATATGTCCACACAGTAATGTTGAATATCAAAAATTTTTAAACAATTTTAATAATTTAT
TTATGGATAAATTAATTTTTAAACGTATAGTAGATGAAATATCAAACATAAAAGATTTCA
GTTTTAATATCGATATCATAGGCAGTGGTGAGCCTACATTACACCCTAATTTTTTAGAAT
TTATTGAATATATATTAAAAAAAACTACAAATTATATAAGAATTCAACCAATGGTGATA
AATTACTAAAAGATTTTGATTTTCGTAAAAAATTATACAACTTAATTGAAAATCAAAATG
TAATATTAAACATTTCAGTTTATGATTCTAAACAAGTTGAAAAATATACTGGACTAAAAA
CATTAGAAAATGTTGTAATAAAGGATATGTTTTTAGACAAAAGTATCAATTTAAAGGATA
AGCATATAAACAACCGCGCTGGTAGTGTAGATAATTCATACATAACCAGAGTAAACAAAA
CAACTTGTAACTACCCCTTTTATGCGTTATATGTAGATATCGATGGTGATATACAATATT
GTCCACACGATTGGGAAAAACGTTTAGTGTTTGCTAATATAAAGGATATGAGCTTATTAA
AAGCCTGGTCTATCGAAACTAAACACAGGTCGCTGATGTTAGCTCACAAACGCAGCGAGA
TTTATCCTTGTTATAAATGTTCAGTAGATGGATGTAAAATAGGCAATAAAAAAAGGAAAA
TGTTTGAATAATATACTATTAAATTTAACTTATGAAAAAAATGCTAGAAATAATATGTTA
AAAACAATACATAAGCCTAGACATTATTATAATGAATTACTACATTGTATTGATTGTTGG
CGCAACAATGGTGGATCACTAAAAAACATAGACATATTGGTTTGCACTGACGATACCACA
CTAAAATTACCATTTGATAATATTAAATATTTATATGTTAATTTTGACAACAGCTTATCT
GACTATGGCTTCGTAAATATTTACAAGGCAGGTCAAGCAGCAACTAATAATTATCCAAAT
TTTACACATATACATATAGATTTAGATATGTATGTTTTAAGAGACCCTTCTGAGATATTG
CTTTTTAGAGGAAATACTGCATTAGGTGTATATTCAATTGAGGATGAAAATTATCAAAGA
AAAAAAATATTTGGGACAAGGCTTGCTGAGACTGATCTGATAATAACAAAACCGGGTTCA
AATTTTTATAATCTTTATTTGAAAGAGTTTAATAAAATAGCAAAATATTGAGGGCTCGA
AACACATCCGAGTATGACATAGAAGAATATGTCGCGGATTGGATGTTATTTAAAAATGAA
TATGAAATGATAGAGGAATACGAATATGGTGAAAGTTTCAAATGTAAACCAGCCAACCCC
CTATTTTTACATCATCATAAATATTATAATTAGATTAAATTAAAAGGTCTTTATCAATCA
CACTAAATCGTTTATAATACCCAAAATCCCTAGTGTCATATGTATTAAAATCCTTAGACA
GCGCTAAAAAGGACCTTCAGTATCAAAAATTAAAAAACTACGAAACTTATCAATGAAAT
ATTGTTTTGATTTTTTTATTGTATCGGTGTGTTTATCTATTATGGGTTTGTTCCATAAAC
TGTCTATCACCAACTTGGAATGCTTGTAATTTGCCAGGGTTGAGTGTTATTAAAAGGTT
CTAAATTATTTGTGTTACAAAAACCTACACGTAAACCAGGAAGGCCTAGTGTTTTTGAAG
GGCCATAAATAACAAAAAAACCTTTACTTTTTAATTTTTCTACCATATGCTGAAAATCTG
TAAAATCTCTACATTGGGAGGTATATATAATAACTTAAATCAATTATTTTAATTTTAT
TAGTTAATTCCCAAATATTATATCGTGGAAAATTTAACGTACAACCATTAGGATAAGTCA
```

FIG. 14S. Continuation of (CJLB-12 [organism= Campylobacter phage CJLB-12] complete genome)

```
CATACACCACATCTGCTTGATTAATATTGGTTAATTTCATTTTGAAAAGATTGGCATAGA
CGTCAATCATTTTATAATTGGGTAAATCATAATATATTGATAATCCTCGAAAATAATTGA
ATAAATCTCTTATAATACCATCAGTACCAAAATTAATGTAATCAACCATATAACTCCG
GATTTATATCACTACAATATTGGTAAATATTATAAAAATTAATGTTGACATCATAATCTA
ATATAAATTTAGAAGCCGGTACGTTGTTATCAGTTTTAAACATAATTTGTATGCTCCTTA
TATTTTTCAATATATTTATAATTTTTAGTGGTGTATTTTTTGTTGAAAAATAAATATAT
AAAAGAGTGATAATGGAATTAAGCAAAAGAGATTAAATAAAATAATAAAAATATATAA
TTTAGCAACAAAGCCGTACAGCGACTCCAAATACACAGATGGTTCTAAATCATATTGGTA
TTGTTTGGATATAAAGTTTAGACATTTTGCATTTGCTAAAATATTTAAAATAGAATTAAA
TAATTATGGTGATCAGGAAATCATTTATTTTTTTATAAGGACACCTGCATACGAATTTAT
TAACCCACCTTTAAAAATGTTAGATTTCAAATCGTATCTTTTTAATGCATTGAAAATGAA
TAAAATTGAAATGATTTCAATTGAGGATGTGCAAGATTTGACAAATATTGATGGATATAT
CAATTATAAGGATAAACAAATACATAAGAGGGGTGTTAGAGAGTTTACCAGTTATTGTTA
TATATGTCTGTTAAATAATTTTTTAAAATAACACCTAATACATAAAAATATGGATATATG
TTTGTGAAATAAAGCCAAACAAAGTAATAACTAATTTATCAAATAAAACCAAAGGTTTAA
AAAATGAATATAAATTATGGTTCAATCAAAAAGTTTTTTGGGTTAGATCCAGATGAAATT
GACGTAATCCAAGAAGTAGGTGATATTTTTCAATTTGGTACTCTTTGGATAGCTTTATTT
TTTATAGCTTTATATCCTACGAATATGACAATTACACCTATGGTGTGGCTTTATGTAGCT
GCAGGACAATTATTGGTATCCGCTAGTCTAAAGAAATTAGTTTCTAAATACTTTCCTAAA
TTATCAGTTAGACCCAATGGAGGTAAAGATTCAATGCCTTCGGGTCATACGTGTGCTGCT
TACGCTGGTTTTGGTTGTTTATTTTTTGGTATAAATGAATATAATACAATTTTAATTATA
GCTACTGTGATATTATTAGCTTTAGCTGTTTTTACTGGATTTTCGAGAATAGCTGCGAAA
AAACATCATTTTAGAGATGTTTGTGCGGGTGCTGCTATAGGTTTAATAAGTTCTTGGATT
ATTATTAATATATATAATATTAAAAAAAGGAGAATAGCTAACTTTAAAGAATTTT
TATTGCTGCAAGAGTCTTTGACTAAAAAGACTAATTATATTAAGCTCGGTGAGAAATACA
TTAATATGTTTAATCAAGTTCTGGATGCAAAGAAATATCTGCAAATATCTCTTTTTAATG
TAGATAATAAACAATACTATTGCATCCTAATAATGAAGGATTCAAAGTTGGAACCACATT
TTGGAGTCTTTTATGAAAATAAATTCAATGAGTTGGTAGAAGCTTTTAAAAATAAAGACA
CGAAGAGAATCAGTGATTTAGTGAATAGTGAGCTTTTTATTCAAAAGATGGTTATCTAA
ATTCTGATGTAAATTTTCTAAAGTATTATCATATGTGTTTTCAGTTTTAGTGGATTACC
TGGCAATAAAGCCGATAGGATTTGTAAAAATTATGGGAATACCGAGAAAGTTCAATCTTT
ATCAAAAGGTAGTAAAAAATATCATCCAAAAAAATGAGATACCCATATCATATTGTAGTAG
AAGAGCAAGATGATAGCTATTCTGGTAAAATTACTGGGCAAACAAACCCTGCCAAGTCAA
TGATTTTAAAGTATAATTTTGCTTAGTGTGAACAAAATGCTAAAATATGCTAAAATCTAC
TAAAACTTCAGTTTAATTTAAGATTATTATTATATAATTATATTGATAAAAACAAAGGAG
ATAAAATGTACGTTGCTAGATTTAATGAGTATTTTGGTTATGACTACCAATTAATGGATG
TTGAAACAGTTGATATTTTAGAAAATATCTACGATAGTTTAGGATATATGCCTAGAGACC
CAGAACCAATTGATTTAGAAATTGTTTTAGAAGAATTCTATAATACAGATAAAATCTATG
TTTTATGTGAAGCTGATGATGAAGAAATTGAATTTTGTTCTTGTATTGATGAAGTAGAAC
CAGAAGTTATCATAGATTTTTTGAAATCCAAGGGTCATACTTTTATGGATTCAAATGCTT
GATTGCGTTTTAAAACCCACAAAATAAATAATCACAAAAAGAGAGATTATGGACTACTTA
AACCCGGGATATGAAGCTCCTAAAAAAGGTAATATTAAAATTACATTAGCATCTTTGGTA
GATAGCTTTCAAGAATTTTTAACAAAACGTAATTATTTTTTATATAATATAACAACTAAA
ACTCAAATAAATGATATCAAACAAACGAAAGTTTATAGTGATTTGCACGAACAGTTGAGA
TCTATAACTTATAGTCATTTTTATGACGATTATACTTTTTATGCTAAAGATACTTTTGAT
ATTGAGCGTGTTAAATTAATTTTTATGACTTGTTATTTAGATTTACTTGAAGAAAATGAT
ATTGATTTATCTAATAATGAATTAGTTACAAATAACGACGTCAACATCGAACATTTTGAT
TTAGCTTATAAATGGTGCGATTTCAATACTGAATTGATAAGAACAAAAGCATACGAAATG
GGTATATTTAAATCTTAAGCTAAAGGTTCTAAATGGATGAAATCAATTATGATGTATTAG
AATATATCATTCAAGATCATTTAAATTGTTCTTTGACTCGTGAAAAATCTGTATTAGATT
ACTTGAATTTAGAAGCAACTAAAAGAAACCAAAAAATCACGGGTGAGACTGAATCATTTG
TAGTCTACAAATTCAAACCATATATGTTAAGTGATGATATTTTAAAACCTTTTATTCTGT
GTACAAATAAAAATAATAAAGGTTCTTAATGATTTATAATATCGACAAATACGATATAAA
ACTCTACAATGAATTTTGAATAATTTATCTAAACATAACGTAGATTACACAGAATACGT
GTGTACAAGAGATAATAAGTTCTATTTATCAACTCAATTAGAGCCTTTTATTCTGGATTA
TATCCCTATTCAAAATGCTTCTAAAATGTTTTTGATATCTAAAACAAAGGAGTTAATAA
CCAAGATGTATACCAATATAGAAGACAAAAGTGACAGCTTCTAAAGATAATTTAAAATT
ATGCATTAATGATGCTTATCAATATTTCATAGATTTAAATCAAAAACAAAAAAATTCTAT
ATTTTACTTTGTTAATATATCGAATAAAGAACGTGCCGAAGCTTTATCTAAACAACTAGG
TAGGCTTTATTATTTTGGGTTTTATTATAATAAGTACAGAGTTTATTTGACCAATAATCA
ATACACAACAAATTACATAGATTCTGAAAATATTTTAGTAAGTTCTAATGATTTGTTTGA
TGCTGAGATGCAATTGAATTATAATATATTTAGATTGCAGGATAGACTTAAAAAATTTAG
TCAAACACCCTATAGAGAAAATGGTACTACAGTGTTACCAAAATATATAGATCCATTTTT
TAGAACTCAGGTTAAAGTTCAAACTAATTCAAATGCTAAAAATTAAAACTTTAAATATAA
TATATAATATAAAATTTAAAACACAAACATTCAAAGGAGACAAAATGTCTAAAGAATCGA
GATATACAAAAGTTAAAAAAGCACCAAAAATGATTTCAGATGAAGACTTTGCTGAATTCT
```

FIG. 14T. Continuation of (CJLB-12 [organism= Campylobacter phage CJLB-12] complete genome)

```
TCCAAGCAGCTATAGATTCTAATCTTAATGAAGATTTTAAAAGACCACTCATAGAATCTA
AATATAAACTTAAATCTAATATTTTATACTTAACAGATGCTTGCAATTTTGATTGTGATT
ATTGTTATCAAAAAAATGATAGAGATCGTTTAATAAAAACACGTATATCTCTGAAAGAG
AAATTAATGATTTTTTTAAAGATCTTATTAAGAGAGAACCAGATAAGCCTAGCACTGTAG
TTATATTTGGGGGAGAACCATTTTTAAACCCAGATATTGTTTATTATATTTTTGATTTAA
CTGATAAAATAACATTTCATACCAAGAAGAAATTCAATCTATCATTAACTACAAATGGTG
CATATTTTAAAAATACTAAAAATGCTGATTATTTTATAGAAAGACCCGCAAATTATTAA
ACCATTTTCTTTGGAAATATCTTATGATTTATCAGGGAACTCCAGAAGAGTTTACAGAA
ATGGTAAAGATTCTACAAAAGATACTGAGTTTGTTTTAAGTTATTTTAAATCTAAAGACT
ATAAATTAACTATCCGTTACACTGTACATAAATTAAATTATATGAATGCTTTAAAAGATT
TAATAACATTAAGTTTAGATTCTAATTATAAAAAAATTGTAGTTAATTTCTATGAAACTG
AATTAGAACAATATATAAATGTATCTGAGTTTAAAGAAACCCTGAAAAGGCAAACTTGTG
AAGTGTTTAAAAGAACTAAAATGCCTATTTGTCATTTAAATTGTTTGGCTTGTATGGGTT
GTAATTTTGCAGATTTTGATGGTATATATTACCAATATAATGATAAATCATTTGAAGTGC
AAGAAAATGCAAAGATATTTGAATCTTTTACAGAACATTCTTGATTTAGCTTTTGGTTCA
CAATAAATAAACTAAAAGTATGAACTAATGAAATTATCTGAATTAATACTTATTTTAGAA
GGTGGCAATACCACAACAATCAATAAAAAAACGGGTGAATCTAAAAGTGCTGAAAAAATA
GATTTTAATAGATTGTCAATAGAATCTTTTAGAGCTGAATTCATAGATTTATTCACAAGT
CTTAATAGATTGTTTTTAAACAAATACAAAGAAAAACTTTGGGCTAATGATTCTTTGATT
AAAAAAGGTCTTGTTTTTAATGGTTCCACGAGTTATATTATGAACCCTAAAATGGATCCA
AAAGAAATCTTTAAATATAAACAAAGTTCCGGTGATATTGATATTGTTATACCTGCTGAA
CACCAAGAAAAACTATGGGATTTATTAGATTCTTTAGAAGGTAAAACAATAGGTAATTTT
GAATATCACGGATGCTTTTCACAAAATCGTGAAAAATTAGGAGATCAATTATTAACAATA
TTCGTGTATAAACCCGAAAACATAGCTTGCCAAATAGATTTTGAAAATGCCGACTTTAAA
GATGGAAAACCAACGGAATTTGCGAGATTTAGTCACGGTTCAAGTTTCGAGGATGCCAAA
GAATCTATAAAAGCATTTGCACATAAGTTATTATTAAGAGCGTTAGTAGGAGCTATTTCA
GCAAATCCAAATATAGTTGTAGCTACTAAGAGTTCTAAACCAGGCAATATCAAATTAAAA
GCAGATAAAAGCACACCTAGAATGGCTCAATTCAGTGTTACCCGGGGTTTGAGATTTGGT
TTGGTTCCTATGTTAGATAAAGGTGAACCCGTTTATTACGAAGGTAAACAAGTATATCAA
GAACAAGATACTAGTGATTCAGAATTTATAACAGATTTAAAAGAAATATTTAAATATATG
TTTAAATCAAACGTGGGAATAAAAGATTTGCATAGTTTTATTGGTGTTGTTAAATTAATG
AAAAAATACTGCGATGAAAAAACTATTAAATTAACACAAGAAAGATTCTTTGATATCATT
TTTGGAATGCCAGCACAATTCATAGAGCCAAATGATTTGAAATTAGATAGACAAGTTAAA
TTAACTGCTTATAATTATTTCTTAAAAGAATTACGTTTAAGCATCCAGGATTAGAAGCA
GATATAGATAGATATTATGTTGTTAAAGGTTCTAAAGCTAAAGCTAAAGCTTAAAAGCTT
GAACTAAAATAGCTTGACTCAGCAATAAATATACAAAAAGTAGGGTTAAATGGCTGAAAT
AAAAACTGGTATTTTATTAAGACGTAATCTTAAAAAACATTTTGTAAATGACGCAAAACC
AACACAAGGTGAAATCGTTCTTGCTATCGATACAAATGAAATTGGTATGCTTGTAAATGA
TGAAATACAATGGACTCCTATCCAAGGTGTTGTTAACACGGTTGCGGGTAAACAAGGTGA
CGTTGAATTAAACAAAAAAGACGTAGGTCTTGAAAACGTTGATAACACTGCTGACATTGA
CAAGCCAATTTCTAATTCTACAAAATTAGAATTTCAAAGACATTATACAGCTGAAAACCC
ACACAATATAACAAAGAAAACGCTTGGTTTAGAAAACGTTGATAACACTGCCGACATCGA
CAAGCCAATTTCTAACTTGACTCAAATTGAGTTAAATAAGAAAATTTCTTGGGATGATGC
TAGAAAGCAAGCCGGTGGGAAAGACCCAGTTTTTACAGATACTACTTATACTATTAAAGA
TGGTGAACTTTCAGAATTTAACTTTAATTCATATTATAAGAATTTCATAGATACTTTTAA
TACTAATTCCAGAGTTTTACCAAGCACACAAGCTCTTACTGCCAATGGTAGAATAATAAC
CTTAAGAAGAGCTGACGGCTCGAGTGAAAGCATAGAAACGCAAGATACTTTATATGATGA
TTCTGAACTTAGAGCATTAATTGAACAAGCTAAAATAGATTTACATATAAACATACAAGA
TAATTTAGAATCAGATTCTACTAAAGATGCTTTAAGTGCTAATCAAGGTAAAGTTCTTAA
AGGTATAATAGACGAAATAAAGAAAGTAATTAATATTACAGATGATGATTTTAAAAATCT
TCAAGATATTATTAATTATATAGAAGAAATCGCGAAAAATTTGATGATTTAACAATTGC
TAATATCAAAGGCTTGCAAGCTGCTTTAGATTCTAAATTAAATAGGGATGATTCTACATA
TGTTGCACCCAAATTCAGCATTATTAGAATCACACCCAGCTAGTGATTTTGTATTAAATAC
AAATTATAATGCTAAGTTAATAGAAATACAAGATTCTTTAAATTCTATTAATTCACAAAT
TAAATTATTTGAAACGCAATCAGGTGTAGATTCTAAAATAAACCAAGCAATCAGAGATTT
AAATTTCACTGAAACTATACAGAGTATTAATGAACAAATCGCAAGATTACAAGGCTCTTT
AGATGGTATTGATTTGGATGCTATAACAGAAAATCTCCAAAAAGTTCAACAAGATTTAAC
AAGCAAGATAGAACAATTAGAAACCAATACATCTAAAAAATAGAAGAATTTGAAGTTAT
TATTAATAATTTTGATATGTCTGAAATACAAACTAATATTAATAATTTTAAAGATCAAAT
TACTCAAAATATCAATAGTATACAAGGTGTTGTTGATTCTGTTTCTGAATCATTATCAAA
CGTTGAAAATAATGTTCAAACCAGTTTAGAAAACAAAGTTTCAAAGGATGAGTTAGCTGC
TGAGGTTAAAACTATTAATGATAACATTACTCGCTTATCAAGCATAGCAAATGAAGCAAA
ATGGCAAGATAATTTTATAGTAAAGTTGAAAGAAAACGACAATCTTTATGGTCAATTAT
ATCAATTTCAAAAGACTTTTTCAAAGGTTCATATAAAAAACCAAATACTTATAATTACTG
GGAAGCAAAATATAAAAATCTTAAGTATATCAATGATAATTTTGATAGCTTAGAAACAAT
ATCTAATGCACCTACATACGACGTTGTTACTAATCAGGTTATTAAATTAACTTTTAGTGA
```

FIG. 14U. Continuation of (CJLB-12 [organism= Campylobacter phage CJLB-12] complete genome)

```
TATTGCGGAAGCATCATTTTTAATTGGAAGTCCTAAGAATAAAATTCAAATAGCTAAAAT
TATAGCAGTAAATGCTAATACTAAAAAAGCTGTGTTTATATATGGGTACCCAAGTTTTAT
GACCGACGATTTGTCAAAAATTATGGTAACTATAGAAAAAGATTCAAGTTTTGGTAATTA
TCTATCAAGAGCTAATAAAACAGATCCAGAAACTTTTCAAAAAATTGTAACCACGCAAGA
ATTTGATTTACCTGACGATACTGATGATTATTCATATTTTGAAGCTAGTTATGAAATATC
TGGAAATATAATAACATTGACTATGCCAGAAACTGTATTTTTAGAATTCTATGGTAATAT
GACAGCAGTAGAAACGACTGTTACAGGTTCTGGTACTTCTCAAGTTTGGTCATCAACTTT
AAAATCTACAGATTATGAAGGTAATAAGCTATTCTCAAATGGTGTGTTGATAGGAAAAGA
TTTAACCGGAGAAATCTTAACTATATATGATAATAAATCTACATACATAAATACCTTGGG
TGAAGCTAGAACCAATTATAATGATTTTCAAATAATACGCGAAGAATACGAAGATATTAT
GTATACAAGGGATTTTTTACCAGGAACTATAGGACCAGGGGATGATGAGTTAGAATGGTA
ATAACTTTTAAACTTTAATTTAAACATTAAAAGCTCTAAGATTTAAGATTTTATCTTAAA
TAAATTTAAACTTTAATTTAAACATTAAAAGCTCTAAGATTTAAGAATTATTTAAGTAAA
AATATAATATAATTAATATAATTAAAACAAAAAGGAATTATATGTTAGAATTAAGCAAT
TTTCTTAGATCACCATTCTTAGATATGCCTAGCATATCATTTAATAACAAAAATCTTCAA
GATTTATTAAAAAATGTTTCAGAAACAATGGAAACATATCCATCATCAGTTACTTCGTAT
TTAACAACTGAAACTAGTTCGGGAATTGATGTTGTTATTGGCTCCAGGAGTTCAAGAA
GATGGTTCTAAAACAATTGAATTAGACTTTAAACCTGATGAAATTGTAGTTAGATATAAA
GTTATAGATGATGCTAAATCATTTTTTATAACTGGTTATAATACAATCAGAGTTAGTTTG
GATTCTGTTAATAACTTTAAACTTAAACAAAATTCATTTAAAGCTAGAAATGGCATTATA
ACCTTTTCGTTAGAATCTATTAAAGAAACTAAAAATACATACACATTCTAATAACTTAAG
CCTTTGGGTAAATACTAAAGGCTTATTAACCACAATTCATAAATAAATATACAAAAAGCA
AGGATTGTGATGGCTTTTACACACAAAAATCAAAAAACCTTTTATACTGATTATGCTATT
AACACGGTATGGTACCTACTGAAGATACTATAAATCTATTTCAAGTTCGTCTTAAAAAA
GAGACAACTGATATCTACAATAAATTTCAAATAGTAAACGGAAAATCACCACTCGAGTGG
AATCAATCTGAAAACTATGAGGTTAATGAAATTGTAAGATATAATGAAGTAGATTATAAA
TGTGTGCAAGAATGTGTTAATAAAGTTCCTAGTGAGGAACCTAGTTTTTGGGTCGTTACA
AAATATCAAGAATACTGAATTCCTGCCAGTAATTACCTAGCTAAAGATAATCAAGAT
CCTTATGATCCTAGTTCAATACAAGATTATGAAGAATCTAATACTTTTCACCCAACAACC
GTTAAACACGTTGAAGATCGTCTAAAACATTGGTTTGATAATGAAACTGTTACAAATGCT
GATAGACTTGATGGTGAACACAAAGATTATTTCTGCTCTAAACAAGAGTTTGATGATTTT
GTTAGAATAGCATTGACTGAAGAATCTGTCGTTGATAGTTTAGAATCTGATAATCGCAGA
TTACCGTTAAGCGCTTACCAAGGTAAGGTTCTTAAAGGATTAATAGATCATATTAACACA
ATTTTAACTTCAAATGACATAAACTTAGATGAACTTCAGGAAATTGTTAACTGGATTAAA
ACAAATAGAGATATGATTGAATCTTTGGGTATTGATTCTATTAAAGGATTAAGAGATTAT
TTAAATCGCATAGATTCTGATCTGAAAAAAGAGTTACTTACGATTATTGGAATGCTGAA
TTTCTCAATAAAATTAAAGAAGTGGATGGGCATTTATCTGGAGTTGATGCTGATACATTA
GATGGTCAACACGCAGGTTATTTCTTACCAGCAAGTAGATTTACACCAGAAGAAATTGCT
TTATTACTTCAAAAAGTACCAGGATCTTTGGGTAAAATAGATGCTGATAAATTAGATGGA
TTAGATTCTAAAGATTTCTTGAGACGTTCAACCAGTGATACCCCTACTCAAGATAATAAA
TTTAGTTTAGGATCTACAGCTTTAAGATGGTCTAATATATATGCTGTTAATTTTCAAGGA
ACTGCTTTGCGAGCTAAATATGCTGACTTAGCTGAGTATTATGAAGTTCCAGAATCTATT
AAATCGAATATAAAGCAGGTCATATATTAGGCATAGATGCTTGTGGTGTAAATTTATTT
AACCCAGGTATGAAATTATTTGGTGTTGTTTCAAAAAATCCTGGTGTAATTCTGAATAAT
GAATGTGATGGTGTTCCAATTGCATTGAAAGGTAGAACTCCAGTTTATTGCAAAAATAAA
CCTAGTATAGGTGATTATATCTATGCTGATTCTAATGGGTTGGGTATTGCAAGTGAAACT
GAATTAGATTTACCATTAGTGGGTATTTGTATAGGTTCTATAATAAATTATAAAGATTTT
TGGATTTGCGAGATCAAAATCTAATATCAAACGTAAGGAGTATTATAATGAAATTAATTA
TTTAATTACTAAAAACTCGAGTTTAATTTTTTTTAAACTCGAGTTTTTAATTCTTATAT
ATAATATTATATTTTAAATTTAAATTTTTAAGTTTTAAATTTCGGGTAATAATATGCAGC
GAGTTCCAAATTCAACACCTTGTGTATCTTTTTGGAATTGAACACTTGAATAAAAACTAT
CTTTAAAACTTGAACCTACTATAGGAAATGTTAAAGTATCTTTATACGTTGGATTTCCTC
TCCATTGAAAAGTTTGTCTTGTGGTGTCTACGGTAGCATCTTGTAAAACACTCCATTTTG
GAATACCGCAAGAATCTATTTTATACTCAGAAGTTGTTCTTACATTTGTGTTATTGTACT
TGGCACCAACATCCTTAAAATAACCTAATGGGCTATCAGAGTCACTGTTTATATAAGTTA
TAATCTCTGCTGGTAATGTAGTTTCATCATAATTATTAGTATCTACTAAAGATTCTAAAT
CTAAATCTGTTATATTAGTGCTTTCTTTGATAACACCAAAATAACTTCTATCTAATATAT
AACCATACATAGCGCCTATAGCCAGATTAAATAACCCGCCTACTAAATCAACAACCCCGC
ACGCGTGACCATTATGACTAATTTTACCCATTTTAGAATCTGAAACACTACCTGTTCTAT
ACAACGCGTTAGTACCATCCGTATACCCAGCAGTTTTATAATCTAAATTATGAATAGCTT
GAATATCTCTTTGCACACTTTGCATAGTATTCATACCTTGAATAAATGCAAATCTATCTG
TTCTTGATTTAGCAAACTCAATATTATTGAAATTATTTGTATTATAAGCATTTTGATATA
TACATTTAGACAACAAAATCAAATAATTATAAGCAAATATAGTTAATACTTGAAATTCAG
GGCCTCTATTTTTAACAGCTTCTAAGAAGCTTGAATTCTATTCTTAATAGATTTTAAAT
CATCAGAATCTAAATCAGAATCTTCTGTAATTTTATTACCCAAAGCAACCTTTGCAGAAA
CTCCTGAGATTAAAGCTACAGAGTTAAATTTAGAATCACAGGTTAAAGGCACTGTATTAC
```

FIG. 14V. Continuation of (CJLB-12 [organism= Campylobacter phage CJLB-12] complete genome)

```
GCCTAGAACCTAAAATACCCCCTTGGTTAGATGCTAGATATTTGTCTATAAAAAACCTG
GAATTTCTTTACCATTATTAATAAATGCTCTATGGCACCAAAAACCTTCTTCTTGAGTAG
CGGAAACTTCAACTTTTAATCCGCAATATGGTGCAGCGTCTACATTTGAAGTCTTAATAT
AAAGTTTAGGTATCCAAACCATAACATTACCGTGGATATCAGTATAATTTCCATAATTCA
TATGACCAGGAGTAAAAGTTCCTAGCATAGGATACATATTATATTTGTTAGTAATTTCTT
TAGGTGCAATACCCACTCCAAAACCAATATCACCAAGATTTGGATTACTTGGAAGTGCAC
CAGCAACTTCTCCGTTTCCGTTATCCAGCGATTTTTATTTTTGTTTTATCTATACAAG
TCCAAATAACTCCAGTAGCTGTATTTAAAAAAGTTGCACTATCGATTGTAGGATTTATAG
AAGCTGTGGGATCATTTGATTGCTTATAGTTTATAGAATAATTATCAACTTGTGTATGCA
AAGCTTTAACATCTTCTTTAACCGGATCTAATTTTTGATCTATTAAGAAATTAGCGGTAT
TGGTATCTATAGAATTTTTAATTTTTTCATAATTATCTTTAAGTTCATTTATGGCTCCTA
CTGCTGTAGTTTTTGCTTCGGTTTTAATGTTGTTACATCACCAATAGTATTGACTTTTT
TGGTTAAATCTTTTTGCGTGTAAGCACCAAGAGCTAAATCTCTCATTACGAACCTTTTAT
GTTATTTATTTGAATCTATATAAGAAGCCTTTAAGATATTTTATAATATAATATCCCAAA
GGATAAAAATGAAAGGTAAAAATTTTAGCTTAAACTCAAATAAACGTAATAAAAATGACT
ATTACCAAACACCTTATAGTATGACTAAACAATTATTAGAAGTTGAAAATTTCGAAGGAA
GTATACTAGAACCTTCTTGTGGTGCTGGAGCAATAGTCAAAGTTCTAAAAGATTATAATA
AATCTGTAGATTATTGTGATTTAAACAATGATTTTAGTTTAACAGGTATCTTCAAAGATT
TCAAAGATTTCATTAATGATGATTTTGATAGATATGATAATATTATAACAAATCCGCCAT
TTAGTTTAGCAAAGAATTTATATTAAAAGCTAAACAAATAGCAAATAATAAAATTGCAA
TGTTATTACCATTGAATTATTTACACGGGGTTTCAAGATATAATGAAATATACAAGGATA
CTGATTTTCCATTAAAAACTGTTTATGTTTTTTGTAGATATGGTTTACTTGAAGATACTA
TTAGAGAAGATGGAACTTATAAAGCTGGTATGATGGTATATGCTTGGTATATTTGGGATA
AATCTTATAAAGGAGAACCTATAATAAGATGGCTAAATAACAACGATTATATAGTCAAAT
CAAATAAAGGATCTTAATGGCTAAGTTCGTTACTCCCGCAGGGAATTTACTTAATTCTTT
AAATTCTAAGAACCTTAGAAATGTTCAAAATTATAGCCAAACGATAGTTTGGTCTTTTGA
AACTAATGAAGAGTTTATATCTGCTAGAATAGTTGATGAAGGTGTAGAACACGTCCCTAA
AGGCCTAAAGAAAACTTGGACACCCACTTCTTTAACTCTTTCTGGTCTGCCAGATGATGT
TGATTTGTATCATCCAAAAATGATCACATATCTTTGGAGTGGCTTTAAGTTAGATGGAAC
TGAATTTAAGGATACTAATTATGAAGAAAAAGCTACTATAGAAGATATTAAAAATCAAGA
TATGCACTATACTGGCAAATCCTGGGGAACTAAAGGTATTGCTGGATATTATAGGGATAA
TAATATACTAACATTTCCTTTTACTGTAGAAGTTACTTATTGGGAATATTCTAATTCGGG
TTCAAACTCAAGTTCTGGCTCTAAAAATACTCGTGAATCTGGTTCTGGTGGACTTAAGGT
TCAAAGAACTATAGCTCAAAATTATTATATTACAGTAGTTCCTAATATGGATCCAGCATT
ATTTTGTAAAAAATATGGCGATGCTCACGGATTTAAAGGGCCTAAAGGTGAAGACTTTAA
TTATGATCAATATAAAGCTTATATGGTTTCTTTAGGCTTAGATTTCTTAACTATAGATAG
AACCCAAGCCACTTAATATATTGAAATATACTTAAATATCACTTTAAATCTAAAATCGAT
TTAAGCCGATTTTTGAGCCTCTATACATATATTTAAATATTACTAAAAATACGCAAAAAT
ATCTGAAACTTCAATTTAATTTAAGATTATTATTATATAATTATATAAATTAAAAAGGAG
ATTCAGATGTTACAAGACAAAGTTTTAAAAAATTACAGGGATTCTTTAAATCAAAGATTA
TCAATCTTGATCAAAGACCCAGAAAGTAACAAAGATATCATATCTGATATTAAAGTTGAA
ATAAAAAAGATCAATAATATATTAAACAGATCTTACAACCGCGGTTAATTCAAACAAGAC
TAGTAATGGTTAGACAAAGGAAATATAATGGTAGATTTAAAAATTTTTAACAGTAAAC
AAAGTTTATATCGATAAATCAGATATAAAACCATCGCAAAGAAATGTAAACTCAGTTCTT
TATAAGTTGCTTTTAAAAGGTTATAAACCAAGCCAGACATTTGTTAGAAGCTATTAATAAT
GCTTCAGATTCTGATCTTAAATCATTTGAAGAATCTATAGTATTAGCTGCAGGCACAACA
TTCTATAAAAAATATACTCATAAATTAAGAGATATTTCAGATTATGAAGATCAATTCTAT
CACTATGTCTTAAGATATATTTTTAACTTAGATACTCACGATTATACTCTAAGTATTAAT
TTTAGTGATCTAATACCAAACAAAGAACTAGTTGAATTAGATTTAATACAAGAATCTGAA
ATTGAAAAAATTACAAAAAACATCCTAGAATCTCAATTCAATCCTACGGATAATGAAAAA
GATATCATAATAAAATATGGTTTTAAATATATGCCAAGTAAGATTCCAAATAAGTTAGCT
TTAGAAACTTTGATTTCTAATTTAAATCCTAGTGAAGCTCTGGAATTCTCTAAAAAATAC
AAACCAGAAAATGTTAATGCGGTCAGAACTATTACTAAATGCTTAATTAAATCTGAATAC
GATTTAGATATAGACAAATTAGATAGAATTTACACAAAAGAATTCAATTTACCTAGATAT
ATTAAAACTTTTGTTATGAATTCTATTAATGAATTAAAATTGGATCGTGAAACTATATTA
AATGAAATGTTAATATACAAGAAATTCTGGCAAAATATACAGTATTTAATTGTTACAACA
CAAAAAAGATATAAAAATCTAATAGTTGCAAACTATGTTTTTAACAAAATATTAAAAAGA
GATTATAAACAAACGGGTACTTATAGAATCAGAACTTTACTAAATAACCCAGTAAAATTT
AATAATGCTTTTATTGAAATTTATAAGTATAATATAAATTTAGCTTTATAAAAATGTTTT
AATTTAGCAGCTAAAACTAATAACAATGATTTTAGTATTTTGTTGTATCATAGACCCTAAA
ACACTCAAACAATTATTGGATTTAGTTCTTAATTATAAAAGAACTGGTAAAGTTCGTATG
TCTAATATCAAAGGAAATATTTATATTTTGATGAAGCTAAAAAACCAAGCGGTAATCTT
TGGGAAGTCTTAAGTAAATTATTTTCAATTTTATTACAATCTAAAAAGATTTAATTGAT
TTTGGCTCAGCTAAAAGAATAGCAATTTCTGATGATTTAGAAACTATGGTTCCTCCAATT
AAACCTAAAGATTCTTTAAAAACTGATATATTCTTTCCAAAAGGATCCAGCCTTAGAATA
GATTCTAAATTTCAAGTATTCGTTGCTTGGAAAAGGAAGGATAATTCTAAAGGTTGGTTA
```

FIG. 14W. Continuation of (CJLB-12 [organism= Campylobacter phage CJLB-12] complete genome)

```
GACTTAGATTTATCTTGTTTATTCAGAGATAGTTCAGGTTCACTAAAGAATGTTTTGGAT
TATACAAAACTTGAAACTAGCATAGATGGTAAGATTCAAATACACTCTGGTGATTGGGCC
AGTTCAAGAAGTTTTGATCCTAAAAATCCATTAATTACAGCAGAGTTTTGTACTTTGACT
TTAGATCCTAAATCAGATTTAGAAGTATATGTAAATGTTCATAGTTACAACAAAGTTTCA
CTCAGTGAATATGATGTAATTGTTGGTGTTCTACCAGGTGATACTAAAAATAATGATGGT
GTTATAAATCTCCAAGATGCTATTTTTCAATTCAATGTTGATGTAGATTTCAAAGATATG
TGTGCGTTTAGAATTCAAAATGGTTTTCTACAAGTTATTGGTGAACCATTTAATATGAGA
GGTTCTCACTCAGGAGGTTATGGTTTTAATCAAATTGCTCCAATATATGATTATTATAAA
GTTTATAATCAAATGAGTTTAAAAAGATTATTTGAATTAATTGTAATTCATAAAGGTTTA
AAACTTGTGGATATCAACGACAATCCAGATTTAGTAGTTAGTTCTAAACTAAGTTCTAAA
CAAGTTCTAAATACAGCTCTGAATATAAAGTTTATAATGTAAGTGAAAACGCAAACGAAC
TCAAAGAGTTAATGGTAAAAGATTAACTCTTTGATTCTATTAAGTTTGATTCTGGATTTA
TAGGTTCTACCATTGGCTCAATTGGAATAGGTACTGCTGGTTCATTTGGTATACTAGGAG
TGTTATCATTAGCATTAGAATCAAACTCTAAAGATTCTACACCTCTTGGGTCTATATAAT
ATACTTTAAAATGTCTATCATTTTTAACTGCTTCATTTAAAACATTAATCAAATCTTTAT
TATTTTCTATTCTATCGTCTATCCCATTTTTATTAATATCTTTTTCTGGTGCAAACTTAC
TAGCTTGATAAACAATTTTTTGACCAGAAACATATAAGATTATCGACCCACCAAAAGATA
CTAACAAAGGTTCTAATCCTAGATTTGCATCAAAAAATCTATTAAGAATTAAAGCCAAAG
AACATATAAAAAGTTCTGTATTATAATATGTCTATTTCTTTCTGGGTTACCATAATTAG
CAGAATCTTTAGTTCCTTTAAAAGTGGCAATAACAGAAGTTGTTCTGTCGACACCCACAT
ATACACAACATAGGGTAGCATATAGTGTGGTTAGTGTTTCCATTGGGACTTGAAAGTTTT
TATTAAAGATACCCGAACCTGGTATATAATAATCTATGATATAATCTAAGCATTGAAATA
TTAAACAAACTGCTGTGAATATACCAAAGAATATAACATAACCAGCAGTGCCTTTAATAT
TTTTATGTAATTTATTAGTAAAATAATCAGATTTAATTTCTTTTGCTGTATACGTAGATT
CGTTAGTTTCTTTATTTAAATACATATGAACCTTTTATATTATTTTATGTCGTTTTAGAGT
TTAAGTTTATATTAAGTTTCAGATATAATACTATAGTATATACTACTAAATAAGCCAAGC
ATTTTTTATACTTTTTAATATTAGTTTAAGCTTTGCTTTAAGTTTTAAGCATATACTAGG
ATATATAGTATAGTATATACTACTAAAAAGCCAAGCATTTTTTATACTTTTTAATATTGC
TTTAAGTTTTAAGCATATGCTAGGATATATAGCATTGTTATATACTACTAAAAAGCCAAG
CATTTTTTATACTTTTTAATATTGCTTTAAGTTTTAAGCATATGCTAGGATATATAGCAT
TGTTATATACTACTAAAAAGCCAAGCATTTTTTATACTTTTTAATATTGCTTTAAGTTTT
AAGCATATGCTAGGATATATAGCATTGTTATATACTACTAAAAAGCCAAGCATTTTTTAT
ACTTTTTAATATTGCTTTAAGATTTAATTATGATAGCTGTATTAGTATATAAATAAACTA
AAAGAGGAACTATGCAAAAATATGTAGCTATTGCTTTCATTATTGTTGCTATGCTAGGAT
ATATAGGATGGCTTAAATATGATAATGCTCAATTACAAACAACTATTTCGAGCTTAGAAG
CCAAAAACAAAGGTTTAGAAACTTCTCTAAATATCCAGGTTAATTTAAATAAAATACAAG
ACCAAAAGAATCGAGAACTTGTTAACAACATTAAAGAACTTGAAAATAAACCTATTAAAA
CTGAAACAAAATATGTAACAGTCAAGGATTGTAAAGTTCAAATATCTAAAGTAGACACCA
ATATTACCTCAGCTAAAGGTATACCTTTATTTTTAGGAAATATAGGTAAAACTCAAATAT
CTAACCAAAAATAAGGAATCTTTATGAAGTTTAAAAAGTTTTTATTGGCCTTAATACCTT
TTATTTTTATAGGCTGTACCACTGTTAGAACTGAGTTTGTATACCCAAAAATACCGGATA
TTAAAGAACCGCCTATAACACAAGATTATAATCTAACTGTAATAAAAATAAATAACATAG
AATATTATTCGTTGAGTGCTGAAGATGCTAAGATTTTGTCAGAGAACTGGATCAAGTTTA
AATCCTGGGCTGAGACGAATTATGAATTATTAAAAATAATTAAAAATAAGGACTTAAAAT
GAGTTTCAAAGACACATTATTAAACCTAGTTTATGAGAATTCTAGCTGTGAAGTGCTGGA
TCTGGATTATAAAGACCCTGAAATCAAAGAAACTGATTCTGGTGATATAGATACAACACC
TACCACTAAAGCAGATATTGTTAAACGCAAAGATTCTAAAATCGATGAAGATGATTCTGG
CGATGATTCAGAGCTTGAACCACTATCAAAGGAAGAATTCGACGATATAATTAATTCTTT
AGATCCAGATACGATTGCATTAATTATAAGTATTCTTAACGATAATGGATATATAGTTGC
TTCCAAAGAAGAAATTTTATCAGCAGAAGATTTTGAAGATATTGGCTATCTTGTTTTAGA
AGTTCTCGAAGAAATTTCTGAGTATGAAGCTAACAATTATGAACAATATGGTGCAACTCC
AGTAGATGAATCATTTGATGATGCTGAAGTTCTTAAAGAAGCTGCTATGATTTTAGAAGC
TAATGATTTAAGTGATTTAAGTGAACAATTAGTAGATATTGCACATACTAAACAATTAAG
ACGTGATAGAAAAGATCAGCTTGGAAAAGATCAGCAGTTTTAAGAGCAAGATTTAGAAA
AACTGGTGAAGGTAGAAGAGAACGCAAAAAAGCGCTTAAATACCTTAAAAAAATATAGAAG
ACAACATAAAGCTCGTATGAAGAGATATTCACAAAAATATACACAAGTTTGGAAAGGTAA
TACTAAAAACTAATGATATTTGTGAAGATTTAGAACCAATATATGAGGTGGTAAAAAAG
CTACCTCTTTATAAACAGAGAGCTAAGGAAGAAGTGTTTTTAGGTATTTTAAAATCAAAA
TCTAAGAAATGGGTCGGATGGAAATACCTAAAAGAACTTAAAAAAGATAAAAGCTTTGAC
GACAGCGCTATTTTTATTGAGCTTTATGAGCTTGCATTAAATTACTACTGGATTAAATCT
CAAAACGACTCTATCAAATACGATAACTTAATAAAAAACTATAAATTTTAAATTTATTAA
TATTCTAATTTAATATTAAAGAGTTTGAAATTTTTAAAAAATTTTACCCTTTAATATGA
TATTATAATATAAAAAACTTTTTAAAAATTTTAGTAGTTTTATTGGTACTTAAAAAAT
GCTTGGCTTTTTAGTAGTATATAACAATGCTATATATCCTAGTATATGCTTAAAGCTTAA
AGCAATATTAAAAAGTATAAAAAATGCTTGGCTTTTTAGTAGTATATAACAATGCTATAT
ATCCTAGTATATGCTTAAAGCTTAAAGCAATATTAAAAAGTATAAAAAATGCTTGGCTTT
```

FIG. 14X. Continuation of (CJLB-12 [organism= Campylobacter phage CJLB-12] complete genome)

```
TTAGTAGTATATACTATAGTATCATATCTAAAGCTTAAAGCAATATTAAAAAGTATAAAA
AATGCTTGGCTTTTTAGTAGTATATACTATAGTATCATATCTAAAGCTTAAAGCAATATT
AAAAACATTTTAAGTTTTAATTTTATATAATAACAATATTTCAAATCAAAAGGATTTATA
TGAAAGATACAGTTTTAAGCCTAAGTGGTGGTTTAGACTCAAGTGCTTTACTATTTGAGT
TTAAAGATCGTATTAAGATTGCTGTAAGTTTTAAATACGGTTCAAATCATCAAGAAAAAG
AACTAGCAGCTGCTAAAAAAGTCTTGGATGAAGTAAATAAATTAGGTGCTGAAATCGAAC
ATAGAATAATCGATTTAACAGAAGCTTTTGGAACTTTTAAAAGTGCTTTATTAAGCGGTT
CTAAAGCAGTTCCCGAAGCTGGTTCAACTGAAGTTTCAAATGTAATTGTTCCGTTTAGAA
ATGGTATATTCTTAAGTATCTTAACGGGTATAGCAGAATCAGAAGATTGTAGATTTATTG
CTATAGCAAACCACAGTGGTGATTCTAACGTATTTCCAGATTGTAGATATGATTTTATCG
ATGCTATGTTTAAAGCCATTGGTTCAGGAACCGAAGACAGAGTTCAGGTATTCGCACCGT
ATACAAATATTACAAAAACTGATTTGACAATCCGTGGTATATCTAATGGTTTAAACCCAG
ATTGGACTTACAGCTGCTATAAAGGTGGTAATAAACCTTGTAATGAATGTTCTGCTTGTG
TTGATCGTAACAAAGCAGTTCAAGAAGCCGCAACAGTTCTAAACATTTTAGTTCTTAAT
TTATAGACTATTAAGTTTTAATATATTATAATATTCTAATCGTTTACACTAAAGTGTAAA
GCAACAACACTTTAGTGTTAATTTTAGAACTTTAGTGTAAGTCACTAAAATTAGAACCAA
AGGAGAAATATGAAACTATTCGAAGCTTGCTTCAATTTAGGTAATTTTGAAACTTATGAA
AGATTCTATAATACAGAAACTAATAAGTCTGAAATTCAAAAAGTCTTTCTTAAGAATCAA
GTTTTTATTGAGGATCCTAAAGGAGAATATACATTTTTATTAGATCCAAATATTAAACTA
ACAAAAGTTCAAGCTAATCAAGCTAAAGATTTAGAAACTTATGGTAAGACTAATATTGCT
GCTGAACATATTAGGCAGAACTATTGGAAACTCAATGATTCAAAATATAATAAAAATATA
AGTATTTTTTATCTGGATATAGAAACTACGGCACACTCACCTATTGACACCGAAGCTTGT
AGAGAAAGAATAGTTTCAATTCAAGTATATCATAACTTAACGAATACAAATTATATTTTT
ACAAATGAGTTCTTTGACACCGAAGCTCATACTAAAGATTCTAAATATATTTTCGATGAT
AGGACTTATGATTTTAAACTTAAATACTATCAAGTAGAAGGTGAACATAATTTATTAATT
GCTTTATTTAAACTTATAGAAGCTTTAAAACCTTTATTAGTATTAGCTCACAATGGTGAA
GGTTTTGACTTTGCTTATCTTTGGAGAAGAACTGAAAAGTTAGGTTTAACTGAAGGATTT
AGTCCATTTGGAAAATCTGAATTTCAAATAAATGAATTAGATAATGGAACTAAAAAATAC
AGTATAAAAGCGCCCGGTGTTTCTATATGGATACTATAGATATCTATAAGAAGTTTAGA
CTTAAACCGAGAGAATCTTATTCATTAGATTATATTGCAGAAGTTGAATTAGGTGAAAGA
AAAGTTAATCACGATTGTTTTAAAACTTTTGATGGTTTTAGAACCGGTGAAGGATTTATT
AGACCAGAAGTTGAACCTAGCAAAGAATCTATTTTAGAATATAAACTTTATAATGCTAAA
GATTCTGAAGAAATAAAAAGAATTTCTAAAGAATATTTTATTCATTATAGTATTATAGAT
ACATACTTATTATATAGAATAGATAATGCAATTAAATTATCTGATATTATGATTAGTATT
GCTTCTATTATGGGTATTCAATTACCTCAAACACTTGGAACAACAACTCCTTGGAGTACA
TTTATCCGAAATTATGCAATGCAAGATAAAATAGTATTACCAAATCCAAGTGAATTTAGT
GGTGATGTAGAATTTAAAGGGGGCTTTGTAGCTGAACCATTAATTGGTAGATATGATTGG
GTTTTTTCAGCGGACGTTACCAGTATGTATCCTAGTCAAATTATGGCATTTAATTTAAGT
TCTGAAACATTTATACCATTTTATAAATTGCCAAATGATTTACAAGAAGCTATAAATGAA
TTAGATCTTAATGAAGATGAACAATATCATATTAATAATTATTATAAAAATCCCGAAGCT
TATAAAAAATACACGGATTTACTTATAAAGTATAATTATTGCGGATCATTAACTGGATCT
GTGTATGATAAATCTAAAAAAGGTATTCTACCAATATTAACAGAATTAGTTTTCAATCTT
AGAAAAGCAGCTAAAAAGAAATGTTAAAATATGAGCAAATGGCTGAAGATGCTAAAGAA
CCTGAATTAATACAAAAATACCAAGCATTAGCAACTGAATTGGATGTCAATCAATTGACA
TTTAAGATTTTAATTAACTCATTATATGGAGCTTGTGGAAATAAACATTTTATTCTATAT
AATAAAGAAATCGCTAAAGCTATCACAGGAAATTCAAGATTTTATATAAATCTTATGAGT
AAAAATATCAATAATTTTTTGTGCGATTTATGTGGTTCTGGAAATTATATAATTTATAAT
GATACTGACTCCGTGTTATGTTCAAGTACCTAATATTATAAACGAAAAATTACCAAAAGA
CCCACAATTAGCAACAGATATAATTGATAAATTTATAGAAACTAAAATACAACCGGTAAT
TAACACAAGCTCACAAGAATTAGGGTCTATTTTTAATGCTTTAGATGCTTCAAGAATTTC
TGCCAAAGCGTGAAGCGATTGCAAGCGTCTGCTGTGTTTGTAGCAAAGAAAAGATATTTAT
GAAAGTTATAGATTCTGAAGGTGTTAGGTTCAGTGAACCTTATCTTAAAACAATGGGTAT
CGATATTGTCAGATCCAGTACACCAGCATTTTCTAAAAAATATCTTAAAAAATCCGTCAA
TATTATATTAGAAAGTACAGAAGAAGAACTTAAAGAATGGTTAAAAAATATTAGATCATT
ATACCTGGGTCAAAATCTAATGGATATTGCTAAGATATCTTCGGTCAGTTCTAGCAAATA
TAAACTTGGTGTGGATAAATCCATACCGATTAATTCAAGAGCTTTCTTGGTATCAAATCA
TTATATAAATAGTCTAAATACAGGTGAGTTTCAACCATTAGAATTAGGCGAAAAGGTTCG
TATGCTATATCTTAGAGAACCTAACCCATTAAAATCTAACATTTTTGCTTTTAATAATGA
AAAATTTGCAAATGTATTTAAAGATTATATAGATTGGGATACTAATTTTAATAAGTTCTT
TTTAAAACCACTTGAAATAATGACAGACCCACTTAATTATAATTTACATAAAGAAACTGA
AACTTTGGAGGAATGGTAATGGATATACTCGGTGTTTACAATTATATTAAATCTTATATT
TTAAAGGATACAATTATTTAAATCTTATATTTTAAAGGATACAATTATTTAAAAAGTA
ATTATTCTTTTATTACTATAATGATATTATTATTTGGCACTATTTGGTTAGCTTATAATT
TATTATTTGCTGTAATTTTTATTGTTTCTTTTAATAGGTTCGTTTGTTTTATTTGCAT
ATCTTGATTCTGCAATAGACGACATTAATTTTAAAAAATAATGATTAATAGGGCTGTTAT
AACTAGGTGTTTCAAATATAATGGCTCTATGTTCGATGCTTTTGAATATTTTATAGACT
```

FIG. 14Y. Continuation of (CJLB-12 [organism= Campylobacter phage CJLB-12] complete genome)

```
TTGGGAATTAGATCCTGATACTAAATTTGTTTCATTGTACAGTCATATCAATAAAGATTT
TTTAAGCATTAAATACAACGTAGATCCAAAATGTTTTGATAATTTTATATATAAAGATCC
ATATGATTTAGAATTTAACAAAGTTTTATTATTCGATACTCACGATTTCTATAATATAAA
TCACCCAAAATCCCTTAAATTAAATAAGTTATATGTAATCGCTAACAGCACCATAGGGTT
CAAAGAAAATACTGAATATTTTGATGAATATTTTTTAAATAAAAATTATATTAATAAAAT
ATATTATCAGATTCACAGAATATTTAATCATTTAGATAATGTATATGTTAATTGTATGGA
TAATTGCTGCAAGAGTTATTTAAATATTCTTAAAATGTATCCGAAAGCAATTATCAAAGA
TCCTAAAAATAATTTTCAACATTACACAATGACTAAGAATTTTATACCGGATATTTACAA
GTATTTTAATAAGTACATATATGTTAAAACTGGTAGAACTTATGATAGACACCCAAGACA
ATTTACAGAATGTGCTTACCAAGGCATTGATTGTGAATATATTTCTGAAGGTTCTAAATT
CACAAAAAATGATAATTCATATTATAGATTCGAAGATAGATATGATTTTGATAAGAGATC
TATATACAACGATATAGTTATATCTAAATGCTCGATTAATACCAAAAATAAATAAGTTA
AAAGGTTTATAATGAGATTCTTAGAATATTATAGATTAAAAGAAGCTGAAGAATTTAGTA
GAAATGACATTAAAACCATCGTTAAACAATACAATAAAGTATTCACAAGAATCTTGAATG
CAAAATTCTATTTAGTTAATGAGGTTGAACATTGTACTTCAAATGGTTCAAAATTAATAG
GTATTAGATTTGCCAGTGCTGATGGCTATATGATAAGATTTAATTACACTACAAAAAACG
CTAAACAAATTCAGAAAATTAACAAAGCTACTAAAGAATTTCACGTTGAAAGTATAGATT
TTTGGAATCCAATAACTGGACATTTAAATAAACCAAGTATCAGAGTTTCTGTGATTTCGA
GTTTATCTCTCAAATATTTTATAGAAGACATTACAACTTCTATTAAAAAGAATCTTTTAG
GAACTTTTTATTATAAAGATCTTAAATTTACAGACGATATAAAATCAGAAAAATATGTGA
TTAACCCAGATGAAATCATATTCATTAATACTAAAGGATTTAAAGAATCCAATGATTTTA
CATTAAATTCACAAGATCCTAATATTCAACTTATACTTAATAACATCAAAGAAGTTTATG
GAGAAGCTTGATGAAAAGAATCTTAACCTTATCAGATCTTAGGCAATATATCAAGGAAGA
ACTCGGATATCCACAATTACAAGTTGAACTTACAGATAATCAATTAGACCACTGTATTGA
AAAAACAGTTCAAATGTTTTGTAATGTTGCATATGATGGAGAATTAACAAGATATATAAA
ATTTGAATGTCAGGGCCAAGGCAATTATTTTGTAGATCCTGAAGTTGAAGAAATATTACA
AATATGCCAAAGTGGTATTTTTGTAGGTTCTGATTTAAATGGATTAATAGATCAAAATCT
ATCTAATTATATACTATCTACTTCTGGTGTTGCTTTAAGTTACTTAGTTACTTTAAGTTC
TACAAGATCCTTAGTCGACAAATACTTTGGTCAACGTATTAATTTCGAGTTTAACTCTCA
TAAGGGATTATTATCAATATATCAAAATTACCACGGGCCTTTGTTAATTGAAGCTAAATG
TAAATACATACCAGATGAACACGATAAAATATATGACCAAGAATGGGTCAAAGCAATGTC
TGTGGCTCAAGCCAGATTGATGCAAAGTGTAGTCTTAGGAAAATATTCAGCACCTTTAAT
TAATGGTTCGCAAGTTAATTATAGTGATATTAGACAATTAGCCCAAGATGAAATACAAAG
ATTAAACGAGGAACTTTCCAATAAATTTACAGAACCTGCTGTATTTATCGTGGCTAAAT
AATTTTATATTTAAGGAACTCTTAAGATATTTTATATTATAATTATCAAAAGGAGATAAT
ATGAGAGTTTCTAAATACAAAATGTTGAGTTCCTTAAAAGACTCAGAATACAACTTAGTT
TTAACAAATTACAAATACCCACAATCTAAAATAGATTTAGAAGAATTTAACGAGTTTGGA
GAACGCTTCTTAAAAGATAATGCAATTATCGATGTTAAAAAACTCAAAGATCCTGAATTA
AATCTTAGATATGATTATGTTTTAATACTTAGAACAAAACTTACTGATACTGCTTTAGAA
ATTATAAAAGAAGCTTATCCTATGCTAAAAACTATTGACGAATATAAAGCTTCATTAACA
GGAGATTTTAATGAATTATGATAAACTAAATAAAATTGGAATAATTTGATTATTATTTT
ATCAGTTGTTTATTTTATGCTTGATATTAATAATACAAAAGTTAAAAATTTAGAATTTAA
AATTCAAGATCTCCAAACAGAACTTAATAAAACCAAAAAAGAATTAAATGATACCAAAAT
TAATTTAAATCATTTAAGTTCTAAAGTTCAAGATTTAAAAATATCTTTAATGAAAGATAT
GTCGTCAATGTATCACTTAAGTGATAAACAACAATCTCTAATACTTGATGAAATATGGAA
ACAATCTAAAAAATACAAAATAAATCCAGCATTCTTATACGCAATACTGTGGAAAGAATC
AAGATTTAGAAACGACGTTATCCATAAACCTACTTATGTTAGAACACTTAAAAAAGAAAT
ACAAGCCCAAGGTATGGGTGCTATTGTTTGGGATTTCTGGGGAGATAAACTCAAATCTAA
TACAAGTTTAAAATCTAAAAAAGATCTTAAAAATTGGAAAAAGAATATAGAAGGAACTGC
ATATATACTTAGTTATTTGAAATCTTTACCAAAGGTATCTAATACAAAAAATAAGTATGA
ATCAGCGGCTTCAAGATACTATGGAAAATACCAAGCAAATTACGTGAATAAAACAATGTC
AAAATTTAATGAACTAAACTCTTAATGCTGAAATTAAGTGGGTTTAAATAACGATTTTG
AACCGATATGATTGTCTAATAATTAAGTACATTTTAAGTGCTAATATGTTATAATATTGT
TAGATTTCAATAGAAAGGAGAACTATGAATGAATTAAGTTTTGTACCAAAATCAGAAATT
CTTAATAAATCACAAGAAACTTGTATTAAAGAATGCCAAGATATTGTATTTCAAGAAACA
AAAGAAGTTTCTAAAGACCTCATATTAGATACATTATTAGGTATGATAGATTCTGTCAAG
ATTTCAGATTCTGCAGTTCATATAAAATTCAATAAATCTTTAATCATACAAAGTGAAAAC
ATTGTTTTAGGTGCGGATAATTTAAATATACAACTTGCAGGAAACCGAGTAGAATTACAA
CCAAGAATCAAACAAAATCCAAAGGAGATTAAATGATCACAAAAGATTTCATTAAAGAAC
TTTCAAAAATGTCGAGTATAACTGATAAAGTTATTCTTAAGTATCCAATAACAACATTAA
ATTCTGAAGCTATAGATATGCTTGTAAATATAGATGCGTCTAAATTAGGATGCCAAGAAT
TCCCAGATACTGGTATATATGAATTAAATAAGTTTGTTCATATGTTCGCATTATTTGATA
ATCCAGAAATTACAAGAACAAACAATGCAATAGAATTTGAAACACCGGGTACAAAAAGTG
TTTATACAATTTCAGATTTGTCTGTAATGGAAAACTTTGATCAAAAAGCTTCAATTATTG
AAAGTTTAGATAATTTTCCAGAAGTTGCCAGAGTTGACATTAGTATTGAAGTCATAAAAC
AAATTAAACAAGCTTCAAGTATTTACAACGAATTAAATGTTTTAAGTATAGAAGGTAAAT
```

FIG. 14Z. Continuation of (CJLB-12 [organism= Campylobacter phage CJLB-12] complete genome)

```
CAAATGATTTATATTTGTATTTAGATGCACATAATAGATTTAATTCTTCTAATAATACAT
TTAGCAAAGAGTTTTTAAATCATTCAACTATGGATTTTAAACTGAAAATCAATATTGAAA
ATTTTGTTAAACTGCCGGTAACAAATTATACTTTAAAGATTAAAATATAATGAGAGTAAAA
ACGCATTTAGAATTCTCTTTGAATCTGAGTTTTCTAAGATTTTGATCTCAAAAATTGCAG
ATTAAAGATTTTACACCAAGGAACAATAAATGGATAATTTAAAACAACTTTCAGCTACGT
GTATGCAAATCTTTATTAAATTAAATGGAATGCATTACTTAGCCAAAGGCAATCAATTTC
ACAGACTTCACGAAATAACACAAGAATATTATGAATTTTTTCAAGAGTCGTTTGATACAT
TCAATGAAAGATTGGTTCAATTGAGTTTAACACCCTGTGTTAATATACAAGAAATCCACG
ATCTGAAAAATCCATATATTTTAGATCTACAAGCTACAAAACTTGATTTGGATACCATAG
CTAGCACATTAATAAATGATTTTAAATTAGTTGACAATTCAGTAGCAGTTCTTATTCAAG
AAGCTATTAAAATTGAAGATACTGTTACAGAAGACATCTTAAGAACATTTAGAATTCGTC
TCCAAAAATATATTTGGATGCTCGAATCTATGCAAAGTTAAGGAGGTATAATGTTAAAAG
AAGATAAATTTATTTGGAGTTTATTTCAGAAAAAATTTCCAGAAGTTTCAAGAGAAGCTT
ATGAAGATTTTGTAGAAGAATATTTAAATATCAAACCATTTAAAGCTAGTGAAAATATAT
TTGAAACCAATCAAAGTATTTCAAACGAAGCTCATTTTATTATGAGAGCATTAGCTACTA
AAAAATTACAAGAAGTTTTTGAAATACTTAAAATTGATTTAGAAGACCCAAATGTTAAAG
CAGATTTTGAAAATGGTAATTTAGGAACACCAGGCAGAGTCATTAAGCTAATGGCTGGTG
CCAACACTGATGATGATACTGAGTGTGGCTCTGGTAGATTTATGAAACCTGTTAGAATAG
CAACTTTTCCAAATAAAGACGCAGCTAAGATTCCAATTACTAAAAGGATTAACATAGCAA
GCAATTGTAGTCATCATTTATTACCATTTAATACAGATTTTGCGGAAGATTCCTATGCAA
TAGTTAGTTATATACCTAAAGATTATGTTCTGGGTATTTCAAGTTACAAAGATTAGCAG
ATTTCGTCTCGAGGCGTTATTGGTTGCAAGAAGATTTGACTAAAGAAATCTACAATAAAA
TTAAAGAAGCAGCACAAACTGAAGATGTTTATGTTAAGTTATGTAATATTAAACATACTT
GTGAATGGATTAGAGGTGCAAGAAACACTGAGGGGGGATTTACTTCAGAATTCTACGGGG
GTGCTTTTGGTGATCCTGAATTAAGAAAACAGGTTCAAATCCGAGTTTAATGTTAATACA
CTATAGATCTTAGCATTTAACACTTTAGTGTAATTTGCTAGATCTTTAGTAAAAAATTTA
ATTAAATTTAATCGTTCTTTATATATAATATCATATTAAAAATTTAAATTTAAATTTTA
AAAGTCTAAATCAAGGAGTTTAATTTGGATAATTTTGAATCGGTTCTTCTAAAAAATAT
TATAGAATCTAAAGATTTTTTTAATAAAGTAAGGCCAATCTTAAAACCTAGTATTTTCAC
AGATTTTGGTAACCAAAAAATCTATGAATTAATAGATAATTTTTATTCTAATTATAATAC
AACTCCTAGCATTCAAGAAATAGCACTTCAAATTAAAGATATTCCCAATAAAGAAGCAAG
AACCCAGATTGCTACTAAACTTAATGATGCTAGAAACTCAGAAAATATCAATAAAGAATT
CTTAGATGATTTAACTGTTAAATTCATTAAGGACCAAATGTTCACAAAAGCATTAATGTT
AGGTGCTGAGTTCATTGATAAAAAAGATGAAACTTATAAACAAAAAGCCAAAGATCTTAT
AGATGCTTCACAACTTGTGAATATTCATAAAGATCTTGGTAATGAATATAATAATATAGA
AGAACGCATTGATTATTATCAAAATCCAAGAAAAGGTATCAAATATTTAAGATTCAATAC
TTTAAATGAGTATATCGGAGAAGGCTTTCTTAACGGAACTTTGAATATTTTTATGGCTCC
TGCAGGTATTGGTAAAAGTTTATTAATGAGTACCAGCATTGGTGATTTTCTTAAACAAGG
TTTAAATGTATTATTAGTCAGCTTAGAATTATCTAATTTTGAGTTCTTAAAAAGAATAGA
TGCTGACTTATTAGATATACAAATTAATGCTTTAAAAGACGTAGACCCTAGTGTTATCAG
AACTAAGTTTGAAGAACTAAAAAGATCTGGTATTGGTAGCTTATATGTTCAAAACTTCCC
AGCTGGTTCTTTTAGTTCAAATGATTTAAAATCTTTATTAGAAATGTATAAAGCTAATAA
TATAAAATTCGATGCAATATTCTTGGATTACTTAGGCTTGATGAAATCTGATAGAGTTTC
TGCAAGTGCAGGTTTATATAGTTATATTAAGGCCATTGGTGAAGAAGTTCGTGCTATTGC
AGTCACAGAAAATATTCCGATATTTCTTGTTCTCAATTAAATAGATCAGCTGTAAATAA
TACAGATTCTAACAATGAAGCTATTTCAGATTCTATGGGTACTGCTATGACTGCTGATTG
GATTTGTTTCTTATTACAAACTGAAGATCTTAAAAAGAAAAATACTATTAGATTTAAAAT
AACTAAGAATCGTTATAATGGTAGAACTTCAAGTTTTGATATGCATATTAATTATAATAA
TATGCGTATAGAAGATATAGTTTCAAATGATATACAAATGTTAAGTAATGCTGATATTAA
AAACGTTCCACAATTAGAAATACAAAAACCTAAAACTGATTGGAACTTTAATTAGTCTCA
TAAAGATTGACACTATAGTGTTAAATGTTTTAAATTTAATTAAACTTTAAGTTTATATAT
TATATAATTATATTGTTTAAAAAATTTGTTTAAAAAGTTTTTTTTAAACGGTTAGATTC
TAATCAGGATTTTCAAACTGTTAATGTAAAAGTTGCAGTTTGAATCCTTTTTAAATTAAT
TAAACTTTAATTATAAATATGATTGAAAATTTATAATTTTCGGGGTGTAGCGCAGTCTGG
TTAGCGCACTTGGTTTGGGACCAAGGGGCCGAAGGTTCGAATCCTTCACCCCGACCATT
CTAACATTAGTAAGCATTCGGGTAATTGGTAACCCACTAGACTGTAAACACATTTAAGAT
TTCAGTAGAAGTTTTAAATGTGTTTATGATGTCAGCGTTATATTATATAACTAAAACTGA
TGATTGTAAACACAATTAAAAATCATTTGTAAGTTTTACCCATGTTTATTAAATTGTGAT
ACTATATGTTTATATAACCAATAAATATATTTAAATATATTTTGGAGGATTAAAATGACA
TTTAAAGATTATTTAAACAATATTGCTTTAAATGAAGCGTTGAAAACGGATGTGTCTGCT
ATAGAGGAACTCAGAAATAGATATCAAGAAGTAGCCAAAAAAAAGATGGAATTGCAAGCC
GAAATAAGTAAACTAGAAGCTGCACAGACTACAGCTTACTTTAAACTAGGTGGCTTAGCT
GCACAGATTGCACCCGATAACGTTGATAATGAAAAACTCAACAAAGGTTTAGAACAATAC
GACAGTGAAATTGAGAATATTGAGAAAAGTTAGAACCTCTTTATAAAAACGAGAATCT
TTACTAGACGAGCTTAAAAAAATAAGCAGAGTTGCTAATAACTTAGTAACAAGAAATGCA
AAAAAAAGCTGGTGTAAGCCCTTTGAATTATGTTTTTAAACATAATTTATCATTTTAATA
```

FIG. 14AA. Continuation of (CJLB-12 [organism= Campylobacter phage CJLB-12] complete genome)

```
AAGTTAAAGAGTCATCGTATAGAATTAAACTCTATACAATGACCAAACCTTATAAGTAGA
CATAAACCTTATAAGACGTATAGCTTTATATGACCCACATTTACTAATAAACTTAATTAT
TCCCATTTAATTTTATCGACAGATTTAACAGTTTCAGATGAATTAATTTTTTCTTTTAAT
GTATTCGCTTTAAATATTACTTCCTGAGTATATTCGGTTACTTTTGAAACAAATGTTAAA
AATTCTTGAGGTGTAAAATTAACCTTTTCATCATTCAAGTCAATCCAAGTAATCTCAGTT
ATTGAATTAGTACCACTTTGTATATCTAACAATATATTAGCGGCCATTCCGTTAATATTA
AGTTTATCCTTTTCCCTAGTTTGGAATGTATGGTCTTTGAATACAAAACCAGATTCTAAA
GCTACGTCCCTTTTTGTTTGTATTTCAAACTTCTTCTTTTCTTTAATTATATTAAGTTTT
TCAGATTCACTTGCAGTATTTAGTACATATTCATAATACAAATCCATAAGATTATTAGCT
AAGCAGTATTCTTTGACTGCTTGTGTACCCGCTTGAATTTCTTCAGGTGTAATGTCATCT
ATATGATTGAAATTACCTCCCTCTCCGACAGTCCATTCTAATTTTTGTGTTAATAATGTA
GAGTATCTGTTATCCGCTTGTGTCAACACATCTTGCAATTTAGTATCGATTTCAGATTTA
TCATAAACATTACTTGTGTTGGCTTTAGTATCTAATTTAGAATCTACTTCAGATTTATTA
TAATAATTAGATAAATCTACACTTAGAACTGCATTTTTCCATTTTTTAGTATTTGAATCA
TATTGTAAAATATGATTGTTTGTCGGGTCAACAATACTTGCATCAATTAAGTTAGCAATA
CTTGTTTTATGTGGGTTATTAAAGTCTGTCTTATGAGTATTAATTAAATCTACATTAAAA
TTCTTTTTGGCGTAAGCTAAATTAATAGCGTGCCAATCACTTGTTGGGTCTGCAACATTA
AATACTTGCGTTTCAGAACCACCCAGATTTGCTTTTGTATTTAAATTATTATTGATGCTA
AGAATGTTATTTTCTATATTTTTTTAAATTGGGTATACTCACTATACCTAGTATCTTCT
AATTCTTTATTTGCAGCAATGGTATTTTCAGCAGTTGTCACTCTTCTTTCTAATTTATAA
TGTTTATCTTCTATATCTTTTTCATTAGTACCTACTGTAGTTTCTAATTTGGTAAGCCTA
GAATCATTAGCTTCCTTATAAGTTTCAAAAATTATTTTTCGAAGGAAATTATCTTCTATA
TATTTAGAACTGTATAATAAATCTTTTGAAGCTTCTTCTGGATTTTCAGTTGTATGTCTA
AAAATTGCTTGAAGATCTATTAATTCATCTGATGCTTCCATAGTCTCCTTAGTTTCAGAA
TCCATACAAATCCAATATTTACCATTAACTATATCGTGAATATTAGCGTATATACTAATA
CTAGGATTTGATTCTTTGCTTATTTTATTAAGTTCTGTTAGAACTTTTTCTTTTAACTGT
TCTTTTGTGAGATTTTCTGATATTAAAACATCAACTTTTTTAAATTGCATTTTTCACCTT
TAAACTAAAGATTTTATAAGTCTATCTATTCTTTTATCCTGAACGATATTATTACTAGTA
TTATTTATGATCTTACCATCAGAGTTTATTAAAATAACTCTACCTTGATCTACGTCTGTT
ACTCTAACATATACTGGTGCACCATCATTTTTAGCAACTAATCCCTGCATTTCATCAACA
GCTTCTTTTGTAATTTGACTTAATGTTTTAGTTGTTTCGTATACGAAATCTATTATTTTT
ATTTTAGATGCTTCTAATGCCATTTAATTTTCCTTGTATATTTTTTACCATTTAGATACT
AAATTTTCAAAAGTATCTTGAACTGCATTCTGCGCTGCGCTTAATCCATTTTTTAACATA
TTACTAAAATATGAACTTGCTTTAGATTGTACACTATCATTCCCGGTTGTGTTGGAAGTG
CTTGCTAATTGAATATTTTTAATATCTGTATTATCGTGATTTGGTTGGTTCATTTTAAAA
CTAACATTGAATTCTATAATTTCATTGTTATCTTGAGATAATTGTATTTGTGAAACATCT
GTCAACAATGCATCCTGCGTCTCCATTACTAAGATGTTTTTAGAACCATTGCTTAAATAA
ACCTGAATTAGCCAAGCACAGACATCATTGTAGTTACCTTTTGAAATTTGAAAAGCATTG
ACAAATCTACGATACATACTAGCATTATCAAAATCTCTGAAGGTCATATCCACTTGGTAT
ACTGGGTCTGCACCACGTGCTAAAACCCAAGTCCCTCCAATTAATAATTCTTCAAATCTA
CCGGTATATTGTGGCAAATTAATACTTTTTAAACAAATATCTATACTATTTTGTGTTTCG
GTAGGGTTTCCCCAGTTTATAAGATTTTGGAAAGTAGCATTAATAGGTTTCATAATAACT
ATAAAATCAGAGGTTTTACTCCATTTGATAGTATTAATAACACTAGCAAGTTTATTTAAG
GTAACAGTTGCCATTTATCCTACTTTTTTGTATATTTATTTGAACATCTTTTAGAGAATA
CTTATATGAACAAGCTTTTAGTAAAGATGTAATGATCTCTAAATTTACTAACAATTCAGA
CAACATTTTTAATCATATTTTAAAAGTCTTAGTATATGATGATAATTTAAATAATAAAAA
ACATTTAAGAGAGATGTCAGGAATAGTAAGATCTTTACAAAACAAAACTATCAAATCAAA
AATAACACCGGAAGACTTGTATCATATTTTCTATGGAAATATTGAAGAAGATTCGAATCT
GAAACAATATATCTTGGATTTAGAGATTAATTACGGTTCTCTTCAAAAATCTAAGCTATC
AGAAAATGAGATACATTTCAGACTAGCTAGAATCTTTAAAAGATTATCAAGTGAGATATT
AACAAAGTCATTCAAGTCTTTTGAAAAATATCCAGAACTAAGGGATAGATTTTAAAACAA
CAGGCTTTGATATAATTTATACCCGATTATATCAAAGCTTTAAATACACAAATGATTGAA
TCATAAATATTTAACCAACGATTAAAGGACTCAATTTGAATTTAGACACTATACATATTG
TTAAAAATAACGGAGAACGTGAAATATTCGATGCTGAAAAAATACATAAACACTTACATT
TTGCTTGTCAAAACCTCGATGTAGATATTATTAGCATTATTAAAGATGCTAGATTAAAAA
TATTTGATGGTGCCAAAAGTGTAGACATACAAGATTCTTTAATTAAATCTGCACAAGAAA
AAATCAGTGAAGATTCTCCAGATTATGAGTTAGTTGCTGGTAGATTATTAAATCAAAAAC
TCAGAAAAGAAGTTTATAAACAATACACACCATTAGATTTTAAATCACAAGTTAAAGAAC
GTATTAAAAAGGTTTCTATACTGAAGATCTTAATGCTTATAGTGATGAAGAGCTTGACT
ATTTTGGATCTTTAATTAATTATGAATTAGATAACGAACTACCTTACAGCGCATTAAATC
AAATGTATTCTAAGTACTTGATCAAACATAATAAAAAATGCATTGAGGTTCCTCAAGAAG
TTTTTATATTGATACCAATGGCTATTTTTTATAATACCGATATAGAATATAGAAAAAAAT
ATGTTAAACTTGGGTATGAATTATTATCACAGCGTAAAATTTCTTTACCTACTCCTATTA
TGAATGGAGCAAGAACAAGTTATAAGAAATTTATATCTTGTAATTTATTAAACTTTGGTG
ATTCAGTTGAAAGCTTTGCTAGGGGTTTAGAAGCTGTTTAAAATGCACCAGTGCTAAAA
GTGGTTTAGGTATCAATACAAGTTTCATCAGAGGTTTAGGAGCTCCAGTAGGTAAACCTT
```

FIG. 14AB. Continuation of (CJLB-12 [organism= Campylobacter phage CJLB-12] complete genome)

```
CAAGATTAGATCATACTGGTATGCTGCCGATCGTTAAAGCCATTGAATCTGCTACGTCTG
CGCTGATTCAGCACGGCAGGGCGGTGCAAGCAATCTGTCAATGCCTTTCTTTCACTACG
AAATAGAATTATTTTCACAACTAGGTGATTCTAAAGGATCTTTAGAAAATAGGGCTAGAC
ATACTGATCAAACTATTATCATCAATAAATGGTTCTTAGAAAAAGCTCTTAATAAAGAGG
ATATATTTTTATTCCATATGAATGCTGTAGGTAATAAGGATCCCAAATTAGATTTATATG
ATGCCTTAGGTGATTATAAAAGATTCGATGAATTATATAAACATTATAGCGCTAAAGTTC
CTAATAAAAGTAAAAAGAAAATTAATGCTTATGATTTATTATCTTTAATTATAAATGAGA
GAATGATTACTGGTAGAGTTTATATTGTTTTTGCGGATAACTTCGTTAATTCAAGTTTTA
AAGAAAATCTATATATGACAAATCTTTGTTGTTTAGCAGGTGATACAATTGTTGAAACTT
CACAAGGGCCTAAATTTCTCAAAGATATTAAAAAGGAGATCTTGTTTTAAGTTATAATC
AAGATACAAAAAAATATGAATACAAAGAAGTACTAGCAGCTGTTTTAACAAATCCGGAAG
CTGAAGTTTTTGAAGTAGAATTCAATGGTAAAGTGGTCATTTGCACTAGTGATCATAAAT
TCTTAACCCAAAGGGGTTATATTGAAGCTCAACATCTTTTAGAAAGTGATACAATAGTAG
AATGTTCCTCCCGTATTTAGAAGAAATAACATATTTAGATAAACCGAATAAACATAATCT
TAATTTCTTTAGAAAAACATATTTAATGGATTTCTTTGAATTAGGATTAGTATTCGACGA
AAATGAAGATTTAATTGGTATTAAAAATGAAGATACTACATCAGGCTATTTACCACTACA
TTTTAATAGTATATTAGAACTCTCAGAGTTTTTATATGCTTTTAATGGCGCGTGGGTAGC
AAAGAAAGTATTGGATGATTGCCAGAAAATGGATATGGTGATTAAGCAAATGTCTGAAGA
ACTCGGTATACCAGAAGAGGTTATTAGAAATGGCAAGTTTCAAAGAATATGGCAAGTTTC
AAAGAAAGGGCTATTTTAAGAATGGCTACATTTAGACACAATAACTTGTTATATTATGTT
ATAATTGAAAGGAGAAGGGGTGTCAAAGGTGACCATACTTGTGTAGAACCACATTTTGGT
GCTTTTGTAACTGATATAGAAAATATCTTAAAAATTCTGATACTAAGCAATTGTTGTTA
CAACTCAAACACAGAAAGGATATTTTAAAGATTTTAAACCCAGATAAAATAGAAACAAAT
TCTCAATTAGTTTTATCCTATGTATTAAGTGTTCTAAGAGATTATATTAAAGAACATTAT
ACATTGTTTATTAAGCTTGTGACTAATGAAGAATTAATTGAAAAATATATAAAATTATTA
CCTTATGTTTGTACTGATTTAAAGTATACTCCTATAGATATTTCAAATGAAATTAGAACG
GATTTTGATGGAACTAGGAAGCGTTTTCTTGTGCTATTGCTCAGAAAATCAAAAGATTTA
GACAAACAAGATGTACTAAAATCACTTAGTAATATCAATTTAAGTAATTATATATTATAA
TAACAATAAAAGAGGTGCTATGATAAAAATAACTAAAAAAACTGAAAAAATACCTGTATA
CGATATAGAAGTTAAGGATAATCATAACTTTTTTGCAAATGGATTGTGTGTTCACAATTG
TGAAATATCTGTGCCTAGTCATAGTTTAGATAATTATAGGGGTATACCAGGAGAACTAGG
AACTTGTATCTTAGGTAATATAAATTTTGGACATTCTAAAGAATCTGACATCCCAAAAGT
TGCTGATTTCTTAGTTAGGTTCTTAGATAATATGATTGATATTTCTGATTTTGCTATGCC
AGAAATTGAATACTCAGCTACAAAACGTAGAACATTAGGTATTGGTGTTTCTAACTTATT
TGGATATCTTGCTAAATCGAAATTATTTTACAATACAAAAGAAGCACGCGAACATATTAA
TGATTTAATGGAATTATTTTATTTTAACTTAGTTAAAACTTCAATAGATTTAGCAAAAGA
ACGAGGTGCTTGTGAATTATATAATGAATCTTTTTATAGTGATAATAAGTTTATATTCGA
AAGATATTTAGAAGCTGGGATTAAACCTGAATTTAAAACAAAATTAGATTGGGAGTCACT
TCGTGAAGAATTATCTAAATACGGTATGCGCCATTCAAGCTTGTCAGCTGTACCGCCCGC
TGGGAAATACTTGTAATAGAGAATCAACAGTTCAAAGCCAAGCTCAGCAACACCTGGTAT
CGAACCTCCAAGAGAATTAGTAACTATTAAAACAGAAAAAGTTCTACTGTAAAACAGTT
GGTTCCTTTCTATAAAACAGCCAAAAAATATTATACGACTGCTTGGGGTGTTGACTTTAA
TAATAAAGATTATCTTAAATTAGTGAGTACAATACAAAGATATGTACATCAAAGTATTAG
TACAAATCAATATTATAATATCGTAGAAACTAAAAAAAGTTAATATTGAAGATGTTATAGA
AGAATTTATAGAATGCTTCAATTTAGGTGTCAAATCATTGTATTATGCTAATTTTAGAAC
TACAGATGATGCAGATGGTGATCAAGTAATTGAAGGTTGTGGGTCTGGAGGTTGTAGCGT
TTAAAAACTTTTAGGTTTAAGCTTTTAAGACTTTTTAAGCTTAAACTTTAAGATTCGGTT
TGTATTTCAGAAACTTTTAAGTTATTTTATATTATAATTATTTCATTAAAAGATAAAGGA
GATAAAATGAAACACATTACAAAAATATTTTTAGGATATAAAACGACAAAGCATATTTC
AATAGAACACAAAGACAAATTACGTGTGCTATCAAAAATCTTGAACGTTTAAAACCTTCA
TTTAATATTAACGAAGCTAGATTTGAAGAAATCTACGAAGCTAAACAAATTGAAACAAAC
CCAAATATACTTTATATTGCTGTTACAGACAAACAATATGTAATTGTAGCCAATAGTGAT
TGGCGCGGTAATATCACATTAGATTATAAAAATATTGATTTGGTGTAGAAAGAAGTCTA
CAAATATCAAGGCTTAAAAGATTATTTAGAGCTGGTGTTAGAATATGGAAATGTAATACT
TACTTATATGATAGAAAACGTAAATCCATAGGTTTGAAGAAACCTAGTCTTGAAGATCGT
TTAGCAGAATATAAAAAATCTAAAATCAATGATTTTAACAATATTGCTTAAATAAATTA
AAAAGTGTTAGTAATTTAAATCTAAATGTAAACAATATTGAAGATTTAGATTTTAATAAT
TTAGAAAAACAAATTGATTTTATGAAGAGTTGTTATATTATACTAAAAAATATATTGCG
AATGAAAAATATAAATTTTGTGATGAACCTTATTTTGAAAGCACAAAAAGAAAAACTATG
AATGCTATTATAAATTTAAAGATTTGAAATACATTCATAATCACACAAAAACTGGGATTA
AACGATGATATTAGATACTAAAGCAGATATATTAGTAACTCATAGTTTTCACTTTAATAA
TACTAAAATGCACGGATTATCAGGACATTTATTTGAAGTATTAGATTATTACTGGTATTT
TAAAAATAAAGGTGTTAATGTTAAATGTTTAATTCCAGAAGTAGTAACTAAAGAAACTTT
TAATGATTTCGTAAAAGGACACTATAGTGTAGATTTTGATTTAAATGATATATATTTTTT
AGATACTAAGATATTAGCAATTAAAGCTAGAAATATACTAGTAACCGATGGTGGGTATTG
GTTTTTAAATCAATATAAGTCTAAATTACTAGGTAAAGTATTTTCGTTTGCTTGTGGTCC
```

FIG. 14AC. Continuation of (CJLB-12 [organism= Campylobacter phage CJLB-12] complete genome)

```
TAGTTTTTTAGAATCCGAAGATAAACCAGAATATGTGACTTTTTTAGCAGATCATAAAAT
ATATCCTGGTTTGGGAATAAATTATACTAAGAAGGTGTTACCCCATTTAAATCATATACC
AGGAGATAAACCTTTTGCTCATATTACTAAAAATTGTAGGGCATTATCAGAATCTCAAAT
AAAAGATCTAATAAGAGATTATCCTGATATTGTAATGTATAGTGATTATTTGAATATACA
GAATTCGACAAACAAACCTATCAAGAATTTTAATTTTAGTAAGTATGTGTATACGCCTAT
TATGAGACATTTTGATTGTTCACCTAGACTTATAATAGAATGTAGAATATTAGGTATAGA
TTTTGATTTATGGAATATCAATTATAAAGATCCTGGTTTAGAAGACGTTTAGAAACAGA
TCTGGATCAATTTATATTGGATGGGTCCGACACAATTATAAATTATTTAGTTTAAAGTTT
AAACATTACTATAGAAAAGAAAATATTCTAAAAGAGACTTAATATGGCTTTTATAAAT
GATAAAAAGCACACAAAGGTTTAAAATGAATAAAATAGACTTCTCGGGTTCTGAATGTT
CATATGAAAAACTACTAAATGGAACATTAGAGTTTGAAGGTATTCGAGCTGCGATAATGA
CAACCGATAAATGTTGTTTTAGTTGTGAATATTGTTGTAATTCAGGTTTTACAGATTTTA
ATGCTGCTAAAATACTAAAAGCGAAGCAGATTTAAAATGTTTTAATTTGGTTAAAGCTA
TATTTCCTAGATTAAAATCCGCAGTTTTATGTGGTGGTGAACCACTAATGTGTGATTATC
TTTATGATTATTTAGACTTATTTAAGGATCTAAAAGACGTAACAATTTTAACAAATCTAT
TATATATAAAGATCATTATAAACGTCTAAAAGAATATAGAAACCTAGATTTAGTTACAA
CTTATCACGCTTCTCAAATTAATTCTAATCAATATATTGAAAGACTTAAATATTTCTTAG
ACATAGATTTACCAAAAGAAGTTAAATTATTTTTTAACCATAAAAAACCAGATTTAATAG
AAAGAACTCAAATGTTAAAGATTTCTTAGAATCTCAAGGATTTACTAATATTATTTGTA
CTCATATTTCAGGATTTGGTTTTAGTAATCCAAATAAAAATGTAGCAGGCGTTGACCTTA
ATGCAGATAGAGACTACGTAATGATTTCTCAAGGAACTAAGAAATATATGAATGAATCTG
AGTTTGCGAGTCAAAATTATCTCGGTATGGTCTGCAATGGTTTGAGACTTCACGTTTACC
CAGATAGAATCATTGAAAATTGTTCAAGAAAAACTTTGACTGTAGAAGAAGTTCTAAAGT
TAAAAGATTATCAAGTTGTAAATTCAAAAGTTGTAATGTTGGTATGTGTTTGAATTATT
TTAATAAAATACAATGTTAAATACTTAAAGAATATATCGTAAAAATAAACTTGTTTTAAATA
AGCTTAAATTTAATCTTATTTTAAGATTATTATTATATAATAACAGAAATAAAAAAGGAG
ATAAAATGATTAAAAACACAAAAATACAAGAAATAAAAGATTTTAACAATGATTTAATAT
CTAAAATGTTAAAAAATAATCCACATTTTGACTTAAAAGTAGACTATAGAACTCAATTTG
TAGTTTTAAAGACAACTCGATAATAGAAAGTGCTTATTATCCTACTAAAATAGCTACTT
GTGAATATGGTGTAATTGAAGTAGATGAAGATGCTTCAGATGGCATCTCAATATCTCACA
ATAAAATAGAATTTTTTAGAAATGGTGTACCTAATGGTTTGGCAATAGAACTTATTGAGG
ATAATGAAACCACAATCAAAATTAGATTTGATTTGCGAGATCGTAATATTTCTATGAAA
ACTATTACGCTTGGGATTGTTTTGGAAAAAGAGCTTTCACTTTTAGAAATGATTTAAATC
GTTTTAATGATCGTTTTATGACTAAGATTAAACTTAAGAATTTTTTAACAAAAAACTTTG
ATTTATTTAAAGATTTTATCAAAAGTTCTAATGAATATTTAGATTTTATTAATAAAAGTT
TATAATTAATTATAGTCAAAGGAGCTTAAAATGGAAATAATTAAATCTGCAACTTCAGGT
TTCATTAAATACACAATAACGTTATTTTTATTAGGATTTTTTCAGGTATAGCTTTTACA
TTTTTTATGACTAAATGGTATTTCGAAGATCGTGGATCAACTATAGGTTATGAAATTCAA
AGAGCCAATATGATAAAAAATTGTATAAAAGAAGTTGACGTTTCCTTAGAAATAATGAAA
GAAGAAAACTCGGTTATAGATGCAACACAACCATTAAACTAAATATAGGATTTAAGATGA
TTATTGAAATAAAAGATTTTCCATTAAATGTTAAGAGAGTAGTTTTAGAATTTGATGATT
CTGGTGCTTGTACGATAGAACCAGAAACAAAAGTTAAAAAAATCTAAGATTTCTAAACC
TATTAAAGAAGTTGAAAATGATTCAGCTGTATATGACTGAAACTGAACCTGTTTTAGATAT
TAATTTTGGTTCTAAACCAGTAAAAGCATCAAACACAGAACCTATTGATAAAGTTGTAAT
CCCGGATATAGAAAGAGAAGCTAACGTTTCAGCTACAATGCAAAACTTGAAACTATAAAG
TGTTATGTGTTAACACTATAGTGTAAAACTTAGAAGCTTAAGAATCTCTTAAGCTTCCGT
AATTGCAAACTTATATAACATCGGAGTAGTTGCAGAATGTAAAGGGTGTATTGTATATGC
ATTTCTTGTAAATACCCTACAGTTCTTTCACCTGATTTATAATTATAAGCAGTTGTTAA
GTTCATACAATATGGGCTATAAATCAACGAATTAACACCCTTTCTTTATGAGATTTTAA
ACCCACATAAGCATTATTATCATCAGGATTTGGATTTAAATAATATCTTGTATTATTAAT
CTTACCTAAGAAATAATCATTCGCTCTATTTTCATCTGTTGAGTCATCTATTCTTGAATA
AGTAAAACTTAATGATAATATACCACCTACACCAGTTTGTGGAAGTATACAAAAACTATC
GTATGTTCTAAAATTAGGTGAATTCATTTTAATAACTAAATCATTTACCTTTTAGATAT
ATGAAATAAGTTTGTTTCGGCATTTTGTTTAGAATCGTTGTTATCATCTAACGTAATACC
TTCTGATTCAACTGCATTTTCTTTAATAAGATTTATAATTTTTTCAGTTTCTTTGTGTGC
TGCAGAAGACTTGACCCAGTTAATGAATAATTCTGGTGTTTGTTCATTTCCGGCTTTATT
AAGATTACTTAAATTTAATAAATCTTCCCAAGCTTCCTGTGATATTTTGATAATAGATTT
ATTAGTATCAACATCAATTTGTTTTTTAATAATTTTAAATGTATCTTGAGTTTCTTGTCT
TGCGAAAACATATCCAGATGGTTGCATCATAGGTTGAACTTCAGCAATGTGATGACCTAT
AAACGATTTGATTTATCTTTTAAGATATCACCTAACATAACTTGGTAAAAATCTGCATC
TATACCTTCGCTAATTAAGTTTGTAGTCTCCTTAAGAGAATTTTCTAATAATAGTTTATA
CATTTTGGCCTCTATGTATTTTTAAGTTATTAAACATTTTAATAGTTTTTCTTGCTTCAT
AGTTCTTCTCAGACTTTATCTGAGCTTTCTAAGAACTCCACAAGCTTTGATTTTTTAAAG
TGGTTCCAGCTGTTGTATCTGTAGCCACTGTATTTTTTAAAGTCTCAAGATAAAATTATA
TTTTAATTTGAATTCTTCAAAATCTTATAAATACTTTTAGTTTAGACATATCAATCCTA
TGTTTAAAATTAGAGAAATAAAGAAATTGGTAGTTTCTTTATTTCTCGTTTTATTATATT
```

FIG. 14AD. Continuation of (CJLB-12 [organism= Campylobacter phage CJLB-12] complete genome)

```
TAAATTTCAAAACTTTCAATTTTTGAAAATTCTAAAATAATTTCTATATTTATTTAGTTT
AATATACTTTTAAGTCCAGAATATATAATATTTGATATAAATTATATAGTTTTTCTCAAT
TTCTTAAGGTTGCCTTAGTAACACCTATAATTTTAGAAAATTCTCCAATAATATACATTT
AAAGTCTTTTTAAGAAAACTTATAATATAATTATAGATATTTATATATTCTTATATATTT
CACAAATTATATTTTTAAGTTATTTTATATTATAATTATTTCATCAAAAGATAAAGGAG
ATTAAATGAAAACTTTAAATCAAAATTAGGTGATAATAGATTTACATTTGACTTAGTTT
ACACAGTTGTAGCCGTAGTAATGATGATAGCATACCCAGCTTATTTTATTTGGGGTTAAA
ATGAACTTCGTAACCAAAGATTATATGTTAACTGCAGAAATAGCGGATAAATTAAATATA
AGTATGACTAATATTTCAAATGGTATGTAAAATTTCCAGAGTCTGTTACTAATAAACAT
TTAGTAAGAATAGGTAATTGTGTGTTTGTTCACAGAGACTTTCCTAATTTAACTAAGAAT
ATGAAAATTATTTTTAATGAACCCAGAATAGATTGGAGTAATAAATTACCATTGAATTAT
ATGATTAAAAATTTTAAAATTAATGTTGCTTATTGTGAAAAATATAATATAGGTCATAAA
ACAAGTTATATTTTTAAAACACATAGAAATCGTGTAATTCAAAAAGATTTTTTTGCATTT
GACCCTAGTATTTTAAAATTATTAAAAGCTACTGAATTAGAATCAAGGAAGGTTGCTAGC
TTAAATTCAATTCAAGTTTCAAAGAATTACTTCATTTGTTTTTGATTATTTAAAGGAGTA
AAAATGGATTCAAAAAGCTTTATTAAAAAACAAGTTCTAAAAATCTTAAAAGTAACTAAT
ATAGAAGAAGAAATTCTTCATAAAATGTTCGTAGATGAAGGTGTTGATGCCGATTTCTTG
ATACAAGTTCTGAAAGATCTACATAAAGAATCTAAAATTAAAGTTCTAATTAAATCTGAT
AATTGCTTGTTTGAATGGGATTCTCACAAGCCTTATATTAAAGGTGTTTATTATATAACT
AGTAAAATGTAAACAAAGGTTCTAAATGACAATATATAGTTTTTCGAAAATAGATACATA
TAAAAAATGCCCAAAACAATATTATTATAGATATATTGAAAAGGTTCCAGAAACTCAAAA
GAACCCAGCATTAAAAAAAGGTTCTGATATACACGAAATACTTGAGTTTCATAACACTGA
AAAATACAATGAAGTTCTTAATTCAAAAGATCCAGAAATACAAAATATTACATTAAGATT
TATTGATTCTGAATTAGGAAAAGAAATACTATCCAGAAAATCTTTAAGAGAATATGAATT
ATTCTTAGATTCTAATTATGAACCTTGTAGCAAAGATACTGCTATTTTTGTAGGCTATAT
TGATAGAATTAATACGACTGAAAATGGATTAGAGCTTATAGATTATAAAACAGGTAAATA
TAAAGAACCATCTTATCAAGATTTTACACAATTAATTTTATATAGTTTATATATATTTAA
AAGACTTAAACTAAATGAAATAAAAATAAGATATGTTTATGTTGAACATCTTTTAGAAAA
TACTTTAAGTTTGTCTCAAGATTCTGCAATTTATTGGCAAGATAATCTTAATAATCAAAT
AAAATCTATTGAAAATTCTATTGAATCTAATACTTGGAATAGCAAACCAAATAAATTATG
TCCTTGGTGTCCTTATGCAGGATTATGTCCAGATTTTAAAGGTAAACCTAAATGTTAAAA
AATAATTTTAAAAAATTAAACGAATCATTTAGTTTAATATCTTTAACTGATGACCAAAAA
GCTAAATTAATATTTAAGAAAGATATTCGTTATAATATATGGGCTCAAATGAATCCAAAA
TTAGCTTATGAATACTTCTATAAAGATTTCAACAACCAACAAATTGTACCAAACGGTGTT
TTAGAATACCTGGGTATAACAACTAAACCAGAAATTAATGAAAAATTAGATTCGCAATTG
GAAATAATTATAAAACATTTAGAACCATTTCCAGTTTATGATTATCAAAAACAAGCTATA
AAAGATGCTATGCAATTTCATAAGTTATTCATTAGAGCAGCCACAGGTGCTGGTAAAAGC
GTCATTATTGGATTAATTGCTAAGATTCTAATATTAAAAAAATTAAAAGGTTTGATACTC
GTTCCCAACATTTCACTAACAAATCAATTTAATAATGATTTAATAAATTATAAATTGGAT
ATAGAAACAAGATTAATAGGTGGTGAAAATAATATTAAATCTTTTGATAAACCATTAACA
ATTAGTACTTGGCAATCTGTTAAAAACTTTAAAGAAGCCTTAAATGATTTAGATTTTATT
ATTGTAGATGAAGCACATACAGCCAAAGCAGATCAAATATTTGATATTTGTAATAAGTGT
ATTAATGCTAAGTATAAGATAGGTTTGACAGGGACTATTCCAGATAATGAAATAGATGCT
ATGAGATTAATAAGTATTTTTGGTTTACCAAGAACATATATTACACCCAGAGGTTTAATA
GATAGAGGTCTGGCTACAAATGCTATTATTAATATAATAGATCTTAAATATAAATTTAAT
TTTGAAGGTGAATATTCAAGCCAATTGAAACAATTAAAAGAATACGATCCAAGAAATAAT
TTAATTCAAAGAATAGGCGATACTGTAGTCAGCAAAGGTAACACTTTAGTATTATTTCT
CATACTGAACACGGTCTAACTTTATTTTATAAGTTCTTGAAATCCAGAGGATTAAACTAC
GATAAAAAGACTTATAAAGATTTGGCGTTTCAACAAAGAAATAATGTATTTTTTATTAAC
GGAATGATAGAAGGTTCGCAAAGGGAAACTATTAGACAATTAATAGATTCAGTAAACAAT
GCTATCGTAGTTGCTAATTATGCGACAACTTCAACCGGAGTAAATATTAAGAATTTACAT
AATTTAGTGCTTGCTAGTCCACTCAAAAGTTATGTCACAATAACTCAAAGTATTGGTAGA
TTATTAAGACTTCACGATTCTAAAGATATTGTTAATATATATGATATTGCTGATCACAAT
GGTTTTTTTAAGAAACAAATAAATGCTAGAATAACAAAATCTTATGAACCTGAAGGTTAT
GAAATAAAAAGATTTACTTACAATATATAATATTATATTTTAATTTTAAACTAAAGTTCT
AAAATTTCAGCAAGAATTAAGTTCAAATATATTTATAATTCTACATAGCTGTTTAAAAGGG
GATTGATAGTCACGGTGACGGTAAATACAATAAGGGTATTGTAGACCTAAGAGCTTCCTA
GCAGCTCAAACCTTTTTTACGGCTTAGATTAATTTTAAACTTAGATCTAAACTTGCTGCT
ATAGTGTTAAATCTTTAATTAGTTCTAAAGATTGACACTATAGTGTTAAATATGTACTTT
AGGTTTAAACTTAGAATTAATTTTAAAAGGAGATACAATGTTAATACAAGTTAACGAAAA
TACAACTGTTAAATTATCAGCAGTTTGTAATATTAATGTTTTGAAAGACAAACAAGTTTT
CAATATGTGTTATACTTTCACAGATAAAAAGGAGCAATGAGTGGTTATTATTATGTAGA
TAATAGTAATATAAACTATCAAAATTCTAAATACTTCAAAGAAAAATTCATAGCAGTTCG
TGGTATTGATAGATTAATATATATTAACACAGATTTTGTAAGCTTTATTAAAAAAGATTA
CGCAAATTACCCAAAAGTGTGTAATTGGTTTAGTCATAGTGTATTAAGACACAATGTCGA
ATCTTTTGCATTTGCACCCGAATATATGTATATTAGAACCAAACCTGAAGATTTAGATTC
```

FIG. 14AE. Continuation of (CJLB-12 [organism= Campylobacter phage CJLB-12] complete genome)

```
TACTTATGAACAAATCTTAGAAGCTATTACAAATATTTCAAAATAAGGAGGTAAAAATGA
GAGATGAATTTGATGATTTGTTAGCAAGCTTGTCAATAGAACCTGTTAAGAAACCTGAAA
TAGAATATCAAGAACCATTAGTTGTTAAACCTGCAAGCAACATAGAAGTTAATGGAGTAA
ACGAGCAAAACGCAGATTTAAATGATTTTGGTGATGTTCTTAACAGCATCGAATCAGGTG
TTAGTAATACCAGCAATAATAACGAAAATATGGTAGCTAGCTCAGATTCAGAAGCTTTTA
AGGAATATATAGATCTCAGAAATATTAAAAATGAATCAGATATTGAAGTTCCTGATTTAG
TGGATACAATGCATTTAGAAGAAGCGCCAAGTTTAATACCAGAAGCACCTAGTGAACATA
CAAATCAAACACAAGAATCAAAACCAAGTGGTTACGAAGTCCCAGATATCAAGGGAACTA
TCAAAAGGGTACCAGATGTTGACGATTCTGAAAATAATGTTTATAAATTAGAAACTGAAT
ATATTGATATTATATTAAGTTATGAAGAAGAATTAAAAGATCTTAAACGTCGTTTTAAAC
TTAATACATTAGAATATCAAGCAAAAGGTGTTCAGACTAGGTTAGTTATTAAAGCAGTTA
AACAAGCAGCCAAAGACGCTAAAAAAGAAGGTTATATTATTAAAGATGAAAATAGAATCC
AAGAAAGAATTAATAATGATTCTAATTTATTAGGAAGAATTTGTTCAATTATTAATTCAT
CAATCTAAAAGTTTAATAATATTTTAAGATATTTATATTATAATACACTAAAGTTTAAA
AGGAGATATATGGTTCACAAAGTGTTCAAGATTATTTTCTAAATGAATTAACTAATTAT
TCTTGTTATAGTACTTTAAGAATGATAGCTAGTTCTATTGATGGTTTAAAAAATTCAAGC
AGAAAAATCATTAACACAGCATTAGACAAAAAATTAAATACAGAAACTAAAGTTAGTATA
TTTGATAATATGGTTCAAAGTTATACACAATACTTGCACGGTTCGTGTTCAGGTGTTATT
CAAAATATGGCTGCAAGCTATACTGGTTCTAATAATATTCCATTGCTTGAAGGTAAAGGT
AATTTTGGTTCGAGGTTTATTAATGAGCCAGCAGCACCAAGATATGTTTATGTTAAAAAT
AAAAAATATATTAATGATTTATTTGATATTAAAGATGTCTTGATTTCTCAGAATTTTGAA
GGTTCAGAAATAGAACCAGTATTTTACGTTCCAAGTTTGCCTATACTAGTTTTAAATGGT
TCAATGAATGGTCTTGCTAGTGGTTTTAAACAGAATATTTTACCAAGATCTTTGGATTCA
GTAATAAAATATATTAAGACAGGTAATAAAGTTGATTTAAAGCCGTATATTGCAGGTTTT
AAAGGGGCTGTTGAATTAGTAGAAGATACCAGTTCTAATAATACACAATGGAACTTTATA
GGTGTTGTCGAAGTCAATAAAAATAAAGCAATTATAACAGAAATACCACCATTTATCGAG
TATACAAAATATCTCGAAATATTAGATAATCTTGTAGAGACTAAAAAGATTAAAAATTAT
AAAGACTTGTCAGACCAAAGAAACCAAGAATTTAAATTCGAAGTTATATTTTCGATAAT
ATCTCTAAAGAGAAAGCTATCGATATATTAAAATTATCTAAAAGAGAAACAGAAATATAT
AATGCTTTGGATGAAAATAATCAAGTCAGAACTTTTGAAAATATTGAATCTATAATTGAT
TATTACATAGACGTTAGAAAAAGATTTTTGGTTAAACAAAAAGATTTTGATTTAAAAGTT
CTTGAAAATGATTTAAATATTAATATTCAAAAATTAAGATTTGTTAAATTAATCATTGAT
TCAGAGTTACAATTATGAAAAGATCTAAAAAGGATATTGAATTGGATCTTGAAAGTAAA
GAGTTTATTAAGTTTGAGAATAGTTATGATTATTTGCTTAAGTTACCAATACATTCGTTT
ACAAACGAAACTTTTGAAAAATTAGTACAAAATGCTAAAGAAATCAAAGCTAAATTTGAA
ACATTAAAAAATCTGGATACATTTAAAAATTATGTCGAATCTTTAGATTCTATTAAGAAC
ATATTAACTAAAGCTTAAGAGGAGTTAAAATGAGATACGAAGCTATAAACAATAAAACAA
AAATTGAGGATTCTGAATTGGATATTATATCTACAAAAGATACGAGGCATTCATTATACA
AAAAAAGTTTTAATTATACTAATTATACTTTAAATATCAATTCATTTGATCACGAAGAAG
GTGAATTAGAAAATATTTTTGCTGATCTTAATGACGCTAATGAAGGTGATTCTATACAAA
TCTTTATAGCCAGTGTGGGTGGTTTTGCTAATGAACTTAATAGATTACAAATATAATTA
GAACAAAGTTCTATGGTAATGTAACAACAGTATTAAACCCATTTGGATATTCTTGTGGTG
CTATGATGTTCTTAATTGGTAATTCACGTGTAATTTATGAGAACTCAAGTATTATGTTCC
ATTCAGTAAGTTTTGGAGTTTCTGGTAAACATTCGGATGTTAAAACGCAATTTGATTTTT
CTAATAAGTATTGGAATGAATATATGAAGTCATTATTAAATCCATATCTTACCAAGAAAG
AAATTGAATTATTAATAGATGGTGTTGAGTTTTGGTTCGATGCTTATGAAATGTGTAAAC
GTGGTATTGCTACTCATATTAATGTTTTGGTTTAAGTATGAAAGCAGATGCTTATTGTG
AGTACATAGATAATTTAGATTATAGAATAGAGTTTCTTGAATATATTATTAAAGAAGGTG
ACCTTGATTCTATTGATTTACAAAGGGCTGAAATTGAGTTAGAACAAGCTAAAAAGATG
CTAAGAAAGCCAGCACTACTAAAACTACTAAAACTCTAAAACTACTAAAACTACTAAAAC
CACTACTAATAATGAAATTGAGTCTAAAGATCTTAGCTAAGATCTTTAGGCTTTAAGAAT
CTTTTTAGTTCAGCTATATTATAATCATATATAACACCTAAGGTAATAAAAATATGAAAT
AACAATCTTTGGAACTGCAAGTAAAAATGAAAAGTTTGCTAAGTCGCCATACGATGACAA
TTCTTTTATTTTGAAACAATTGAAGTCCAAACGACTTACCAAGCATTTCAACTACTTGT
TAATAATTTTTGTTTAAATATTGCCTTAGACTTAAAAGGACCTGGCAAATCCAGAAGATT
AAAAACAGATTTAGAACCTCATATAATTAAAACATTTGATCATTTATTATTTGATTTTGA
ATGCAAATCAGAGTTTAATAAAAATATGGCATTAGACTATTTTAAGAGCACACAATGCAC
TATCGGTCAATCCAGATCTTATGATGGTGTTAATAATTTTAATTTAAAAGGTATTATTAA
AACAGCTCCAATGAGCTTAAAAGAACTAAAAGTTTTGCAAGCTAAAATTCAAAAAGAACT
TTCTGAGTATGGTAAATATACTACTGATACATTAAGAATAACTTATTATACAGCGCCTTT
GAATAAAGATAATATACTCTTGGATAACCCAAACGGTTCTATGTTAATGCCTATAGGTAC
GAATGTTACAGATTACTATAATAACATAGATTTAGATTTGTAAATTTAATATTACCTCTAA
AGAAACTACTGAAATATGCAAAACAATTTTTAAGAACCTGGGTTTATCTTAGTAGATAT
CAATGCTAATGGTTCTATAAAATACACAAAAGATTCTGAAAATTATATTTGGTACCCAAA
TAATCCATATATTATGAATCATACTGAAAGTTATATGTCAGTAAATATTTGGAAAGAAGC
TATAAAATATGAACCTACTTTTGATATAACTCCTTATATAGATTATAAAGCAGATATTGT
```

FIG. 14AF. Continuation of (CJLB-12 [organism= Campylobacter phage CJLB-12] complete genome)

```
AGTTGATAGAAACTTTACAGAAATTAAGTCTGAATTAGATTCAATTGTAGAAGCTTTTTT
GTTTAAGCATAATGGTGCTCTGACTTTGAGAGCTCCTATGGGTTCGGGTAAAACAACTTT
TATAGATAGAATTATAGAAGCAGCACTAGAGAGAGATTTTAAGGTTGCAATTATAACTAA
TAGAGTTACGTTAGCAGAAGATTACAAAAGAAAATATAAGAAGTTTTTATATTATAAAGA
TTATACTGATGCTATTAAAGCCAAAAATAACAAAAAACCAAAAATAGTTAGATCAAAAGG
TAAATCCTTAATTTGTCAATACGACAGTTTTTAGACATTTTGATTTAGATGACTACGACCT
AATTATACTCGATGAGTTTATGAGTTTATTAATGCATACAAGATCTGCATTGAATAGTAA
AACAGAGAACTTAATAAAATTCTATACTGCTTTAAATAAAAAAGTTGTTGTAGCTGATGC
ATTTTTAAGTAAATACATTGTGGACAATATGTTTACTAAACCTTTAAATGTTGTTAGCTA
TACAAAAAATAATACAGAACTTTATAGTTGCAATGACAGCAATACCTTTTATACATTAAT
TAAAAATGCTTTAGATTCTAATAAAAAAATAACTATTTCTACAACTAGTATAAAAGTTGT
TGATATTATTAAACAAATGTGTTATATACTAAATAAAAAAATAATTATTTTTAATAAAGA
AACCGGCTCAGTATCAAAAAATATTATATATGATAAAATTAGGTCTAAAGAAGCGCTAGA
TTGTGATGTCTTTATTTACACTCCAGTGTTAACTGTAGGAGTTAACATTCTGAATGATGT
TGATATACATTTTCATTATGATAGTGCAAGTTCTACAGACGTTATTAGTTCTTTACAAAT
GTTAGGCAGAGCAAGATTTTCCAAAAAGATAATTTACTATGTTATGAACAAAAAATATAA
TGCTTGTATTAATTATGATTTATTAAAAACTACTGTAGAAAAAAGCCTAAGGAGCATAC
TGATGATTCTAAAGACAGAGATGTTGAATATAAGAGGGACTTGTTAAAAATCTTTTATA
TCATTTTCACGTACCACCTGGCAAGATTATCAAGAATTAAGCCATATTGGTAAAGCTTG
TCTAAAAGTAGACGTTTTTAACAATATGACTTTATGTGACTATAAAAAATCTTTTGATGT
TTATTAAGTTTTAATTTCAGTAAGATACCTATTGAATTAAGAAAAATAGGTGGTGATAT
TTTGAAATTAATGAATATTAAAATACAGGATTCGAAAGATTCCGAGCTTTAGTTTAAGTT
TAAAGCTTTAGTTTAAGTTTAAAATTAGTCCAAATATATTATAATTAAAAAATCAAATAA
AGGAGTTGAAATGCAATTAATAGATGGCTATTACACAGATTCTAATAACAATAAATGGGA
TTCTTCTATGTATACTGAAGAACAAGCGAAAGAAGCTTCTGAGTCTTTAGTAGTTTGTAA
AGATTGTTTAAATTGTTTCAATTGTATTGATTGTTATAAATGTATTGATTGTATTGATTG
TTATAAATGCCGCGTTTCTAAAGATTGTATTGATTGTAAATCTTGTATTGATTGTATTGA
TTGTTATAAATGCCAAGGTTGCTTTAAATGCCATAAATGCGTTTATTGTTTGGATTGTCA
CGAATGTGTGGATTGCAAGAGGTGTCGAGCTTCTATAGATTGTTTGAATTGCATTGAGTG
TGCGAATACTTCGAATGAATCACATACTCGAAAATCACATACAGTATTAAAAATATATAA
AATCTTAAATGCATAAAATCACAGATTCATAAATAAACTAAAAGGTGATAATGATTTATA
TTACAAGTGATTTACATATATCTCATCAAAATATTATAAAATATACTGGTAGGTATATTG
ATGATGCTTTAGAATATTCAAAAGAAGTTCATAAGTATTTTAAATCTGTTTTAAAAGATT
CTGATATTTTAATGTTTTTAGGAGATTTAGATTGTGGTCCTAATAAAAATATAGAATTCT
TAAGACACTTTATTAGTTCATTACCAAGCAAAAAAATTTTTGTAAGAGGTAACCACGACA
AGTGGTTAGATACTGAAAGTATTTTATATATTGGATTTAGTGCAGTTTCTGATATCATTA
GATATAAAGATACTTTGTTTTGTCATTATCCGTTAGATTCAAAATCAGTAATACCTAAAG
AAGCTCCAGAGTTTTTAAAATCATATGATTTAACTGGTATTAAAAAAATATATCACGGCC
ATACTCACAATAATTGGATAGTGGATTCTAAAGATGGTATTGAAAGAATTAATTGTTGTA
TAGACAGAAATCCAGAAGTTATTGGTGCTTTGATACCATTCGAGCCTAAGACTTAAAAGC
TTAAAATAAAAGGATATTAAATGAATAAAGTTTCTGAAGTTAAAAAAGTTACAAGAGTTT
TCCAAGGAAAATCTGTGTATGATTGTTTAGTTCGTTGGAATGATGCTAATAAATTTGTGC
CTTGTACAGTTGATATTCAAAATCCAGGTGACCTGAAGCCATTAGCAGATTACTTACTTA
AACATAATCTTATCTCTGGTCTTTAATAAAAGACCTTACCAAGGTTCGTGATGCATAGTG
ATGTTATCCAAACTCTAAGTTCAGCAGGCGCTTACTTACCTAATGACACTATATGTCCTA
GAGCAAAACTAGACACTGGCACATACTGCAACTATCGTTGTTATTTTGCTATTACCAAA
ATGAGTTAGATAAAAGACACCATTTGAAGTCATTAAAAAAAGAATAGATACTTTGTATA
GTATAGGTTGTAGAGATTTTGATTTAAGTGGAGGCGAATCTTCCATACACCCAGATTTCT
TTAAAATCCTAGAATATATTAAATCTTTGAATCCAGATAATAAAATATCTTGTTTGACAA
ATGGATCTAAATTTCAGAATAAAGATTTTCTTAAAAAAGCAAAATCTTGGGTTATCTG
AAATATTATTTTCATTACATAGTGTTAATGAAACTCACGATAAAATAACTGGGATAAAAA
ATTCTTATAATTATATAATTAAAGCTATTCATAATGCAAAGGATCTTGATATTGTTGTTA
GATTAAATTCAACTATTACTGATGTAAATTATAAATTAGTTGATACTGAATATTTCGAAG
TTGTTGAAAATTAGAACCACTTGAAATGAATTTTCTACCATTGAATTATTTAGTCAGA
ATTCAAAATCAAAGGTGTTAATTATTCTGAGATTTTAGAACCTATAAAAGATTTGTAG
ATTCATCAAGTATACCTTTGATCAATGTCCGATATGTCCCGTTTTGTTATATGACTGGT
ATGAGAAATACGTTGTAGGATATTATCAGCACATCTATGATATTTACGATTGGAATATTG
CTATGTATGAATACTTAGAACCTAATTTAGTAAATTTAGCAAAACAAGCTGCATCTAATA
GACAAAAAGTTATAGGAAATGTGATGCTTGTAGAACTTGTAAGTATTTTTATATCTGTG
ATGGTATTGAGCCTCAAGTTCTTAAAGCAGGTTGTGAATTTAAACCTATTCAAGGTTCTA
AAATAAAAGATGTTAATACATTTAGAAAATCATTCTTTAATTTTTATAGTTTATAGTTTT
TGACCTTAAACTTTAGATTTTTAAACTATAGTTTTATTTTTTTTAACATTTTAAAAGGAG
TGTAATGGATATTTCATTAATTATAGGACCTATGAGATCTGGGAATCACTTGAATTGTT
AAGACAAGCAGAGAAACTTCATTTTAGTGACAAACCTTATGTTTTATATAGACCCAAAAC
TGACACAAGGGATTTTATATCAAGAAGTTTTAGACCTAGTTTAGACTTAAATATACAATA
CTATAGCAATGAAAACTTCAGTGAATCTAAATATGATTATATATTATTAGATGAATTTCA
```

FIG. 14AG. Continuation of (CJLB-12 [organism= Campylobacter phage CJLB-12] complete genome)

```
ATTTTTTGAACCTGAAATTATTAATAATATATTAGAATCTAATAAAACATTTGTTTTATG
TGCTTTACAAAGTGGTACTAATAATATCAATGAACCTTATAATGTAGAAGTCTTTAGAAA
TGTCAATAGAATTATGCCATTTTGTAGTGATATTAGATTGTTAACTAGTATATGTGAAAA
TTGTGGCAGTTCTTGTGCTACACACAGTTATACCGATGTTATCACTGTTTCTGATAATTA
TAAGATTCTTTGTAATAATTGTTTAGATTTTAAGATTTCAAATGCTGGTATTTTTAAGAG
ATTAAAAACTTGAAGCAAAACTTAAATACTAAAAAGCATAAAAAATGCTTAAGTTTTTAG
TAGGTATATACTATAGTATAAGTCTAAAACTTAAAGCAATATTAAAAAGTATAAAAAATG
CTTAAGTTTTTAGTAGGTATATACTATAGTATAAGTCTAAAACTTAAAGCAATATTAAAA
AGTATAAAAAATGCTTAAGTTTTTAGTAGGTATATACTATAGTATAAGTCTAAAACTTAA
AGCAATATTAAAAAGTATAAAAAATGCTTGGCTTTTTAATAGTATATACTATAGTATTAT
ATCTAAAACTTAAAGCAATATTAAAAAGTATAAAAAATGCTTGCGTTTTAGTAGTATATA
CTATATATACTGCTATATATACTATAGTATTATATCTGAAACTTAAAGCAATATTAAAAA
GTATAAAAAATGCTTGGATATTTCATAGTATATAGCACTTAATGATACTATTGATGAAGT
TTAAAAAGTATAAAAAATGCTTGGATATTTCATAGTATATACTATAGTATTAATATTCGC
TTAAAATTTTAAGTATATTTTAAGTATTTTCATAATATAATACTATCAATAGAATAAACA
AAGGTTAAAACAATGAATAAAACCGATAAATGATTGAAGCTATCGAGGATACACTATT
AAGTCCGGAAATTTAGGAACACATTTCTATGTTTTAGAAACTATAAAAGGATTTAATTT
CAGTATTAAGTTCGATAAAATAAATAGCTCTATTAAATATTTTACTAAAAGTAAACCAAT
TAATTTTGAATCTAATAAAAGTCCAAAAATTAAAGCACTTAATGATACTATTGATGAAGT
TAGTTTAATTAACAAATTGGTTGAATTGATTAATATTAAATACCCAGAAGATGACCATAT
TGAGTTCTTTTTGACATTATTTCCTATTGGAGTAAGCAAGTCTAATGATTCTGATACCGC
AGGATATGCAGTCATAATGTATGACATTTTAGTCGAATCCAAATATGAAGATTTTGATAA
TGTTTTAGATTATTGCACTTTAGCTGGTATCAAAACGAATCCAATTATTAGAATTGCAAC
TGATTTAGATTCTGCTTTAAGTGTTCCTGTAAATGGTGATTCTATGATTCCATATCTTTT
CAATAATAGTTCGGAGTCGATACCTATGTATGGCATCACCATCAGACCTTATAAGGAATT
GCAATACAAATTAAGATCTAAAACTCATAGACTTATTATTGATCTTGATGAGTCTAATAT
GCCAGTAGGTTCTAAAACTGAAGATTCAGAATTTCTTAAATTTTTAAACATAGAATCATT
AAATGTTGTAAAATCTCAAATCCAAAAAATTTAGAAACAGAGCTAATATATTATATAAT
AGAAAAAATAAATGAAATAAAACACTTAAGTGTAGAAGAAATTAAAAATCTAAAATCAAA
GTACTCACAAAGAGTTAAAGATTTCATCTCTGTGAACTAAAACACTAAAATGTTAAGTTT
AAAGAACTAAAATATAAATCGAAGAACGAAAGGTGTAAAAATTGTCTATGAAATTTTTG
TAACCGGATCCAGTGGTTTCCTAGGATCTAACTTTATTAAAATACTATATTCATTGGATT
CAAATCCAAGAGTAATTGGCTTAGATGTAAATCCAGGCGAATATACTGATAGTACACAAG
GTATTAAAAATGCTAAGAAATCTGGGTTGCTTAAAAACTTAATTAAAAATAGTGATATAG
TTGTTCATTTTGCAAGCCATTTAGGCGTTCAAAATATTGTAGACAACCCAAACTTACCTT
TTAAATCTTTTAAAAATGATAAAATTGTTGTAGACTTAGCCACTAAATACAATAAAAAGA
TTGTATATTTTTCTACTTCTGAAGTATATGGTGATTCTAAAGATTACTCAGAATCCAGTG
ATTTAATTATAAGTTCTAAATTAAGATCTAATTATGCTTTAGAAAAACTTTTTATGGAAA
GATATATCCAATCAAAAACAAATAATTATTTAATAATAAGACCTTTTAATGTTTACGGTC
CTGGTCAAAATCCAAATAATGGATTCATTGCTAAAGTATTAGCAGCAGCTTTCAATCCTA
AAGAAGTGATTAAAATCAGAGTCGATGCTGAGCCAAAAACAGGGACTGAAAGATGCTATT
GTTATGTAGATGACTTTAATAAAATTCTTTATAAATTAATTAAACAAAATGTCAGCGGTG
TGTTTAACATAGGAAATCCTATGGCTAGAGCAAATCCATTAAATATCATAAAAATATTCA
ATGATTTTGGGTATAATATAAAATATAAATTCGAAACTATTGAAAATGAAAATGATTATG
AAATACAAAGACGAGTTCCTAGTATTGTTAAATTAAGCGAAGTTGTTCATATCGATTTTA
CAAATTTAAAAACTGGTATTAAAAATATTTTGTATTATATTGACCCACCATTTTGAGATA
AAATTTAAAACCTAAAATCAACAAGGAGTAAATATGCTAAAACATTTAATAATTGCAGGT
CATCCAGATGATGAGGTAATTGGTTGTAGTTCTATACTACTAGAAGATTCTGTTGGTGTT
CTATACATCACAAATGATTATAGTACTGCTAACACAGAACGTAATAAAGTCAAAGATAAA
TTAGCTTTGGATTATCAAAAATGTTTAAAATATTCATTTTTTAAAATGCCTGATATTAAT
GAATTAGCTGATAATATTAAAGACGTTTTAGACTCCATTAAACCAGAAAATGTTTATGTT
CACCATCCAAAAGATTTGCATCAAGATCATAATACTATTACAAAAGCAACCCTAATAGCT
GCTAGAATGAATAGAAATGATTATATTAAATCTTTAAGTTATTATTATGTTGAAAATCCA
TTTGAATTAAAAGCTTGTGAATTTAAAAAAATAGATAAAGATGAAAAACTTAAGTTTTTA
TCTAAATATAAAAAGTATATACCAGAAAATCATATCAAAACTATTTTAGCTTTTAATGAG
TTCGTAGGGATTTATAGCAATTTAGGTTTTGCGGAGCCGTTTGAAGTTGTTTATAAGCGT
TCTTAATTACATTAAATCTAAGAAAACCAAGGAAAATAATGAGTGAAATTATAATGATTC
ACGAAGTAAATGATAAAGTTCTCAAAGCTGTAGAATCTTTAGACCCAGACAGCATAATCA
CATTTGATGATGGTTTATATACACAATTTCATTATAGAAGTCATTTGCGTTATTTAAAC
GTGTTATATTCTTTGTAAATCCGTCCATAATTTGCGAATCTTCCGAGAAACAATCTAAAG
AGTATATACAGTGCTATAACGCCCATAAAAAGGCATTTAAAGGCTGTTTTGAAAATTATA
TGACATTAGATCAAATTCAGCAAATTTCAAGGGAAAATATGTATAATTTTGAAATAGGTT
CACATTCTTATAATCATAAATATTTTAAAGATTCTAAATCTTTAATAAAAGATATTCAAG
ATTCTTTAGATTTTTTGAGAATCATAATATACCTATTAAATCATTTTGTTTCCGTATA
ATCAAGATTCGAGAAACCCACATTTACCCAAGCAGTTAAACTAAAGTTTAAAGATTTGG
ATATTTTGGTAATAACAGAGTACCTATCGAATCTAAGTTCTAAATATTAAATATTAGAC
```

FIG. 14AH. Continuation of (CJLB-12 [organism= Campylobacter phage CJLB-12] complete genome)

```
TAAAGTCTTAGATTTTAGACTTTAACAATACAGCAAATTAAGGAGCTTAAGTGAAAAATA
TTAAAGTTAAATTAATAGCAGATTCTGGTATCAATGTTTTTATTGACGCTGTCAGAACTT
GCTGGGATAGTCATAGTAAATGTGATACTAATGGTGATAATGTAGGAGAAAATGATAAAG
CATTAATAGATAGAATAGTACACAAACATAAACACCATTCTACATTAGAACATTTGTTTT
ATAATTTTGAAATCACAGGAATTTCAAGACTTTGTTTGCAAGAGTTGGCAAGACACAGAA
TGGCTTCATTCAGTGTTAAGAGTACAAGATATACACTAAAAGAACTTAGAGGTGCTGATA
TTTCTACATTAGAAGATGCAAGTAAGTTTATTGTTTTAACTGATAATGAATTAGTAGATG
CTGCAAGCCACAAAAACTTAAAAGAACTTCATAACATAGTCAATACAAACGGTATTACCC
AAGACTACGCCAAGTATTGTTTACCAGAATGTTACAGAACTTCATTAAGATTTTCTTTAA
ATGCTAGAAGTTTAAGAAATCTATTAGAACTAAGATTATCTAAAGGTGCTCATTTCGAGA
TTCGGTATTTGGCTAAATTGTTGTTTGATGCATTACCAGATCTACACAAAGAATTAATTT
TCAATGATTTAGAATATTCAGAATAAACATAAGGAGTTAAAATGTATGTTACAAAAGAAG
TAGACGTAGAAGTTGAAGTTGAATTAGATGAATTAAAGACAATGACGTCTTAAGATATG
CTAGGGATTTAATTGAAGTCGATAAATCTAAAATAGTATTTTTTGAGGGTCTTATAGAAC
CAGAATTTAATTTTGATTTTTTAAATGATTTATATAATATAGAATACAAAAAAAATTATT
TTGAATCATTTCCTAAGCATAAAAAATTAATTGATTTCATAAAAGATAGATATATAAATA
ATTATAAAAATTATAAATAAAAGAAAGGAGTTTAGAATGTTATCTAGAAAGATAAGAAT
TGATAGTTTATATCTGATGCAGAAAAATCAGAAATATTTCAATATTCTAAATCCCTTTC
TGCTGTCTATAACGTATGTCTTGATACGCTCAAAGAAAATTTAAATTTTAAAGATTTATC
TAAAATCACAAAAGGTAGGTCTAAAACAACAGGCTTGCATTCAAAACATATACAGAATAC
CTCTAGAGAGGTTATAAATGCTGTAAAATCTTATCTAGCAAAAAAGAAAACAGATAAAAC
TGTTAGATTTCCAAAATTATATAGAGAATATAGTCCTATCATTATGGATATAAATCTTTC
TTCTAAGATTGTAGAGGTTGTTAATTCTGAAACAGGAGAGGTAACTCTTGTAAAGAAATA
TTGTCCAGGCGGGGATTTAAACTAGAAGGTAAGAAAATAAACTTTACTTCAATAGGATT
TGAATTAGATTTAAGTAAATGCCCTTACTATGATATAGAACTTATCAACTATGAGCTTT
AAAACAGATAGTCATCAAGATTGATGAGAATAAGAGAATAGATTGTATTTTTGTTTCTC
AGAGAAAAACAAGAAAAAGCACTAAATCAAAATTTTCTTTCTATAGATCTAGGAATAAG
CAGTACAGCATCTTGCTACTCAAATAAGATTGATTGTCTGAAGATACAAACTAAGAGATT
TAAAGGTTTAGAAAGAGCTATAAATGAACTTAAGTCTAAAAGAGATAAGAAGAAGAAAGG
TTCAAGAGCATATAAGAAACTTAACAAAACAATCAGAAGAAAGCAAGCAAAACTAACTAA
TAAAAGAAAAGACTATCTCCATAAGACCTCAAAAACTATGGTAGATCTCTGCATTCTTAA
TGGTATAGATAACATCATTTGTGGAGATATCAAGACTAAAAAATTAAAGAAAGACTATAA
AACAAGTTTAAACAAATCAACTCAAAATGAAGGACTATTGAGTAGATTTAAGGGTTTCTT
AAAGTATAAAGCAGAGAATAAAGGGTTGAACTTTTTACTTGTGAATGAAGCATATACTTC
TCAGACTAACTGTCTTACAGGAAAAAGAGAACTAGACTCGAATCTTAGTATTAGAGAGGT
AGAATTAAGTCCAGGTTTCAAAGTTGATAGAGATATAAATTCAGCTGTCAATATAGCCAA
AATATGTGGGGATTTATGGTTATCCCATATCTTTGAGAAGAATAGACTTCTCAAGATACA
AAAAATGAATATTACTTTGTAATATTTGATTAAATTCTTGTAGATTTCTATAAGAATTTA
AAAATCATAAAAGCTAATTATTGATTTTAAACCAAGGATTTTAATGAACGTTTTATATAA
TAATGAATATATTGATTTTACAAAAGAACCTTTATTTTTTGGAACAGGTAAAAACTCACA
AAGATATGATGTTATAAAATATCCTATCTTTGAAACTTTGTTTAAGAAAATGGCTGGTTT
TGATTGGCAAGAAGATGAAGTACAGTGCACTAAAGATCAAGCAGATTTCAATATCTTAAA
TGAAGCAATGAAACATTCTTATACTAGAGTGTTAAACAAGTTAATTTTCTTAGATTCTAT
TCAAGGCAGGGGTTTATTACAAACTATTGGATCTATTGTTACTAACCCAGAACTAGAAGT
TTGTATGACAGAATGGCAAAGATTTGAAATTTCAAGACATTCAAGAAGTTACACTCATAT
TCTTAGATCTGTTTATGCTAACCCAAGTAAGATATTTGATGAATCTTTTGAAATACCAGA
ATTATTAGAACTTGCAGATAGTATTTCAAAACCATATGAAGAAGCTTTTGAAGCTGTAAC
AAAGTATCATTTAGGATTAATAGATACTGAAGAAGTTAAAGTAAAAGTTCTTAATATGTT
AGTCGAAATTAATATATTAGAAGGTGTTAGATTTTATTCTGACAATTTGGAG
TATGCATTATAGCCAAGGGTTAATGGAAAGAACTGGCAAGATTTTACAATTAATTTGTAG
AGATGAAAACCTACACTTAGCAATAACTCAAAATCTAATTAAGATATTGTCAAGATCTCC
TGAAGAAGGCTTTATAAATGCTTGGAATTCTATTAAAGATAATATAACTGATAGATATTT
AGAAGCTGCTGATCAAGAGTTTAAGTGGATTGATTATTTGTTTAGTAAAGGTGCTTTCTT
AGGTATGACACCAGAATTAGCCAAGAATTATATTAAATATCTTATTAATAAAAGATTAAA
AGCTATTGGATTCAAAGAAGTTTTTGCTGGGTTTAATAAGAACCCTATACCTTGGGTGGA
AACATATATTAATTATGATAAAAATGAAGTTCTCCCGCAAGAATCTGAAATAACAAATTA
TAAAATGGATATTTTAGACACTGAAATTAAAGATTCTGCTTTTGAAAGACTTAAGAAGAA
ATTAAAAATCTAAATTTAATGCTTTGATGATATTTACTAGATCTGTAGTATTAAACTTAG
TTCGTTTGTACTTTAGATCTAAATTTAACACTAAGTGTAAACTTCTAAGCTTGATAAATG
TATAAAATATTTAAAAAAATAATTTTATTTTAAGTTTATTATTATAAAATTATATAAAAT
TAAAAGGAGCAAAAATGAAAGATTTAACAACAAAGTTTATTAATATTATGTTGAATAACA
GCTACGATGAAGCTCTACACAACAAAATACAAGAAAAATTATTTAGTTCCGATTTACAAT
GTTCAAATTGTGACACAGGTTTTGAATCATTTAGACTTGAACTCAATTGTTCAATTGATG
AACTCAAATCAAAATTATTAGGTTGTGGATATCTTGACGACACTGACGAGGATTTGTGGG
ACTTTTTAAGTTAAAAGATTCTGATGGTGATTCACAATGGGATAATTACGTTTACAGTT
TACCTTCATCTATAAGAGAGTTAAGCAGCACTACATTTAGAATTAAAGACGGAAATACTA
```

FIG. 14AI. Continuation of (CJLB-12 [organism= Campylobacter phage CJLB-12] complete genome)

```
TTGTTTTCTACGATATGGTTTGGGGTAACGAACAAACTTGCCATTTGACTTTTAAGAACT
AGTAAATATTACACTTTAGTGTTAACGAACTTAAACGACACTAAAGTGTAAACTTCTAAG
TTTGCTAGTACTATTGAATATCAGTATCCTTGAATCTTGATAAAATCAATTTTGTAATAT
AAAATTGTGAACTTTCTATTTTATCTATAAACCCAGTTAAAATATACTCACCAGAAATTT
TAGTGTCTCCTTCTTGTGTTTCATTAGTATTTTCGTTAGATTTAAATAATACTTTGTATT
TTGTGAATATTTCTGGTGCCTTAACAACTCCAGGTACTACTAATTCTAACTTAGAATAAT
CTAAAAACGATTTATAAGTATCAGCAAAAATATTATCATCGTACAAATATTCTTGAGCTT
GATATTCAAAACCATCGTGATCTTGAGATTCTACTGGAACATCGAAATCTAAATCTTCAA
GATTAATTTTCATAACTTTCATTGTTTTAGTAGCTTTATCAAATGCGATTATTTGTGATT
TCGGTAATTTCAGAGCTTGGTTTGTGTTTATAATCTTCCTAGATAAAATATCATAAGGGT
TGTTAGGATCTTTTTTAAAATCATCATATTGTATATTTTGAAGTTTTAAATTATTTGGTT
TGAGTTCTTTATAAGGTTTCATAATAATTTTTTGTTTATCTTGAATAATATCAATCCTT
GTCTATCACATTCTTCAAATATGAAATCCAATACAGATTTTCGTGAAGTTAAAACGAAGT
TTTCAATTACGATGTTGCTAGATAATTCCAATTTAACAGAATCTGGATTATATTTTAATT
TTGGTTTAATATAAGTATCATATATATCTTTAAAAATATCTGAAAGTTTTTTATTTTTAT
ATGTTTTAGCTATATATAATTTACTAAACAAATAAGATATTAAATCTTGACCTTGTATTG
TAAAACTGGATTTATCAGTTGTTTGAGTTTTATTATTTTTAACAACTTGAAACTCTCTTC
TATAGTAACCTTCACTAGCATCTAATATAAAAGGAATAAATCGCATATCGCCGGATTGAT
CTAAATAGTATTGTAAATCCGTGGTACCATTGACTGTAAAATAAGACAAGATGATAAAAC
CATTGAATGAGATTTCACCAGATTTGTTTCTCCAGTTTTTAATTCAAGTGATTTACTTG
ATTTATTATTAAGAATAGATAAAGTAAAATCTTTGACATCACAAGCGTGAGAAAATAGAC
TTTGAGTTCCCGGATTCATTAGAACCTACCAAATACATCATCAGAATTTGTATAAAAATC
TTTTGTTTCTTGTTGTTGTTTATCTTTAATAGAACTCAATTCATCGAAATATTTTTCAAG
CTCGTTATGCATATCTGTATTAGGTGTTTGCTTGTCTAATAATTCGTCAGATCTAATAAC
AAAATCACTTTCAAGTTCATCAGATTTTTTAAATACATAAGTTTTACATTTAAATTTATA
AACATTTTTATATTGATTATAAAGAAATACGTTATTTAACCCAAAACAATCTAACGTAAT
TTCGGTAATTTCAAGAATCTTTCCACTTGGAACGATTATTAAAGATCCTATTAAATCGTG
AATTCTGGAATCTGGTAAAGTTACATCGTATTCATTCTTAGAATTCATTGAAGATTGAAC
TAAATTAAATGTGGAAATTTTAGAAACATATAAACCTATACTTGTATCTAATGGGACACC
AAATTGTGTTTGCAATCTTTCATATTGGTCAAACTCTTCTGAATTTTCTGGCATACCAAA
TATTTCAAAACAAGCTCTATTGTCCGCTTTAAAATGACTAAAATCACCAAATGTTAAATC
CCTGTTAATTTTTTTGGTAATGATTAATTTAAGTGGAGCACCATAAAGTCTAATGAGTTC
TTCGGTAACAGATCCACTCAGATCATATTCATTAGTATGCTGGTTAAAATTCAATTTTAA
AGCCTCATTTTTGATATATTTATTTTAAGTAATCAAAATAAATAAAATCAAAAGGTTCAA
GATGGACAGCACAGATAATTCTAAAGTTACAAGTATTGAAACAAATCAATATATAAAAAA
TCCAAAATATACTACAAAGGAAGCTATTGATAAATTTGTTCACCTATTGATCCTGGGTAG
ATACACTGAAAAGATTTATCAGATGCTTTGAACTATTGCTTAATACGTAGTACAGAAAG
TTTTGACAGCATAGATTCTATAAAAAAAGCTATAGAAGAACTTAAGAAAGATTCAGAAGC
TTTTAAAATATTCATAGATAATACAAATAAACTTTTAGATGCTATCCAAGATATTAATAA
AGAACAAACTGCTGAAATTGATAAAATTAATGAATTCTTAAAAACAGCAGTAACTTTAGA
TACTGAACAGACTATTGTAGGAACTAAAACATTTAATAAGATTTATGTTCCAAATCCTAC
AGAATCTAAACAAGCTGCTAACGCTCAGTATGTTATAGATTATGTTAAAGATCAATTAAG
TAAAACTATTGGAGATTTAAATAATTTAAAAACTGAATCTAAAGATTTAATTATTAATGC
TATTAACGAAGTTCTTGACAATTTAAATGCTTATAAAGAAACTATAAATGAAACTGCTAT
TAATCAAATGATTGATACTAAGTTAAATCCATTAATAGAAAGAATCACGACAATTGAATC
TACTGCGGATTACACCAAAGAATTAGCAGAAGCTAATAAGCAAGCTATTGAAGATTTAAA
TACAAAAGTAGTTGATAATACTAGTGATATAACGGATATCAATAGAAGACTTGAAGAAGC
TGTTTTCTATAGTAAAATTGATGATACTCGCAAAACTATACAACTTAAAAATTATGATAG
CATTTCCGGTGTTAGTACTACTGGTGAAGGTATCAATATTGCTATGGTTTCTAAATGGGA
TAAAGTAGATTTAGGATCTACCCAAATTCCTATTAACTTAAATGGGTCAGAAACCAGACC
AACTTATAACGATTCTAAAGAAATAGCTTTAATGGATGATGTTAAGTTGAAAGCAGATGC
TAGCAATGTTTATAATAAATCTGAAATTGATACTAAATTAGATACTAAAGCAGATTCAAA
TACAGTTTATAATAAAGAAGATTCTGACGCTAGATTTGTTAGTTTAACTGAGAATCAAAA
CATTCAAGGCAATAAAGTTATAGAAGGTATTTGGGAATTTAATGGAATATTGTCTAAACC
AAAACAATTAGCAACTACCGAATATGTGGTAAATTATGCTAAAACATATGCTAACCAAAA
AGTCGGAGATTTGGCAAGTCTTAAAACAGAAGCTAAAGATACAGCAGTGTCTGCTATCAA
CGAATTATTTGATAAGATTGAATCTGGTAATACAGATAATGTCTCTTATAAAATACTAAA
AATATAAGACTTAAAATATATGCAAAAACTGATAGCTCTAGTTACTCCACTGGAGATACA
GTTGTAGTAAGTAATCTTAAAGTTAAACTTAAAGGAGATACTGAGTTTCTTAAACCTGTT
GGAGTTGAAGTTACTGACAGAAGTAATCAAAAAGTAGGATAAAACTTAAACAAAACCTTC
AGGATTTAATATCTCAAGTATTGATTTATCTAGTGGTAGTAATGCTGTAGCTACAGTAAA
AACAAATGGTGTATACGATTATAGTGGAGTATATGAGATTTGTAATCCTTTCAGAGAGTA
TAATAAAAAATATTGCGTATTTTTAAGTTCTGATGGATTAAAAATCCTTACTATCAAGT
AACTTTAGAAAGCTCTAAAGAAGTAGAAAATATACAATTACAATTATATGGAACAAGTGC
TACAAATCCTTTATTATACTCTAAAGAATGTATAATAGAATAAAGTTTATAATATAATAG
AATCAATAGGAAAACCTTCATTTTCACTAAACCCTAATAAAATAGGCTCTCTATACTCTG
```

FIG. 14AJ. Continuation of (CJLB-12 [organism= Campylobacter phage CJLB-12] complete genome)

```
ATACAACAAATAAAGCTGTATATATGTGTATAGACAATACTTTTGGTGCTAATAAATGGG
TGAATATAGTAACAGGTGATGAAATTAAACCAAACCTTAGAAAAATAGAAATCACTTGTA
ATGTAAACTTAAGAAGTGGATAGTATGGCGGTTGTATGAGCGGTGTTAAAATAGGATTTG
ATAACGGGTATGCTTCTACAAAACAAATAGTTAAAGGATTAAATAATGGTCAGATATTAT
GGTCATTAGACGGTTTAGGTAATCTAGCTAGTTATTCTGAAGTAGGTTCTTTATCTCCTA
GTGGTAATGATATCAAAGGTGATGTTACTACTACTGGAATATATAACGACCCTTCATATC
ATTGTGTTACTAATATATTCAAAGAGTATCTTGGAAATGCTGACCAGTGTTCATTATGGT
CTGACGCTAGCACTAAACAATTAAAAATAACATTAATATCTGAAAAAGTCCCTAATAAAA
TTACTTATGTAGGTAACGGACATTATGGTCAGACTTCTGTATCTGATGTAAAAGCTATAT
GGTATTATGTAAATGATGACGGTATGAAAGTAGAAGAGTCTGTAGATAATGAACTTGAAG
TTAGTGTTAATAGTTCAGAAACAAACGATAGTTCTTATATATATGCGTTCAATATAAATT
AGATATGTAAGGCTGTATTAATGATAGTGCCAACTAAAGACTTTTTAAAAGATATTATTT
GGAAACATCATTATTATTTTTTGATTCATTTTATTAAAGAAAACAGAGATATTTATATTG
TCTTTATAATTATAAATAAAGTTCGATAAATAATTTATATCTAATAGATATATCATAAGA
ATAATTTAAATTTAATTTAGTAGAACATTTTAATTTAGTGTGTTTCTACAAATATGATCAA
ATGAGGTATTGAAGCCGAGGATTCTTAATGGCTTTCTTTCATTTTAATACCCTAAGAAAA
TATACTGGAGCTTTGATACATTTATTTTCTAATTTAGAAATACAAACTATTCAAAGTAAT
GGTAAACCATTGTATTCTATAGTTCCTATTCAGTATGCTAACAGGGAAAGATTTGATATT
TATAGTCAATTATCTTATAATCAAATGTTTAATGGTAATACTCAAGTTTTACCCAGAGGT
ATACTTTTGTTTACTGGTATGAATGCTAATATCAACAGAGCAAAAAATAAATTTGCTAAG
ATATATAGAAAATCACAATAATTAAAGGTGAAACTAAAAAATTAAATTATCAATTCAAT
TCAGTTCCTTATGATTTTACTTATCAAGTAATTATACAATGTCGTGGAATGAATGAAGCT
AGTATGATATTAGAACAAGTCGCTAGTTATTTTAATCCTAGTTATTGTTTAAGAATTAAA
GAAGTAGATTTACCAGATTTTGGAGATACCTCTTGTATATTAGAATTAAACTCGACTAGT
GTAGATCAAGAATCTATGGATGAATTAAGTACTAATATTGTAACTTGCACTTTTGATTTA
ACCTTAAGAGGTAATATATACCCAGCAATAAAAGAACAACATTTAATAGAATTAGTTCAA
TTGTTTATGAGTACTGATTTACCAGAATCTACTGAAGCTAATCCAGTAGTCACGAGAGTT
TATTCCGAAGGTTCTAAAGAAACAGAATCTGGTATTCAAACTTTTATAAATCAATACAAA
GCGGTTATTAAGGATATAGAATTCAACCAAGATTATTTACTCTGTAAAATAGATTCTGAA
TGTGAGAAACTTATTAAATTTAAATTTAATTGGTGGGTCAATGGCATCAAACAAGACAGC
GAAATTGAAAAATTACATTATGCACCACGAGATGGTGATATTGTAAAAGTTCAAGCATTT
ACTGATATTGTTGAGAGTGATATCTTTGAAAAAGAATTCTATTCTGATGAACCAAGATAT
GATTTAATTATTAATGATTTAATTAGGGATGAAAAATTCTTAGAATGTGATTTTACTGAC
AGTAATCCATCAAATATTAAATATACATTTGAATGGTTTATAAACGGTGAAAAATTAGAT
TTAACACAACGAATTATTAAATATAAATCTAAAGTTAGCTTTGATTGTGAATGTATTATT
AGAAGCTCTGATGGTAGAGAAGCTAAATATTTTAAACATTTTCATAATAATGAAATAATT
TTTAAAGATTCTTTTAAAATAAAAGATTCTATGAAACTCGAGCTCAAAACAGAGTTGAAA
TCTATAGCCATTGGCTACAACGATTCAATGGGTTTCGATACTAATAATGATTCAAATGAT
GATTCAAATGATAATTAAGGTTTAGAATGGGTACTTTTTCATTTTCATTATCGGATATAA
AGAAACAATTAGGTCCTGGTTTAGGAGTTAGATCAAATGCTTACTTACTAGAAGTTGCTG
TAGTAGGTGCTGTTTCTAAAAAATTAGCAGTTCTTTGCCAAAGCACAGCATTACCTGAAA
GAAATATTGGAACCACTGACATATTCTACAAAGGTAGAAAATATAAAATGCGTGGTGAAA
CAGACTTAAGTGGTACTTACACTATTAATATAACTGATGATTCTGAAATGAAACTTAGAA
GAATGTTCGATAGCTGGATGAGAGAAGTAGATAATACCACACCTAAAGGGACTTGCTTT
TAGCAGGCTTATTTGGTGGTGCTATGGGTGACTTAATGGAGGTAGCTAATGGAACTTTGA
AAGCGGTTAATGAAATTAAATCTGCTTGGGAGTTTGATGGTGGTGTTTCTTGGCTTAAAA
ATATGATTATGGGCAAGCCACTACCAGCAAATTATCAAACAACCGTAAACATTTGGCAAT
TAACCAAAGTCAAAGAAAAACTATATGGGTATGCTTTGACTAATGCTTTTCCTATTGAAG
TAGGTGCAGTAGAAGTTTCTGATGAAAATGAAAATCAGTTATCTATGTTTAGTGTAACTT
TTGCATATTCAGATTTTGAACCTATTGAAGATAAAGGTGTAATTGGACAAATAGTTGATA
CTGTAATAGGCCAAGAAGGTCAAGAAATTGTACAAGGTGTTGAAAATCTATTGGATTAAA
TATTCTTTAGATTTAAAAATTTTTAAGTTTTAATATTATATAATATGTGAAAAATTTAAA
TTTAAAAGATTTAACACTGTAGTGTTAATTATTGAATATACTAAAACTGCTAAAATCACT
AAAAATTTAAGAATATTTTAAGGATTAATACATTATAATAACATTGTAAAGGAGATCAAA
TGGATATTTCAATTAAAGAAATACAACCAAGTCCTGAACAATTGAAGCAATACAAAGCTC
AAAGAATAACACAAAGAAAACGCATCGTAAAAGGTGGGTTTGAGCACGTTCTCGTAACTT
CGGATTCTGACTTAGATGGTATTCATATAGGCGCTTTATTGATGGGGTTTATAGAAAGAT
TTAGGCCGGAATACAAAGGTAGATTTGGTCGGTTTAACACGCCTGTTAAAATGGTTTTAA
AAGGCGAAACTCCTATTAAATGGACTTATGACATCACGAAGAGTTACCGGTTAAATCCG
GTGAAAATGCGAAGTATTTCAAAGGTTTAGGATCTTGGCAAAAAGAATTATTAGATTTTG
TTATTAAGAAGGATGGATTAGAAAATATGATCGATGTCTATGATTTCGATAATATTAATA
TAATTAATGACTTCTTAGGCTCTGAAGAGAGTGATAAAAGAAAGAATTATATTAGAAATC
ATTCTTTTAGTATAGCAAGTCTGTAATTATTTGATTGTTTTACATTTTGGTGATTTAATT
TGATTCTAAGTTTTAAACTTTAGTTTATAATTTAAAGTTTATAATATAATAGAATCAATA
TTAAATTAAGTTTTTAATTTTTTATAATTGGTTTTAACTGATTAATTTTTTTAAAGGAT
ATTTATGGACATTAATTTTGATTGGAATTCAATGAATGCGGGAGCTAACCCATTCGAATC
```

FIG. 14AK. Continuation of (CJLB-12 [organism= Campylobacter phage CJLB-12] complete genome)

```
TAAAAGTTATGAAAGTGATACTCGTTTTTATACCCTAGCAAAAGATGAAAATGGTAATGG
TGCAGCTTTAATTAGATTCTTACCTAGTGAAGTTCACGAAAATGGCTCAATGAGTACCAT
TATGAAAGTATTCAAATACAATGTTAGATCTAAAACTTCTAAAAGATTTATAGCTGAGTG
GAGTCCAAGTACAATTGGTTTACCTGACCCAATTCAAGAAAGTGGGCGTCTCTTTGGAA
TGCTGGCAAACAAGATGAAGCAAGAAGATATGCAAGGTCTACAAGATACATTGCTAATAT
TAAAGTTATTAAAGATCCAAAAAACCCAGCAAATGAAGGTAAAATTTTCTTACTTGATAT
GTCACAAACACTTGGTGAGAAAATTAAATCTATTTTAACACCAAATGAACAAGAATTAGC
ACTAGGTGCTGTTGCTAAAAATCTTTTTGATCCTATAAAAGGATTTAACTTTAAATTGAT
TGCAACTAAAGGTGCCAATGGGTTTATAGAATATTCAAAAGTGATGCTGAAGCAAATCC
AAGTGCAATTTATAATAGTGTAGAAGAAGCAGTAGCAGATATTAAAAATAATGCTTATAA
ATTGTCAGATTGGCAAAAACCAGAAAGCTACAAATCTTACGAAGCATTAAAAGAATTGCT
AGATGGTTTGGATACACCAGTAGAATCTAACAATTTAGATTCAATGGTTCAAGCAGCGCC
AGTAACAAGTTTTGCTGAACCGGAAGCACCAACAGTACGCATTAAAACAGCACCAGTACG
CATTAAAACAGCACCAGATGCACCAGAAGCTAAAGCGCCAAGTGCTAACCAAGCAGATAA
TCTTGATGATTTGATGGCTGACTTATTAAAGTAACTTATAGAAGCTCTGATGGGCTTCTT
AAGCTCTGATAGGCTTCTTCTCAAAGGAAGAATTATGATCGATATCGAAAACTTTAAACC
ACTTCAAGATTTTGTTCTAATAAAAACAGAACCTGTTAAATTTGAAACTGAATCTGGCAT
CATTACAAAAATACAAAAATCAAATCTTTATGACCGACCAACCAAAGGTGTTGTAATTAA
ACAAGGGCCTAAATGTCAATATGATTTGGTTAATAAAACAGTTCAATGGGATATCACAAA
AGGTCAAGATATTGAAGAAAATTATATTCTTTTGACTGAGGATTCAATACTAGGAATTAT
AGAGTAAATGAGAGCTCAGCTTTTTGAATTGCACCAAGAACTCAACAATATCAAGGATAA
TATAATCTTGTTACATTGTGATATGTTTCCTTATGCAGGAAAGAACATCATAAATTTACG
TATACAAGAACAAACTATGATTAATGTAGCAGCTGGTATTGCATATACTGGCAAACCAGT
TATAATCTATGGAGTTCTTGGATTTGTTTTTCTTAAAGCTCTGGAGCAAATTAAGTTTAG
TATATTAGATTTTAGTGCGAAATATGCTCCAATAATTATGTATAATGCTGGATATACTGG
GTGTTATGAAATGTATGGCAAAGGCCACATTTTCAAAGAAGAATTAGATCTTTGTAAAGT
TTATAATATTGAATATTTCAAACCTAATAAAGAAAATTTTAAAGGTTTGATAAAAGATTG
TTTAAAAACAAATGGTTTCAAATATATTTTGATATATTAAATCATTAAACTTTTAAATTT
GATATTTTAAAGCGTTAAGCTTTTAAGCTTTAGCTTATAGTTATTAAACATTTTAAGCTT
TAGCTTTATTTTTAAAACTTTTATAGCTTTAAATTAAAAATAAATAATTTAAAACTCAG
GAATTTTAATGAAAGAATTAGTAGCATCGTGGCTAGCACGCAGATTTACAGATAATGACT
TTAGAAGTGTTCTCAAAAATGTCGTTCTAAAAGATGGTATAGGTAAAGGCACCAAACGCC
CAGATAATGCTACCAATTTTGTGAATACAAAAACTGGTGAATTAATAGAACCTACTAAAA
TTCGTGAATTTATCAAAGCTATGAATGTGGAGGTTCAAACTCGCAATAATTTCTATAAAG
GTAATACCGATTATCAAAATGTTTCACAAGTTCCACAAAATGGTGTTTTGCAGGGTTCTG
TAGTTTTAAGCACACCTTATACTGCTATGCAGGTTGTTTTAGAATCATTTGTAGGTGATG
GAATTATAAATTTTGGAACCGCAGTCCAAGCAGATTTTAATCAAGTTAAATTAAATCAAA
AATCTTTATTTTTAGCACACGGTAATTATTTTGCAAGATTAGAATTTACAGCAAGTGCGA
TTGCTAATATTTCTGGTGGTGTAAGATTAACTTATAATCAGTCTCAACTTTGGTATGATC
AAGGTAGATCAGAAGTTAATATTAATTATGATGCTTTAACAAAAATATTAGCTCTTGAAG
ATTTTACTGACGTAGAAATTGGTATAGCAGATTTTAGTTCTAAGAAAATTAAATGGTTTA
ATAACGTTAAACTTAAAGCAAGTACATTAAAATTCACAGTTTCTCAAAATACAGAAAACG
CTAATAAAACAGTTCAAAAACGTATAGTTTCTGGGTATTTAGATTTTACAATTGATCAAA
CTATTGAAGATACAATATCTGAGAAATTAAAAGGTGCTTTGATCACAGCTGCTAGATTCA
ATAAATTCAAACAATTATTAAATAAAGCTGAAGTTGCTTGTTTATGTGATTGTAATTATT
GTACTTGTGATTGTAATTATTGTACTTGTGATTGTAATTATTGTACTTGTAATTGCAATT
ATTGTACTTGTGATTGTAATTATTGTACTTGTGATTGTAATTATTGTACTTGTAATAATA
ATAAAGAATACACTGATAGGGTTAATTATTGGCATGGTGTTGTTTGTACTTGTAATGCGA
ATATTACTTGCCAAACTCAAGGTCCTGGATATACACCAGTTTATGAAAACAAATATATGA
CTGAGTGTTCTTGCCAAGGGGATAGAAGTGTTCCGCAATACAACCAATACGGTCAAATAT
ATGGTTATGCGTGTAGATGTAATGCTAACTGGATTAATTCTGTTAGACAACACGCTACCG
TAACTCAAGTATGTTCTTGTAACGTTGATAAACAATGGACTAAAAATATTACAGGTAAAC
CAATTTGGGATAAAAAATCTACAGGTCAAATCGATAATATTGTCAACAACAATACTTCAA
ATTCACAAACAAGTACTACTGTAAGAGTTTGTGTTTGTGATACAAACGTCACAATAGCTG
CACAATGTGCTACAAATAGAACAATGGCTTATGTTGATGGGTCAACTGGAAGTCAAGGCG
GTTACAGATGTGTTTGCGATATCAACACAAATAGACAAATTGCTTGTTCTGCTAATAGAG
AATATAAATATGTCACTGACTATACTCAATTTCAAAACAAACAATACAATTAAAACTCAA
TTAACATATAATCAGCTTGAAGTTCTTAAAAAGAGCTTCAATGCTTTTTAAAAATTTAAG
ATCAGAGATTTAAAACTAAAGTTTAAATTTTAAAATATTTTTAAGTCAAAATATATTATA
ATTATTTTATCAAAGCTGTATATAAAGGAGATATAATGAATTATTTAGAACTTAAAAATA
TGGCGGAGAATTTAAAAGATTCTAATTATAGGTCAACAAATTAAACGATTTTAAATTCT
ATACTTATATATTGTCAGATTATAAAAACTTCAAAGAAAATAATACTTTTTTCATAAGAG
GTTAATGATAGATTCTAAATCTATATTAAACAAAGATACTTTAGCACCTGGTATATCGA
TACCAATACCAAATTCTTTAATATTAATGAAAATGAAGATTGGATATTACCAGATTCTA
CAAATCTTGAAGATTTCACTATAGTGACAAAATACGATGGTTCTTTAATGATACCTTATG
AATATGATGGTATAAAAATTTAGAACTAAAATGTCTATTGACAACGATCAAACTAAATTAG
```

FIG. 14AL. Continuation of (CJLB-12 [organism= Campylobacter phage CJLB-12] complete genome)

```
CTAATAAGTATATCAAAAATAATCCAGATATATTAGATCTAATAAAAAATAATCCAGGTA
CCCAGTACTTTTTCGAGTTGATATCACCTTTAAATAGAATAGTGGTAGACTATAATAAAA
CTGAATTAAAATTAATAGCTGAATTAAATCTTAGAACATTAGAATTTAAAATTCACGAAA
CTAACGAGTTTAATTTTAAAGATTTAAATATTAGGACTCTAAAAGATCTTAAAGATTATA
TAAACACCATATCTAATTACGAAGGTGTTATATTGCAGCATAAAGTAACTAAAAAAGTCT
ACAAGTTAAAAACACAAGAATATTTAGACTTACATAATACTGTAACTAATTTAGATTTAA
AAGTGATATACAAAATGATATTAGAAGAAACTATAGATGATGTGTTACCAAAATTATCGC
CAGAAGCTGTGGCTTATGTTGATTCTGTATCTAATTCAGTAAAAGTTAAGTTAAATGAAA
TATTAGATTCTATAGATTCTAATTATATTAAAGCTAAGATCTTGAAGCTCCAGCTTTAT
ATATAAAAGATTTGAATATAGATCCTATAGCCAAAGATTGTTTATTTAAATTATGTAGAA
ATAAACTTAATTTAGACAACGTCTTAGATCAAGTTAAAAAATCTATGTTAAAATATAACA
AATTGCGAGATATTAAGGTTTTTTTAAAGCTATAAATTATATAATATTAAAATCAAGTCT
TTAAAAGGTTTTTCTTAAATGAATTCATTTATATATTTATATTGCAGTTTACGGCGGGATA
AGTGCGATTTTGAGTGTTTTTGCAGTATATATTTCTCATAAGTTTTAAAGGTATAAAATG
AACACAATTAAACTAACTTGGAATGATGTTCACCAAGCTTTGCATAATCTTACAAATGAA
GTAGATCTTAAAAATTTTGATTGTATAATAACTCCCAATAGAGGCGGATTAATAATAACT
AGTATGTTGCAATACACCCAGGGTGTTAAATTACCTGTTTATGTAATTAATAATTCTGAT
GTAATCAATATTCAAAATTATAAAAAAGTTTATTTTAGATGATATTAACGATACAAGT
AAAACAATATTTAAAATCCAAAAAGTTTTCAATGGTCTCATAACATTTAAAACATTATTT
GAAAGATATAATAGTCCATTTAAAACTGAGACTATCAATATCATCTTGAATGATGTTTGG
TTAATTTTTCCTTGGGATATTAACCCAGAAGTTTTAAATCTAAGAAAGTGAGTAATTAAT
ATGCTAGTACCAAAATAATCAGAAATTCAAAAGTTTATAGATTTATAAAAAATATCATT
AAATTCAGAAATGAATTAATAATTTGGAGACCTTATGAGCCAATATTTGATTTAAATTG
ATTTATAAAATGCTTAAAATCAAAAGAGAATATTGGCTTGATGATTGTGGTGGGGCAGCT
TATGAAGGTATGCAAAAAGAATTAGATACTTTAAATAGACTCTTAAATGAGTTAGACTTA
GTATTTAAATATTCATATGATGGTGATGGCCAAACTGCTATGATCCATTTTGACATTTTT
ATGGAAATATATAAGAAAAATGCTTTTAAATTTTGGTGTTGATATGACAATGCGTGTTAG
AATCTAAAAATACTAAAATATTTAAATTACAATTATATTTATCGAACTTTATTTATAATT
ATAAAGACAATATAAATATCTCTGTTTTCTTTAATAAAATGAATCAAAAAATTAATCATA
AATACTATATAATATATCTAAAGGAGAATTATGGAATATTTACCAAAATCTCAAGGACCT
AAAAAACTTTATAATTTTGATATTAATATGACTCAAGCGTGTACACTAAGATGTACATAC
TGTATTCAAGATTTTAATAAACAAAAATTTGAAAAATTATCACCAGAACTTACTAAAAAA
ATGATAGAAAGTTTGATTTTCTATTGAATTCAGTAGAATTCAATAAACATTATGATGGT
ATTAGAATTTCATTCTGGGGTGGGGAACCCACAACTAACCTAGAAGGTGTTAAAGAGTTT
GTAGAATACTATAGACACAACCCAAAAGTTTGTTTCTTTATGTATTCAAATGGTTATAAA
TACAACCACGTTTTGATTACTTAGAAACATTTAAGTATATGCCAAATGTCGGGTCAGAA
CCAAAATTCTTGACTCAAATATCTTATGATGGAATGGCAAGTCACGATTCAGATAGACTT
AATTTACAAGGTAAGGGCTCAGCACAACAAGTTAAAGAAACTGTTTTTGAACTAGCAAAA
AGAAATATACCTTTTATTGTACATCCTACGATTGCAGCTAAGAATTTCGATAAGATTGCT
ATTAATTATTTCGAATTTAAAAGAATGTCCGATGTCTTAGGTATTGAACTTAATTATAAC
CCTACGATAGACTATATGTCTAAATATGATTTACAAAAGAACAATTAGAAGCATTGACA
AATACTTTAAAAGAAGAATTCTTAAAAATACGTGATGCTGAAGTTGAGTTCTTTAAAGA
AAAGGATATTTTAATTTTGGTTGGATGAATCCAAATAGAAGTATTTGTACAGCAGGTGAT
GGCTATTCTGGTATTGAATTGGATGGTAAAATGTATGCTTGTCACGGTGTTTTAGTGAA
GAATATAAACCAAATAATGTTTTAAATGATATTAATTTTGAGAATGTAAAATTTACTGAA
ACATTGATTAAGAGCTCACAAGATCATAGAAAATATTAAATGAAAATATGCCCAAAGCT
TGCCAAGAATGTTTTACACATTATTGTTTAAAATGTAATTCTACAAAATTTGGTATTTCT
AATAAAGAAACCTACGCAGAAAGATGGACTGATTATAGTTGCCAACCTGGTTTATGTTAT
ATGTTTAAATTCATAGGTAAATATAGAATAGCTTTGATGAAATATATTCAAGCTTCTTAG
AATTCTAAAATAGTTCTAAATTGACACTATAGTGTTCTATTTTAGAACTATACTGACATA
TACCAGAATCCAGAATCCAAAATAAATATACAAAAAGTAGGATTTATTTTGAGTATAAT
AAAATCAACTGCTAGGGGTATTAGAGGTACTTATAGAGCAGGCAAAAATGCAGTTAATAG
TGTTAATTCTGCTTATAATAGTGCTGTTAGTGGTATAAACAAAGTAAATTCTGCTTTAGA
TCCTATGAATACAGTTAGAAGTGCTACTCAAAGACTCAATAACTGGATGGATTCGGATTC
TAAAGTATCTAAGACAACTCAAAAAAATAATGATTCAATTGTTAGTGAATTAAACAACGT
AGCCAATGAAGTTGTTAGTGCAGCCAAAGCTTTAGATCCTATGAATGCTAGAAAATTAAC
AGAAATTTCAGAATCTCTTAAAAATATTTCAAACAAATCTCGGATATTAAAAAAGGATT
AATAGATAATCAAGATACAGAATAAGACACCAAGGTTTTGATAAAAACGTTCAAAATGT
TTCAGAATCTAAAGTAAATGTACCTCAGAATAAAAGTTTTTTTGATAAACTTTTAGGTTG
GTTAGGAGGTTTATTAGGTATATCGGCAGGTGCTTTATTACCATTATTGGGATCATTAGG
AAGTTTTTTAACAAAGCCTTTAGATTTCATTTAGATCTATTAAAAGGTGGTATTAATAA
ATTATGGACTTTATTTGAGCCATTATTAGGGCCTATTATAGACCCTTTAAAAAATGGATT
TGAATTCTTAAAAAATAAATGGAACTCATTAGTAGATTTTATTAATAAAAAAATTAATAT
TGGTGATAAATGGAAATCTCAGATAATGATAATCCAAAAAATCCAAATCACCAAAAGT
AAGTTCATCTAATCCAGCTAAAGAACAATCTTGGATGTCTAAGAAATGGGATTCTTTTAA
AGGTGCTATGCAAAATGGATATGATTGGGCTTCACAAAAAGTAGATGATTTAAAATCATA
```

FIG. 14AM. Continuation of (CJLB-12 [organism= Campylobacter phage CJLB-12] complete genome)

```
TGCTAGTAAGAAATATCAAGATATTAAAAATTCTAAAGTAGGTAAAATTATATCTGCAGG
ATATGATAAATTAAAAGCAGCACAAAAATATATTGTAGAAAAAGCTATTGAAGGATTTGA
TGCTGTTAAAAATATGGTAAGCTCTGCTTGGGATTCAGCAGTTAAAGCAGCACAAAAAGG
CTTTAATATGCTTAAAAAGTTTGCTTTAGCTCCTATGGAGAAATTTGTTAGTTCAGTAGG
TAAGAAACTATTTGGAAGTTCTAAGTTATTTTCAGTTCTACCTAGTATACTTGGAAATCT
TGAAAAAATAGGAGCAAGATTAGCTGCTAGTGGTGCTAAAATAGCTTCAAAAGCTTTACC
AGGTGTTGGGTTTGCTGTAGGTATATACCAAGCTTGGGATTTCTTTACTCGTGGTAGATC
GGTATTGGGTTCAATAGCAGCACTTAGTGCTTGTATTTCATTATTACCAGGTATTGGTGG
GATCATATCTATGTGTTTAGACTTAGGTTTATTTGCTACTGATATTATAACAAGTCCAGA
TGATGTAGATAATCTTAATAAAGAACAAATGATTTAGTAAATACAGCAAATAAAATGGT
TCAAAATAATGATACTGGAGGTATTTTAGAACCAAGTCAAGTAGAAAAAGATAAAGCACA
ATCTGGAGTTCAAGATTCAAGTTCTAATTCAAGTTCAAGTAATAAAGGATTAAATGCTAA
AGTACTTGATGGTAAATCTGCTAACGATTTTGCTGCTTCGTATACACCACATAAAGTGGA
TTCTAACGGAACCGTTATAGCTGCTAAAACAGGTTCTATATATAAAGGTTTGACCTGGGT
AGAATCTGAAAAATATGATGCTGAAAAGCAAGCTTATTTTAAGAAACGTGAAGAAAAAGA
AGCACAATTAGATGCGCTTTTTGAACAAGGTCAAAAAGCTATGAATTCTGGAGATACTGA
AACCTTTAATAAATTAGTTACACAAAGAAATAAATTATCTGATGAATTATCTAAAATGAG
CTTAGATTCTATCGATTCTAAATATCAAGCTATTGGACAAGCAAGAATTAAAAAATTGCA
AAGCCAAGGAGCTAATGCAGATTTATCGGTATTTAGAACTAATGGAGATTCAAGTACTAG
TTCAGGGGGAACTGATACAAAACCAGATTCTACAAATGCTAGTGCTAGTGTAGCTTCGCA
AGCTTCTGGTTCAATCTCTCCGGCGCAAGTTCAAGGAGCTCAATCCACAGAAGCCCAAGG
CTCGAGTTCAGGAGGATCTCCAGGAGCAAGAGCTGCAGCAGAATTCAGTAAAAATATAA
CTTAGGAACTAGAGCAACAGGCGCTTGCGCCAAGTATGTTAGATCTTATTTGATGGCAGC
AGGATATCCATTATCTGGTTGGCCAGTAGCAGCTGCAGATTATATAAATTTCTTACCTAA
ATATGGTTTTACACCAGTTCAAGGTAGAGCTTCACAAATAAGCCCAGAAGTAGGTGACAT
TTCAATAACCCACACATTTGGAAATCACAAATATGGGCATATTGCTATTTCGAATCGTTC
TAATTGGGTTTCAGATTTTAAACAAAACTCAGTTTCAATTTATAGAGACGTAAATGCTTT
CGGTGGGCCGGATGCTAATATAACTATTCTAAGAGATACTTCAGGTCAAAATCCATCTCA
AGAACTTGTAAATCAACAATTATCCAATATGAATAGTTCTTTTAAAGTTGCATTAGGGGG
TGGAGGTGCTAAAGGTGCTGTTTATAGTTTGGATTCTGGAGTTTCAAATGTTGTTACAAA
TACAGCAGGCGCTGCAGCTAGTGTTATAAGTTCTGGTGTAAGTAGTATCCAATCTTTTGC
TAATGCTAATTCTATTACAACCAGAAAATCTTTAACTCAAATGTATACAGAATCTGGATT
AAGTACTAGTTTTGGGTCAAGTTCAGCCCCACAAGCTGCTAGCCCAGCTGCAAATTCAAC
ACCAAAGAAACAAAGCAGATATTAAGCCAGCTTCAAAACCAGTAGCGTCAGCTCCAAA
AGCAGTTCCTAAAGCTGCTAGCTATGGTACACCACACAGAGGTCAATATGATGCAGAAAC
AATGGAAGACTTCAACAACTTAGGAGATAACTTTAGTAAATCCAAATCACCAATTTCTTT
ACCTGGAGATTCGAAATCTAACGTTCAAACTAACAATGCTGGCTCAGTAGTACCAGTAAC
TCCTGTAGTTAATATAAAGAATAATTCATCTCCAAGTGATTATTCTTGGGCTTCTAAAAA
CAGTTTTAAAATTGCTAGAATGTTTGGGTTAGATGGCATCAGCGATTACGAAATACTTAA
TGAAGGTTCAGAATCTGACTTTTTACAATCTTATGGTATGTCTAAAAGACAAGCAATTCA
ATCAGCAGGGTTAAACAATACAGTACAAACCAAAGTTGCTAGTAATGTTAAAACAAAAGA
TGTGATACCAGCTGTCAATAAAACCCAAATAAATAATACCAATATACAGACTAAAACAAA
AGAAACTTCTAATAAAGATTTGACTGATTCTTTTGTTTTGAGCTAAGGTTCATTAAATGC
AAAGGATTAAATTTTGGGATTATTTGGTTCTGTCAGTAGTGTTATTTCAGGTGTTGATTT
ACCAAAAGCTACGAAAACTTTCTCGGCCAACAATGGTGCTGAAATTCTAAAATTTACCAA
ATCTTTAGAATCTGATAATTTTAAACACAAACAATAATATTGACTGTTTATGACCCAAA
TGATTTCTATAAAAAAGTCAAAGATGCTATTGGTCAAAAAATGTCAAGCCTGATGACAGC
AGGAACTTCAGCATTTTCTGGTGATGGGTATGATTCTTCAGATGCTAGCCAAACTCTAAA
AGATGCTGGTCAAGACATTGTAGATATGTCAGCAGTCAATATATTTATATACAATACATTT
ACCATTAATGAATGCGTTCCAAGAACAAAACTCTCATAATTATTCTGAAGATACTGGTAT
TTTAGGTTCTATGTCAAATGCTGCTAATGAATTATCAAGTACAGCTAGTTCTGGTATAAT
TGAAGCTTATGGTAGATTTGGAGATTTTGGTGGAAATACAGATAATATGGCATTTGCTCC
GCAACTACCACAAGTAGATCCATTAAAATGGCAAAACTTTAAAGGTTCTAACTTAAGAAC
ATTTCAATTTACTTTTAAAATATCTCCCAGAAACATAGATGAAGCTTCTAATATGATGCG
AATATTTTGGTTATTAAAAGAAGTTCATACCCTAAAAAAGAAGCTGGTGGTGCTTATT
GATACCGCCTGCAAGAATAGGTGTCCAATTTTCAAACCCACTGCTACATAAGTTGATAGC
TCCTGGTATTTGTGTAATAGATGGTGTTTCTATGGTTTATGAAAACGGTGATGATATTGC
TGTGACATTAGATGGAGTTCCAAAGAAAATAGAGTTTACATTATCATTAAAAGAATTCCG
TCAAAAATACCAGGATGATTGGAATTTTGAAAATGCTAGTCTATAGGAGTTAGAATGTAT
ATTAGTAAGCAACTTACAAATTATTTAGATAATTATTCGTTCAGTGAAGCTAATAAAACT
GAAGCAGAAGTTTGTAATGTTAGAGATTACAGGTCTATGGATTATGACTACTAACAAAA
TATATTAATGATTCTAATACTATTAATGTTAAAATAAATGCAAATGATTTCATTGAAAGT
GTTTCTAATAGATTGTATAATGATCCTAATTTATGGGATTTATTAATGCTTATTAATAAT
AAAGATGCCTTGAGTGATATGCCTTATGATAATGATAGAATAGCAGATATGGCTGACGAA
TTGATAGCCAATTATTTTAATAATCCTGAGAAACCATACCAAGGTAATGTTACTGAACAA
TTAATAACCGAATACAGGGAATATTTGATAGATTATTGACACAAAAGAATTATCAAAAT
```

FIG. 14AN. Continuation of (CJLB-12 [organism= Campylobacter phage CJLB-12] complete genome)

```
ATGATTATAAAAGCTTTAGACCCTGCTTATTTGGGTGACTTCTTAAGACTTTTTAAGTAC
AAATAATTTAATAAGCCAAGCATTTTTTATACTTTTTAATATTAGTTTAAGCTTTGCTTT
AAGTTTTAAGCATATGCTGGGATATATAGCATTGTTATATACTACTAAAAAGCCAAGCAT
TTTTTATACTTTTTAATATTGCTTTAAGCTTTAGACTTTAAGTTTTAAGCATATACTAGG
ATATATAGCATTGTTATATACTACTAAAAAGCCAAGCATTTTTTATACTTTTTAATATTG
CTTTAAGCTTTAGACTTTAAGCATATATAGGATATATAGCATTGTTATATACTACTAAAA
AGCCAAGCATTTTTTATACTTTTTAATATTGCTTTAAGTTTTAGACATATAGATACTAGA
TAGTATATACTACTAAAAAGCCAAGCATTTTTTATACTTTTTAATATTAGTTTAAGCTTT
GCTTTAAGTTTTAAGCATATGCTAGGATATAATACTATAGTATATACTACTAAAAAGCCA
AGCATTTTTTATACTTTTTAATATTAGTTTAAGTTTTAAAATCTAAACTAAAAATTTTGG
TTTTAAAAACTCGAAAAAACTTTTTTAAAAATTTTTTAAAAAGCTTTATATTATAATATA
TCATATTAAAGAGTAAAAATTTTTTTAAAAAAATTTCAAGGACTTGGAATCCCACATTA
AATTCAAAACAAAGCTTAAAGCAATATTAAAAAGTATAAAAAATGCTTGGCTTTTTAGT
AGTATATACTATAGTATATGCTTAAAGCTTAAAGCTTAAAGCAATATTAAAAAGTATAAA
AAATGCTTGGCTTTTTAGTAGTATATACTATAGTATTATATCCTAGCATATGCTTAAAAC
TTAAAGCAATATTAAAAAGTATAAAAAATGCTTGGATATTTCATAGTATATACTATAGTA
TTATATCCTAGCATATGCTTAAAACTTAAAGCAATATTAAAAAGTATAAAAAATGCTTGG
ATATTTCATAGTATATAACAATGACTACATTTCAGTTAAAATTCAGTTATATTTTAATAT
AATACCGTAAGTATAAAAAATAAATACTTGAATATAATATAACAAGCAAGGAAATATATG
ACTAGTAATAGCTATTCGCAATCTAGTAATTATAAAATATTTTTACCTTTTCTAGGCGAT
GAATGGATATATGCTCAAAATATAGCATTACCGGGGTTTAGTCTGAACCCAAGTCAAGCC
AACTTCGGCGGTAAAACTATTTATGTTGGTGGTGACCACATAGACTATGACCCAGTAACT
GTAGGTTTCCTTGTGGGAGAAGATTTCAAAATATATACAAAATTAATCAAATATATTTTC
GATAGAGTTCACCCAAATAATGGTAATATCGAACCATTAAAAGAATTTACTTGTGGTGTG
GAAATAACCGACAATAAAGGAGAATCGTTAGTCAGTATGACTATGTATGGTTGTAAAATC
ACAAACTTAGGTGCTTTACAACTAATATCGAATGCTGATGATGCTGAACAAACTTTTGAT
CTTACCTTTAATTTCGATAATTTCGAATTGATCGATTATTTTGAATCTATTAAATTAAAA
GAAGCTGTTATAAAATCATAAAGGGTTCTAATGGAACAAGTAATAGAAGCAGAAATCGTT
GAGTTCGATTCTGAGAAAGCTAAAATTAATAAAGCTCAATTAAATCCAGATGAAATAATT
CAATTGGATTTAGTAGTAGACGATTATAATAAATTAAGACAAATTATTTTAGCTAATGTA
GCACAATTAAAAGTTATGAGTGACAACCTAGTTCAAGAAATGGAAATTGAAGGATATAAC
CCAGACTTAGTAACTGCTTATAGTAAACTAATTGAAACTTCAAACAAGTCTTTAAAAATT
CTAACGGATTCTTATAAAGGGATATCTGATATTTTAATTAATATTAATAAAATTAATGCA
TTGCATCCAAGTACAGAAGTTAAAGAAGATTTTGAAGTTATTTCAACAGCAGATGTTATT
AAAAGAATTCGAGATTCAAAACAGGATTAAATATTGAAAACAAAGTATTTCAGATAGGAC
AAATCAAATGCCTTTAAGTGTAAATGAATTTATTAAGAAACCAAAATATTTTAAACCTTT
TCTTAAGAAATTAGAAACAAATGATTTTTTATTAGAAGGTGATCTTGGTGTTTTTAGTTT
TGATTTAAAAGATCCTACAAATATTAGATTATTTGAATTAATTAAAAGTATGAATGTCGA
TGCTGTAGAACTTTTGATATATGACAAAGATACTAAAAAATATAAAAACTTTAAAGGTTC
TATTAATGGAAAGAAAGGTGAAGCACCTTTTAGTAAAATTCATAAATCTAATGTATCTGG
TATCACATTAAAAGGTCAAAAAAGTGACAACAAAGACGACTTAGCAGAGTGTGGCGTTGT
ATACTATTTAGATATGTTTTTAAATACTAAATTAACCGATATTAAATTCTATAATGAAAC
TCAAGTTAAAAATACTAGGACTAAGACGCCATTAGATTCTGTTAAAACATTTTATTTGA
AAATCCAGATTGCGATAAAGCTTGTAAAGATGCATCTAAATGTATTCTAAATGAAATTAT
TTTAAAACAAAACCTTAGAAATTATGAATTTCACCACAAAACTGATGTTTTTAATGATCT
TAAAAAGCAAGGTAAACAATTAACTAAATTAGCAGAGGATAAATGGAATCCTGGAGATTT
CTTTTTGGTTAAACCTACATATAAAATCAAATCATACAAAACTTATCAAGAACTTAACAA
AGAAATTAATGATTTTGATAATATAATACCTATAAGTCTTAAGAAATCTGCTAAAGAAGC
TTTAGGTGGTTCCTATGCTTTGAATAATTTATCAGGTAATTATGGTTTACCAAATTTTAA
AAGTATTAAATATAAATCATTCGATAATAATTTTTTTAATTTTTTTAAAGAATGTATGGT
TGAATTAAAGAAGCATAAAAATTCAGATATCATTAGAGTTAGAACTAATAACATTAACTT
AGCTGACATTTATGATGAAATTGCCAGCAATGCTAAAGCTGCTAATTTTTTCGAAGGGTT
TCCACCGAGTTTAGCATTTATATCTATGAGTTCAAAATATTTTAATGATATTATATTTGA
AGTTGTTTGTAATTGTTTAAGTAGATCTCTATTAAGTTCTAATTTTTATAAAGTTTCAGG
AAATCATTTAGAAGTATTTGATACATTGCCTTCAGATTTAAAAATCGAATACTGTGTTGT
CTCCTGTGATGGTAATGCTGATATCAAATGGAATATTAAAATAGACGGTAAATTATGGAA
ATTGCAATTAAGATCTAAAGGTTCTTTACCACAATTTATGTTGGTACCTCAACCGGTAAG
TGCTTCAAGTCAAGACAAAAAAATTCAAGCTATTAATGTTTAAAAATCTACACTCGAGTG
TTAGATCTAGCACTATATTTAGTATCCAAATAAGTGAATAAATACATAAAAAGGATCATA
ATGGCAAAATTAATCTTACAAAGAATACAAGAATGTACCAATGTTAGAAAACTAAGTAAA
GAAAAAATCGAAGGATCTACATTATCTGATTTAATATTATATGATGACAATGGTCAAATT
CTTTGGAAAGGTGCTGCTTGTGAAAATGCCGGACCAAGCACAGAAGAATCAGGAACTGAT
AAACGTATAACAGCAGGTTCTTATAAATTAGAATGGTGTGCTAGTTCTAAAAATGTTGGA
TTAGCTAAAAAATACCCACAATGGTATAATAAAGATCGATCAACCATAGCAATTTGGGTT
AAAAGACCAAACCATGCTAATTTAACAATAGATTAATCAGAATACATATTGGAAATTAC
CCACAAGATACAGAAGGTTGTATTTTACCTGGTAAAACCAGAGGTGCTGGCATTGTTTCT
```

FIG. 14AO. Continuation of (CJLB-12 [organism= Campylobacter phage CJLB-12] complete genome)

```
AGTTCAGCAGATGCTTGCAACGAACTCTATACTAAAATAAAAGAAATTGGAATTAAAACT
GTAGATTTTATTATTAAAGAAATTGAAGCTTAAGGATTAAAATGAGGGGGTTAGTTTATA
AATCACCACTTAAAGTTGATTTAGATTTAGCAGAATCTTATAAAGGTAATATATTCTTAT
ATAACGAACCAATAAAAAATGATCCAGAATATAGCATACAAGATTCTATTAATTTGGTAT
CTAAACCAGATCCCGCAACTTTTAGTGAATCAATATCTTTAGATGATACTAACCACTTCA
ATATTGATTTCAATTTTAACGAAACAGCGATATTAAGAGAATCTGTCTTTGATATAACTT
CTGAGACTATTGATTCTGATTTTAGTAGAGATCCAGATATAAATAAATACAAAAAAAACA
AGGATTTTAAATGTCAGATAAGTTAAAATTACTTTATGAATATCACGATGCTAATGTACT
TATCGAAGAATCAGTTAACGACAAAAAAGAAAAAGTTAAAAAATATAAAATTGCTGGTAT
TTTTTCAACAATAGGTGAAAAAAACCGTAACGGTAGAATTTACCCAAAAGAACTCTGGGA
AAGTAATGTTAAAAAATACCAAGACGTTATAAAAAGCGGTTCTATTAATAGACTTTGTGA
GTGGGAACATCCTGAAAGAGGTACAGTTGATCCTATGAAGCAGTTGCTGCCATCAATAA
ACTTGAAATCAACGGCAAGTATGTTATGGGTGAAGCTACATTGTTAGATAATCCAAGAGC
TAACCAATTAAAATCCTTAATAGATAATGGTATTAAATTGTCTGTATCTAGTAGAGGTTC
TGGCAGAGTTAAAAATGGTATTGTCGAATCATTTGATTTAATTACATATGATTTAGTATC
TGCACCAAGCGATTATAATGCTACTATGGAAGGAACATCTATATATGAATCACAAAAGA
ATTTGTAATGGTGGATGGTAAATTAGTAGAATCTAAAGATTCTGACAGTGCTAAAGATTC
TGACAGCGATAGCAAAGCTGATACTAAAGATTCGAAAGATTCTGATTCAAACGATTCTAA
AGATAATACTGAAGATTCGAAACTAAAAGAATCTATTCTTAAAGAACATTTCTTAGAGTT
TATTGAAATACTTAAGAACAAAAATAAAAACAAATAATCTATAACAGGAGTTAAAAAATG
TATGACGATATTGTAAAGAATGTAATTCAAAATAAAGGGCTGGCTCAAGCAAGTAATGAT
TTCAGAGCTATTCTAATTGATAAGTTCGACTATATGCCAGAAATTAGATCAAGACTAGCT
TCTATTGAAAAATATAGGGATATGAGAGCTTCACAATTTTCTGCAAATAATGCATATAAC
CCAGATCGAGATTCGATTTCTTAAACATTTAAAATCCAAATTTTACTCGAGAGCTAACAT TTTAA
```

FIG. 15A. (CJLB-13-1 [organism=Campylobacter phage CJLB-13] partial genome contig_1)

```
TTATATCTGAAACTTAATATAAACTTAAACTCTAAAACGACATAAATAATATAAAAGGTT
CATATGTATTTAAATAAAGAAACTAACGAATCTACGTATACAGCAAAAGAAATTAAATCT
GATTATTTTACTAATAAATTACATAAAAATATTAAAGGCACTGCTGGTTATGTTATATTC
TTTGGTATATTCACAGCAGTTTGTTTAATATTTCAATGCTTAGATTATATCATAGATTAT
TATATACCAGGTTCGGGTATCTTTAATAAAAACTTTCAAGTCCCAATGGAAACACTAACC
ACACTATATGCTACCCTATGTTGTGTATATGTGGGTGTCGACAGAACAACTTCTGTTATT
GCCACTTTTAAAGGAACTAAAGATTCTGCTAATTATGGTAACCCAGAAAGAAATAGACAT
ATTATAATACAGAACTTTTTTATATGTTCTTTGGCTTTAATTCTTAATAGATTTTTTGAT
GCAAATCTAGGATTAGAACCTTTGTTAGTATCTTTTGGTGGGTCGATAATCTTATATGTT
TCTGGTCAAAAAATTGTTTATCAAGCTAGTAAGTTTGCACCAGAAAAGATATTAATAAA
AATGGGATAGACGATAGAATAGAAAATAATAAAGATTTGATTAATGTTTTAAATGAAGCA
GTTAAAAATGATAGACATTTTAAAGTATATTATATAGACCCAAGAGGTGTAGAATCTTTA
GAGTTTGATTCTAATCCTAATGATAACACTCCTAGTATACCAAATGAACCAGCAGTACCT
ATTCCAATTGAGCCAATGGTAGAACCTATAAATCCAGAATCAAACTTAATAGAATCAAAG
AGTTAATCTTTTACCATTAACTCTTTGAGTTCGTTTGCGTTTTCACTTACATTATAAACT
TTATATTCAGAGCTGTATTTAGAACTTAGTTTAGAACTAACTACTAAATCTGGATTGTCG
TTGATATCCACAAGTTTTAAACCTTTATGAATTACAATTAATTCAAATAATCTTTTTAAA
CTCATTTGATTATAAACTTTATAATAATCATATATTGGAGCAATTTGATTAAAACCATAA
CCTCCTGAGTGAGAACCTCTCATATTAAATGGTTCACCAATAACTTGTAGAAAACCATTT
TGAATTCTAAACGCACACATATCTTTGAAATCTACATCAACATTGAATTGAAAAATAGCA
TCTTGGAGATTTATAACACCATCATTATTTTTAGTATCACCTGGTAGAACACCAACAATT
ACATCATATTCACTGAGTGAAACTTTGTTGTAACTATGAACATTTACATATACTTCTAAA
TCTGATTTAGGATCTAAAGTCAAAGTACAAAACTCTGCTGTAATTAATGGATTTTTAGGA
TCAAAACTTCTTGAACTGGCCCAATCACCAGAGTGTATTTGAATTCTTACCATCTATGCTA
GTTTCAAGTTTTGTATAATCCAAAACATTCTTTAGTGAACCTGAACTATCTCTGAATAAA
CAAGATAAATCTAAGTCTAACCAACCTTTAGAATTATCCTTCCTTTTCCAAGCAACGAAT
ACTTGAAATTTAGAATCTATTCTAAGGCTGGATCCTTTTGGAAAGAATATATCAGTTTTT
AAAGAATCTTTAGGTTTAATTGGAGGAACCATAGTTTCTAAATCATCAGAAATTGCTATT
CTTTTAGCTGAGCCAAAATCAATTAAATCTTTTTTAGATTGTAATAAAATTGAAAATAAT
TTACTTAAGACTTCCCAAAGATTACCGCTTGGTTTTTAGCTTCATCAAAATATAAAATA
TTTCCTTTGATATTAGACATACGAACTTTACCAGTTCTTTTATAATTAAGAACTAAATCC
AATAATTGTTTGAGTGTTTTAGGTCTATGATACAACAAAATACTAAAATCATTGTTATTA
GTTTTAGCTGCTAAATTAAAAACATTTTTATAAGCTAAATTTATATTATACTTATAAATT
TCAATAAAAGCATTATTAAATTTTACTGGGTTATTTAGTAAAGTTCTGATTCTATAAGTA
CCCGTTTGTTTATAATCTCTTTTTAATATTTTGTTAAAAACATAGTTTGCAACTATTAGA
TTTTTATATCTTTTTTGTGTTGTAACAATTAAATACTGTATATTTTGCCAGAATTTCTTG
TATATTAACATTTCATTTAATATAGTTTCACGATCCAATTTTAATTCATTAATAGAATTC
ATAACAAAAGTTTTAATATATCTAGGTAAATTGAATTCTTTTGTGTAAATTCTATCTAAT
TTGTCTATATCTAAATCGTATTCAGATTTAATTAAGCATTTAGTAATAGTTCTGACCGCA
TTAACATTTCTGGTTTGTATTTTTTAGAGAATTCCAGAGCTTCACTAGGATTTAAATTA
GAAATCAAAGTTTCTAAAGCTAACTTATTTGGAATCTTACTTGGCATATATTTAAAACCA
TATTTTATTATGATATCTTTTTCATTATCCGTAGGATTGAATTGAGATTCTAGGATGTTT
TTTGTAATTTTTTCAATTTCAGATTCTTGTATTAAATCTAATTCAACTAGTTCTTTGTTT
GGTATTAGATCACTAAAATTAATACTTAGAGTATAATCGTGAGTATCTAAGTTAAAAATA
TATCTTAAGACATAGTGATAGAATTGATCTTCATAATCTGAAATATCTCTTAATTTATGA
GTATATTTTTATAGAATGTGTGCCTGCAGCTAATACTATAGATTCTTCAAATGATTTA
AGATCAGAATCTGAAGCATTATTAATAGCTTCTAACAATGTCTGGCTTGGTTTATAACCT
TTTAAAAGCAACTTATAAAGAACTGAGTTTACATTTCTTTGCGATGGTTTATATCTGAT
TTATCGATATAAACTTTGTTTACTGTTAAAAAATTTTTAAAATCTACCATTATATTTCCT
TTGTCTAACCATTACTAGTCTTGTTTGAATTAACCGCGGTTGTAAGATCTGTTTAATATA
TTATTGATCTTTTTTATTTCAACTTTAATATCAGATATGATATCTTTGTTACTTTCTGGG
TCTTTGATCAAGATTGATAATCTTTGATTTAAAGAATCCCTGTAATTTTTTAAAACTTTG
TCTTGTAACATCTGAATCTCCTTTTTAATTTATATAATTATATAATAATAATCTTAAATT
AAATTGAAGTTTCAGATATTTTTGCGTATTTTTAGTAATATTTAAATATATGTATAGAGG
CTCAAAAATCGGCTTAAATCGATTTAGATTTAAAGTGATATTTAAGTATATTTCAATAT
ATTAAGTGGCTTGGGTTCTATCTATAGTTAAGAAATCTAAAGAAACCATATAAG
CTTTATATTGATCATAATTAAAGTCTTCACCTTTAGGCCCTTTAAATCCGTGAGCATCGC
CATATTTTTACAAAATAATGCTGGATCCATATTAGGAACTACTGTAATATAATAATTTT
GAGCTATAGTTCTTTGAACCTTAAGTCCACCAGAACCAGATTCACGAGTATTTTTAGAGC
CAGAACTTGAGTTTGAACCCGAATTAGAATATTCCCAATAAGTAACTTCTACAGTAAAAG
GAAATGTTAGTATATTATTATCCCTATAATATCCAGCAATACCTTTAGTTCCCCAGGATT
TGCCAGTATAGTGCATATCTTGATTTTTAATATCTTCTATAGTAGCTTTTCTTCATAAT
TAGTATCCTTAAATTCAGTTCTACTTAACTTAAAGCCACTCCAAAGATATGTGATCATTT
TTGGATGATACAAATCAACATCATCTGGCAGACCAGAAAGAGTTAAAGAAGTGGGTGTCC
AAGTTTTCTTTAGGCCTTTAGGGACGTGTTCTACACCTTCATCAACTATTCTAGCAGATA
TAAACTCTTCATTAGTTTCAAAAGACCAAACTATCGTTTGGCTATAATTTGAACATTTC
TAAGGTTCTTAGAATTTAAAGAATTAAGTAAATTCCCTGCGGGAGTAACGAACTTAGCCA
```

FIG. 15B. Continuation of (CJLB-13-1 [organism=Campylobacter phage CJLB-13] partial genome contig_1)

```
TTAAGATCCTTTATTTGATTTGACTATATAATCGTTGTTATTTAGCCATCTTATTATAGG
TTCTCCTTTATAAGATTTATCCCAAATATACCAAGCATATACCATCATACCAGCTTTATA
AGTTCCATCTTCTCTAATAGTATCTTCAAGTAAACCATATCTACAAAAAACATAAACAGT
TTTTAATGGAAAATCAGTATCCTTGTATATTTCATTATATCTTGAAACCCCGTGTAAATA
ATTCAATGGTAATAACATTGCAATTTTATTATTTGCTATTTGTTTAGCTTTTAATATAAA
TTCTTTTGCTAAACTAAATGGCGGATTTGTTATAATATTATCATATCTATCAAAATCATC
ATTAATGAAATCTTTGAAATCTTTGAAGATACCTGTTAAACTAAAATCATTGTTTAAATC
ACAATAATCTACAGATTTATTATAATCTTTTAGAACTTTGACTATTGCTCCAGCACCACA
AGAAGGTTCTAGTATACTTCCTTCGAAATTTTCAACTTCTAATAATTGTTTAGTCATACT
ATAAGGTGTTTGGTAATAGTCATTTTTATTACGTTTATTTGAGTTTAAGCTAAAATTTTT
ACCTTTCATTTTTATCCTTTGGGATATTATATTATAAAATATCTTAAAGGCTTCTTATAT
AGATTCAAATAAATAACATAAAAGGTTCGTAATGAGAGATTTAGCTCTTGGTGCTTACAC
GCAAAAGATTTAACCAAAAAGTCAATACTATTGGTGATGTAACAACATTAAAAACCGA
AGCAAAAACTACAGCAGTAGGAGCCATAAATGAACTTAAAGATAATTATGAAAAAATTAA
AAATTCTATAGATACCAATACCGCTAATTTCTTAATAGATCAAAAATTAGATCCGGTTAA
AGAAGATGTTAAAGCTTTGCATACACAAGTTGATAATTATTCTATAAACTATAAGCAATC
AAATGATCCCACAGCTTCTATAAATCCTACAATCGATAGTGCAACTTTTTTAAATACAGC
TACTGGAGTTATTTGGACTTGTATAGATAAAACAAAAAATAAAAATCGCTGGATAAACGG
AAACGGAGAAGTTGCTGGTGCACTTCCAAGTAATCCAAATCTTGGTGATATTGGTTTTGG
AGTGGGTATTGCACCTAAAGAAATTACTAACAAATATAATATGTATCCTATGCTAGGAAC
TTTTACTCCTGGTCATATGAATTATGGAAATTATACTGATATCCACGGTAATGTTATGGT
TTGGATACCTAAACTTTATATTAAGACTTCAAATGTAGACGCTGCACCATATTGCGGATT
AAAAGTTGAAGTTTCCGCTACTCAAGAAGAAGGTTTTTGGTGCCATAGAGCATTTATTAA
TAATGGTAAAGAAATTCCAGGTTTTTTATAGACAAATATCTAGCATCTAACCAAGGGGG
TATTTTAGGTTCTAGGCGTAATACAGTGCCTTTAACCTGTGATTCTAAATTTAACTCTGT
AGCTTTAATCTCAGGAGTTTCTGCAAAGGTTGCTTTGGGTAATAAAATTACAGAAGATTC
TGATTTAGATTCTGATGATTTAAAATCTATTAAGAATAGAAATTCAAGCTTCTTAGAAGC
TGTTAAAAATAGAGGCCCTGAATTTCAAGTATTAACTATATTTGCTTATAATTATTTGAT
TTTGTTGTCTAAATGTATATATCAAATGCTTATAATACAAATAATTTCAATAATATTGA
GTTTGCTAAATCAAGAACAGATAGATTTGCATTTATTCAAGGTATGAATACTATGCAAAG
TGTGCAAAGAGATATTCAAGCTATTCATAATTTAGATTATAAAACTGCTGGGTATACGGA
TGGTACTAACGCGTTGTATAGAACAGGTAGTGTTTCAGATTCTAAAATGGGTAAAATTAG
TCATAATGGTCACGCGTGCGGGGTTGTTGATTTAGTAGGCGGGTTATTTAATCTGGCTAT
AGGCGCTATGTATGGTTATATATTAGATAGAAGTTATTTTGGTGTTATCAAAGAAAGCAC
TAATATAACAGATTTAGATTTAGAATCTTTAGTAGATACTAATAATTATGATGAAACTAC
ATTACCAGCAGAGATTATAACTTATATAAACAGTGACTCTGATAGCCCATTAGGTTATTT
TAAGGATGTTGGTGCCAAGTACAATAACACAAATGTAAGAACAACTTCTGAGTATAAAAT
AGATTCTTGCGGTATTCCAAAATGGAGTGTTTTACAAGATGCTACCGTAGCACCACAAG
ACAAACTTTTCAATGGAGAGGAAATCCAACGTATAAAGATACTTTAACATTTCCTATAGT
AGGTTCAAGTTTTAAAGATAGTTTTTATTCAAGTGTTCAATTCCAAAAAGATACACAAGG
TGTTGAATTTGGAACTCGCTGCATATTATTACCCGAAATTTAAAACTTAAAAATTTAAAT
TTAAAATATAATATTATAATATATAAGAATTAAAAACTCGAGTTTAAAAAAAAATTAA
ACTCGAGTTTTTAGTAATTAAATCATTAATTTCATTATAATACTCCTTACGTTTGATTAG
ATTTTGATCTCGCAAATCCAAAAATCTTTATAATTTATTATAGAACCTATACAAATACCC
ACTAATGGTAAATCTAATTCAGTTTCACTTGCAATACCCAACCCATTAGAATCAGCATAG
ATATAATCACCTATACTAGGTTTATTTTTGCAATAAACTGGAGTTCTACCTTTCAATGCA
ATTGGAACACCATCACATTCATTATTCAGAATTACACCAGGATTTTTTGAAACAACACCA
AATAATTTCATACCTGGGTTAAATAAATTTACACCACAAGCATCTATGCCTAATATATGA
CCTGCTTTTATATTCGATTTAATAGATTCTGGAACTTCATAATACTCAGCTAAGTCAGCA
TATTTAGCTCGCAAAGCAGTTCCTTGAAAATTAACAGCATATATATTAGACCATCTTAAA
GCTGTAGATCCTAAACTAAATTTATTATCTTGAGTAGGGGTATCACTGGTTGAACGTCTC
AAGAAATCTTTAGAATCTAATCCATCTAATTTATCAGCATCTATTTTACCCAAAGATCCT
GGTACTTTTTGAAGTAATAAAGCAATTTCTTCTGGTGTAAATCTACTTGCTGGTAAGAAA
TAACCTGCGTGTTGACCATCTAATGTATCAGCATCAACTCCAGATAAATGCCCATCCACT
TCTTTAATTTTATTGAGAAATTCAGCATTCCAATAATCGTAAGTAACTCTTTTTTTCAGA
TCAGAATCTATGCGATTTAAATAATCTCTTAATCCTTTAATAGAATCAATACCCAAAGAT
TCAATCATATCTCTATTTGTTTTAATCCAGTTAACAATTTCCTGAAGTTCATCTAAGTTT
ATGTCATTTGAAGTTAAAATTGTGTTAATATGATCTATTAATCCTTTAAGAACCTTACCT
TGGTAAGCGCTTAACGGTAATCTGCGATTATCAGATTCTAAACTATCAACGACAGATTCT
TCAGTCAATGCTATTCTAACAAAATCATCAAACTCTTGTTTAGAGCAGAAATAATCTTTG
TGTTCACCATCAAGTCTATCAGCATTTGTAACAGTTTCATTATCAAACCAATGTTTTAGA
CGATCTTCAACGTGTTTAACGGTTGTTGGGTGAAAGTATTAGATTCTTCATAATCTTGT
ATTGAACTAGGATCATAAGGATCTTGATTATCTTTAGCTAGGTAATTACTGGCAGGAAAT
TCAGTATATTCTTGATATTTTGTAACGACCCAAAAACTAGGTTCCTCACTAGGAACTTTA
TTAACACATTCTTGCACACATTTATAATCTACTTCATTATATCTTACAATTTCATTAACC
TCATAGTTTTCAGATTGATTCCACTCGAGTGGTGATTTTCCGTTTACTATTTGAAATTTA
```

FIG. 15C. Continuation of (CJLB-13-1 [organism=Campylobacter phage CJLB-13] partial genome contig_1)

```
TTGTAGATATCAGTTGTCTCTTTTTTAAGACGAACTTGAAATAGATTTATAGTATCTTCA
GTAGGTACCATACCGTGTTTAATAGCATAATCAGTATAAAAGGTTTTTTGATTTTTGTGT
GTAAAAGCCATCACAATCCTTGCTTTTTGTATATTTATTTATGAATTGTGGTTAATAAGC
CTTTAGTATTTACCCAAAGGCTTAAGTTATTAGAATGTGTATGTATTTTAGTTTCTTTA
ATAGATTCTAACGAAAAGGTTATAATGCCATTTCTAGCTTTAAATGAATTTTGTTTAAGT
TTAAAGTTATTAACAGAATCCAAACTAACTCTGATTGTATTATAACCAGTTATAAAAAAT
GATTTAGCATCATCTATAACTTTATATCTAACTACAATTTCATCAGGTTTAAAGTCTAAT
TCAATTGTTTTAGAACCATCTTCTTGAACTCCTGGAGCCAATACAACAACATCAATTCCC
GAACTAGTTTCAGTTGTTAAATACGAAGTAACTGATGATGGATATGTTTCCATTGTTTCT
GAAACATTTTTTAATAAATCTTGAAGATTTTTGTTATTAAATGATATGCTAGGCATATCT
AAGAATGGTGATCTAAGAAAATTGCTTAATTCTAACATATAATTCCTTTTTGTTTTAAT
TATATTATATTTTTACTTAAATAATTCTTAAATCTTAGAGCTTTTAATGTTTAAATTAAA
GTTTAAAAGTTATTACCATTCTAACTCATCATCCCCTGGTCCTATAGTTCCTGGTAAAAA
ATCCCTTGTATACATAATATCTTCGTATTCTTCGCGTATTATTTGAAAATCATTATAATT
GGTTCTAGCTTCACCCAAGGTATTTATGTATGTAGATTATTATCATATATAGTTAAGAT
TTCTCCGGTTAAATCTTTTCCTATCAACACACCATTTGAGAATAGCTTATTACCTTCATA
ATCTGTAGATTTTAAAGTTGATGACCAAACTTGAGAAGTACCAGAACCTGTAACAGTCGT
TTCTACTGCTGTCATATTACCATAGAATTCTAAAAATACAGTTTCTGGCATAGTCAATGT
TATTATATTTCCAGATATTTCATAACTAGCTTCAAAATATGAATAATCATCAGTATCGTC
AGGTAAATCAAATTCTTGCGTGGTTACAATTTTTTGAAAAGTTTCTGGATCTGTTTTATT
AGCTCTTGATAGATAATTACCAAAACTTGAATCTTTTTCTATAGTTACCATAATTTTTGA
CAAATCGTCGGTCATAAAACTTGGGTACCCATATATAAACACAGCTTTTTTAGTATTAGC
ATTTACTGCTATAATTTTAGCTATTTGAATTTTATTCTTAGGACTTCCAATTAAAAATGA
TGCTTCCGCAATATCACTAAAAGTTAATTTAATAACCTGATTAGTAACAACGTCGTATGT
AGGTGCATTAGATATTGTTTCTAAGCTATCAAAATTATCATTGATATACTTAAGATTTTT
ATATTTTGCTTCCCAGTAATTATAAGTATTTGGTTTTTTATATGAACCTTTGAAAAAGTC
TTTTGAAATTGATATAATTGACCATAAAGATTGTCGTTTTCTTTCAACTTTACTATAAAA
ATTATCTTGCCATTTTGCTTCATTTGCTATGCTTGATAAGCGAGTAATGTTATCATTAAT
AGTTTTAACCTCAGCAGCTAACTCATCCTTTGAAACTTTGTTTTCTAAACTGGTTGAAC
ATTATTTTCAACGTTTGATAATGATTCAGAAACAGAATCAACAACACCTTGTATACTATT
GATATTTTGAGTAATTTGATCTTTAAAATTATTAATATTGGTTTGTATTTCAGACATATC
AAAATTATTAATAATAACTTCAAATTCTTCTATTTTTTAGATGTATTGGTTTCTAATTG
TTCTATCTTGCTTGTTAAATCTTGTTGAACTTTTTGGAGATTTTCTGTTATAGCATCCAA
ATCAATACCATCTAAAGAGCCTTGTAATCTTGCGATTTGTTCATTAATACTCTGTATAGT
TTCAGTGAAATTTAAATCTCTGATTGCTTGGTTTATTTTAGAATCTACACCTGATTGCGT
TTCAAATAATTTAATTTGTGAATTAATAGAATTTAAAGAATCTTGTATTTCTATTAACTT
AGCATTATAATTTGTATTTAATACAAAATCACTAGCTGGGTGTGATTCTAATAATGCTGA
ATTTGGTGCAACATATGTAGAATCATCCCTATTTAATTTAAGAATCTAAAGCAGCTTGCAA
GCCTTTGATATTAGCAATTGTTAAATCATCAAATTTTTCGCGATTTTCTTCTATATAATT
AATAATATCTTGAAGATTTTTAAAATCATCATCTGTAATATTAATTACTTTCTTTATTTC
GTCTATTATACCTTTAAGAACTTTACCTTGATTAGCACTTAAAGCATCTTTAGTAGAATC
TGATTCTAAATTATCTTGTATGTTTATATGTAAATCTATTTTAGCTTGTTCAATTAATGC
TCTAAGTTCAGAATCATCATATAAAGTATCTTGCGTTTCTATGCTTTCACTCGAGCCGTC
AGCTCTTCTTAAGGTTATTATTCTACCATTGGCAGTAAGAGCTTGTGTGCTTGGTAAAAC
TCTGGAATTAGTATTAAAAGTATCTATGAAATTCTTATAATATGAATTAAAGTTAAATTC
TGAAAGTTCACCATCTTTAATAGTATAAGTAGTATCTGTAAAAACTGGGTCTTTCCCACC
GGCTTGCTTTCTAGCATCATCCCAAGAAATTTTCTTATTTAACTCAATTTGAGTCAAGTT
AGAAATTGGCTTGTCGATGTCGGCAGTGTTATCAACGTTTTCTAAACCAAGCGTTTTCTT
TGTTATATTGTGTGGGTTTTCAGCTGTATAATGTCTTTGAAATTCTAATTTTGTAGAATT
AGAAATTGGCTTGTCAATGTCAGCAGTGTTATCAACGTTTTCAAGACCTACGTCTTTTTT
GTTTAATTCAACGTCACCTTGTTTACCCGCAACCGTGTTAACAACACCTTGGATAGGAGT
CCATTGTATTTCATCATTTACAAGCATACCAATTTCATTTGTATCGATAGCAAGAACGAT
TTCACCTTGTGTTGGTTTTGCGTCATTTACAAAATGTTTTTTAAGATTACGTCTTAATAA
AATACCAGTTTTTATTTCAGCCATTTAACCCTACTTTTTGTATATTTATTGCTGAGTCAA
GCTATTTTAGTTCAAGCTTTTAAGCTTTAGCTTTAGCTTTAGAACCTTTAACAACATAAT
ATCTATCTATATCTGCTTCTAATCCTGGATGTCTTAAACGTAATTCTTTTAAGAAATAAT
TATAAGCAGTTAATTTAACTTGTCTATCTAATTTCAAATCATTTGGCTCTATGAATTGTG
CTGGCATTCCAAAAATGATATCAAAGAATCTTTCTTGTGTTAATTTAATAGTTTTTTCAT
CGCAGTATTTTTTCATTAATTTAACAACACCAATAAAACTATGCAAATCTTTTATTCCCA
CGTTTGATTTAAACATATATTTAAATATTTCTTTTAAATCTGTATAAATTCTGAATCAC
TAGTATCTTGTTCTTGATATACTTGTTTACCTTCGTAATAAACGGGTTCACCTTTATCTA
ACATAGGAACCAAACCAAATCTCAAACCCCGGGTAACACTGAATTGAGCCATTCTAGGTG
TGCTTTTATCTGCTTTTAATTTGATATTGCCTGGTTTAGAACTCTTAGTAGCTACAACTA
TATTTGGATTTGCTGAAATAGCTCCTACTAACGCTCTTAATAATAACTTATGTGCAAATG
CTTTTATAGATTCTTTGGCATCCTCGAAACTTGAACCGTGACTAAATCTCGCAAATTCCG
TTGGTTTTCCATCTTTAAAGTCGGCATTTTCAAAATCTATTTGGCAAGCTATGTTTTCGG
```

FIG. 15D. Continuation of (CJLB-13-1 [organism=Campylobacter phage CJLB-13] partial genome contig_1)

```
GTTTATACACGAATATTGTTAATAATTGATCTCCTAATTTTTCACGATTTTGTGAAAAGC
ATCCGTGATATTCAAAATTACCTATTGTTTTACCTTCTAAAGAATCTAATAAATCCCATA
GTTTTTCTTGGTGTTCAGCAGGTATAACAATATCAATATCACCGGAACTTTGTTTATATT
TAAAGATTTCTTTTGGATCCATTTTAGGGTTCATAATATAACTCGTGGAACCATTAAAAA
CAAGACCTTTTTTAATCAAAGAATCATTAGCCCAAAGTTTTTCTTTGTATTTGTTTAAAA
ACAATCTATTAAGACTTGTGAATAAATCTATGAATTCAGCTCTAAAAGATTCTATTGACA
ATCTATTAAAATCTATTTTTTCAGCACTTTTAGATTCACCCGTTTTTTATTGATTGTTG
TGGTATTGCCACCTTCTAAAATAAGTATTAATTCAGATAATTTCATTAGTTCATACTTTT
AGTTTATTTATTGTGAACCAAATCAAGGTATTATTTGTTTATTATAGATTTATAAAATTGT
TTTCAAGGATAAATTATCCTTGAAAACTATGCTTTAAATTTGCGCATTATTTCTAAGAAA
TTTTTAGGGCCGTCATTGTAATAAGTTAATTGTGTTTTCGCATCTTTTAATAACTTCACC
ATTGTATAAAGCTTGTCTATTCCGCTGCTGTCTATGATGTCAGAATTAAAAATATCTTCT
AATGCAGCCTCAAATTGGTTTCGGATAACATTCTCGTATTTTGAAAGCCCCATTTTACTT
AAACGAACCCTTAAACGATCATTAAATTTTTTGGAGGCGTCGTCTATATTGTAACCACTT
TTGTCTAACTCAACCCAACTTGAACCGGAATCTTTCACTCTTTCTAATTCAGATGATTTT
GAATTTCGTCTATGTGTTTGCTTATCGCGCATATTTCTCCTACTTTCACTATCGATAGCA
AAGCAGAATACTCTCGAAGTCGCACTTTGGTCATTAAAATCTGCTATACACGTTTTGAGC
GTGGCTGTTAATGTTTTCTTTCGATACATTGTACTAAGTATATAGCCAAGATCGCCGTGG
ATAAACACATATCCAATATCGTGATAGATTGAGGATTTTTCATCAGGGTAAACAAAGAGA
TAATCAAATTCACTTGATGTGTTCTTTTTAAATTATTAACTTCTGCTGCTGTAAGTAAT
TTGATGTCGGCGTTTTGTAAATCTACACGATCGTGCAACGCCTGTATTAAACTTTTTAAT
TGCTTCCCACCCAAACCCGGTATTTTTTGTGCTATATAATTTTGCACATTTTCATTTAAA
GTATCACTATTGACGCTATTAAATAAAAAATCTTTGAATTTCATTTTTAACCTTCCATTT
TAAATTTACACTTTTGTGCTAAAACACTTATAAAAATATTGAATTAACAACTGCAACAAA
GTGCATATATTAATATCATATCTTCATAATAATATTATATTTACAAAAAGCTGAATTGTA
TTTTAATTATTTGATTCTGGTCTTTGTCAAATAACGTCTATATCTTTAGGTTCTTTTTCT
ATAGTAATATAATTGTAATTCAGATTTTTGCTGGCAAGTGCCGTTGTAATTGATTTTAGT
GCTTACAAACAATCACCTCGAATTATCATCATTTTCCTTGTCTTAGTTTTATAATATATT
TGTAACTCACACAAGCTAAAATCAAGAATGTTCTGTAAAAGATTCAAATATCTTTGCATT
TTCTTGCACTTCAAATGATTTATCATTATATTGGTAATATATACCATCAAAATCTGCAAA
ATTACAACCCATCAAGCCAAACAATTTAAATGACAAATAGGCATTTTAGTTCTTTTAAA
CACTTCACAAGTTTGCCTTTTCAGGGTTTCTTTAAACTCAGATACATTTATATATTGTTC
TAATTCAGTTTCATAGAAATTAACTACAATTTTTTATAATTAGAATCTAAACTTAATGT
TATTAAATCTTTTAAAGCATTCATATAATTTAATTTATGTACAGTGTAACGGATAGTTAA
TTTATAGTCTTTAGATTTAAAATAACTTAAAACAAACTCAGTATCTTTTGTAGAATCTTT
ACCATTTCTGTAAACTCTTCTGGAGTTCCCTGATAAATCATAAGATATTTCCAAAGAAAA
ATGGTTTAATAATTTGCGGGTTCTTTCTATAAAATAATCAGCATTTTTAGTATTTTTAAA
ATATGCACCATTTGTAGTTAATGATAGATTGAATTTCTTCTTGGTATGAAATGTTATTTT
ATCAGTTAAATCAAAAATATAATAAACAATATCTGGGTTTAAAAATGGTTCTCCCCCAAA
TATAACTACAGTGCTAGGCTTATCTGGTTCTCTCTTAATAAGATCTTTAAAAAAATCATT
AATTTCTCTTTCAGAGATATACGTGTTTTTTATTAAACGATCTCTATCATTTTTTTGATA
ACAATAATCACAATCAAAATTGCAAGCATCTGTTAAGTATAAAATATTAGATTTAAGTTT
ATATTTAGATTCTATGAGTGGTCTTTTAAAATCTTCATTAAGATTAGAATCTATAGCTGC
TTGGAAGAATTCAGCAAAGTCTTCATCTGAAATCATTTTTGGTGCTTTTTAACTTTTGT
ATATCTCGATTCTTTAGACATTTTGTCTCCTTTGAATGTTTGTGTTTTAAATTTTAGTTT
TAAATTTTATATTATATATTATATTTAAAGTTTTAATTTTTAGCATTTGAATTAGTTTGA
ACTTTAACCTGAGTTCTAAAAAATGGATCTATATATTTTGGTAACACTGTAGTACCATTT
TCTCTATAGGGTGTTTGACTAAATTTTTTAAGTCTATCCTGCAATCTAAATATATTATAA
TTCAATTGCATCTCAGCATCAAACAAATCATTAGAACTTACTAAAATATTTTCAGAATCT
ATGTAATTTGTTGTGTATTGATTATTGGTCAAATAAACTCTGTACTTATTATAATAAAAC
CCAAAATAATAAAGCCTACCTAGTTGTTTAGATAAAGCTTCGGCACGTTCTTTATTCGAT
ATATTAACAAAGTAAAATATAGAATTTTTTGTTTTGATTTAAATCTATGAAATATTGA
TAAGCATCATTAATGCATAATTTTAAATTATCTTTAGAAGCTGTCACTTTTTGTCTCTA
TATTGGTATACATCTTGGTTATTAACTCCTTTTGTTTTAGATATCAAAAACATTTTAGAA
GCATTTTGAATAGGGATATAATCCAGAATAAAAGGCTCTAATTGAGTTGATAAATAGAAC
TTATTATCTCTTGTACACACGTATTCTGTGTAATCTACGTTATGTTTAGATAAATTATTC
AAAAATTCATTGTAGAGTTTATATCGTATTTGTCGATATTATAAATCATTAAGAACCTT
TATTATTTTTATTTGTACACAGAATAAAAGGTTTTAAAATATCATCACTTAACATATATG
GTTTGAATTTGTAGACTACAAATGATTCAGTCTCACCCGTGATTTTTGGTTTCTTTTAG
TTGCTTCTAAATTCAAGTAATCTAATACAGATTTTTCACGAGTCAAAGAACAATTTAAAT
GATCTTGAATGATATATTCTAATACATCATAATTGATTTCATCCATTTAGAACCTTTAGC
TTAAGATTTAAATATACCCATTTCGTATGCTTTTGTTCTTATCAATTCAGTATTGAAATC
GCACCATTTATAAGCTAAATCAAAATGTTCGATGTTGACGTCGTTATTTGTAACTAATTC
ATTATTAGATAAATCAATATCATTTCTTCAAGTAAATCTAAATAACAAGTCATAAAAAT
TAATTTAACACGCTCAATATCAAAGGTATCTTTAGCATAAAAAGTATAATCGTCATAAAA
ATGACTATAAGTTATAGATCTCAACTGTTCGTGCAAATCACTATAAACTTTCGTTTGTTT
```

FIG. 15E. Continuation of (CJLB-13-1 [organism=Campylobacter phage CJLB-13] partial genome contig_1)

```
GATATCATTTATTTGAGTTTTAGTTGTTATATTATATAAAAAATAATTACGTTTTGTTAA
AAATTCTTGAAAGCTATCTACCAAAGATGCTAATGTAATTTTAATATTACCTTTTTTAGG
AGCTTCATATCCCGGGTTTAAGTAGTCCATAATCTCTCTTTTTGTGATTATTTATTTTGT
GTGTTTTACACTGATGGCCACAAACTGGTACCAGCTAGTATTAGCCGGCACAAAATTAAT
TTGTTTCGTATTCTAATTTCTTAGATTCAAGCTCCTTTAACATTTCGTCAAGTTTATAAT
CTATAATTTTATTAACTTTAGATAATTTATTAACAATATTCGGATTTTCTATCGCTTCTG
TTCCAACGTAAGCACCAGCCATCAAATACATAGTGCTGCTTCTAGGTACTAAAATAACTA
CAGCACCAAATATTATACCAGCTATCACACAAATTTTTATACTTTTTGATGTCATTTTAT
ATAAACGATCCTCTCTATCGGCGTGTGATGCCACGTTAAATGCAAAAGACAAACAAAAAA
CAACAAATGTTAAACAAATTACTACTTCAGCTGTGTCCTTAAGAGCATCAAAAACACCAG
CTAAATATATAAAAACGATAATAACATAATTTTTCCTTTATTTTATAATCAAGTTTAATT
GAACGCAATCAAGCATTTGAATCCATAAAGTATGACCCTTGGATTTCAAAAAATCTATG
ATAACTTCTGGTTCTACTTCATCAATACAAGAACAAAATTCAATTTCTTCATCATCAGCT
TCACATAAAACATAGATTTTATCTGTATTATAGAATTCTTCTAAAACAATTTCTAAATCA
ATTGGTTCTGGGTCTCTAGGCATATATCCTAAACTATCGTAGATATTTTCTAAAATATCA
ACTGTTTCAACATCCATTAATTGGTAGTCATAACCAAAATACTCATTAAATCTAGCAACG
TACATTTTATCTCCTTTGTTTTTATCAATATAATTATATAATAATAATCTTAAATTAAAC
TGAAGTTTTAGTAGATTTTAGCATATTTTAGCATTTTGTTCACACTAAGCAAAATTATAC
TTTAAAATCATTGACTTGGCAGGGTTTGTTTGCCCAGTAATTTTACCAGAATAGCTATCA
TCTTGCTCTTCTACTACAATATGATATGGTATCTCATTTTTTTGGATGATATTTTTTACT
ACCTTTTGATAAAGATTGAACTTTCTCGGTATCCCCATAATTTTTACAAATCCTATCGGC
TTTATTGCCAGGTAATCCACTAAAACTGAAAACACATATGATAATACTTTTAGAAAATTT
ACATCAGAATTTAGATAACCATCTTTTTGAATAAAAAGCTCACTATTCACTAAATCACTG
ATTCTCTTCGTGTCTTTATTTTTAAAAGCTTCTACCAACTCATTGAATTTATTTTCATAA
AAGACTCCAAAATGTGGTTCCAACTTTGAATCCTTCATTATTAGGATGCAATAGTATTGT
TTATTATCTACATTAAAAGAGATATTTGCAGATATTTCTTTGCATCCAGAACTTGATTA
AACATATTAATGTATTTCTCACCGAGCTTAATATAATTAGTCTTTTTAGTCAAAGACTCT
TGCAGCAATAAAAATTCTTTAAAGTTAGCTATTGTATTCTCCTTTTTTAATATAATTTGT
GAAATATATAAGAATATATAAATATCTATAATTATATTATAAGTTTTCTTAAAAAGACTT
TAAATGTATATTATTGGAGAATTTTCTAAAATTATAGGTGTTACTAAGGCAACCTTAAGA
AATTGAGAAAAACTATATAATTTATATCAAATATTATATATTCTGGACTTAAAACAGTGG
CTACAGATACAACAGCTGGAACCACTTTAAAAAATCAAAGCTTGTGGAGTTCTTAGAAAG
CTCAGATAAAGTCTGAGAAGAACTATGAAGCAAGAAAAACTATTAAAAATGTAAAGAATT
TTATAGTTCTTTATAATATTTTATAATGGTTTAGTTGGTATTAATAATAATCCAAGAACT
TATTAAACCTATAGCAGCACCCGCACAAACATCTCTAAAATGATGTTTTTTCGCAGCTAT
TCTCGAAAATCCAGTAAAAACAGCTAAAGCTAATAATATCACAGTAGCTATAATTAAAAT
TGTATTATATTCATTTATACCAAAAAATAAACAACCAAAACCAGCGTAAGCAGCACACGT
ATGACCCGAAGGCATTGAATCTTTACCTCCATTGGGTCTAACTGATAATTTAGGAAAGTA
TTTAGAAACTAATTTCTTTAGACTAGCGGATACCAATAATTGTCCTGCAGCTACATAAAG
CCACACCATAGGTGTAATTGTCATATTCGTAGGATATAAAGCTATAAAAAATAAAGCTAT
CCAAAGAGTACCAAATTGAAAAATATCACCTACTTCTTGGATTACGTCAATTTCATCTGG
ATCTAACCCAAAAAACTTTTTGATTGAACCATAATTTATATTCATTTTTTAAACCTTTGG
TTTTATTTGATAAATTAGTTATTACTTGTTTGGCTTTATTTCACAAACATATATCCATA
TTTTTATGTATTAGGTGTTATTTTAAAAAATTATTTAACAGACATATATAACAATAACTG
GTAAACTCTCTAACACCCCTCTTATGTATTTGTTTATCCTTATAATTGATATATCCATCA
ATATTTGTCAAATCTTGCACATCCTCAATTGAAATCATTTCAATTTTATTCATTTTCAAT
GCATTAAAAAGATACGATTTGAAATCTAACATTTTTAAAGGTGGGTTAATAAATTCGTAT
GCAGGTGTCCTTATAAAAAATAAATGATTTCCTGATCACCATAATTATTTAATTCTATT
TTAAATATTTTAGCAAATGCAAAATGTCTAAACTTTATATCCAAACAATACCAATATGAT
TTAGAACCATCTGTGTATTTGGAGTCGCTGTACGGCTTTGTTGCTAAATTATATATTTTT
ATTATTTTATTTAATCTCTTTTTGCTTAATTCCATTATCACTCTTTTTATATATTTATTT
TTCAACAAAAAATACACCACTAAAAATTATAAATATATTGAAAAATATAAGGAGCATAC
AAATTATGTTTAAAACTGATAACAACGTACCGGCTTCTAAATTTATATTAGATTATGATG
TCAACATTAATTTTTATAATATTTACCAATATTGTAGTGATATAAATCCGGAGTTATATG
GTTGTGATTACATTAATTTTGGTACTGATGGTATTATAAGAGATTTATTCAATTATTTTC
GAGGATTATCAATATATTATGATTTACCCAATTATAAAATGATTGACGTCTATGCCAATC
TTTTCAAAATGAAATTAACCAATATTAATCAAGCAGATGTGGTGTATGTGACTTATCCTA
ATGGTTGTACGTTAAATTTTCCACGATATAATATTTGGGAATTAACTAATAAAATTAAAA
TAATTGATTTAAGTTATTATATATACCTCCCAATGTAGAGATTTTACAGATTTTCAGC
ATATGGTAGAAAAATTAAAAAGTAAAGGTTTTTTTGTTATTTATGGCCCTTCAAAAACAC
TAGGCCTTCCTGGTTTACGTGTAGGTTTTTGTAACACAAATAATTTAGAACCTTTTAATA
ACACTCAACCCTGGCAAATTACAAGCCATTCCAAGTTGGTGATAGACAGTTTATGGAACA
AACCCATAATAGATAAACACACCGATACAATAAAAAAATCAAAACAATATTTCATTGATA
AGTTTCGTAGTTTTTAATTTTTGATACTGAAGGTCCTTTTTTAGCGCTGTCTAAGGATT
TTAATACATATGACACTAGGGATTTTGGGTATTATAAACGATTTAGTGTGATTGATAAAG
ACCTTTTAATTTAATCTAATTATAATATTTATGATGATGTAAAAATAGGGGGTTGGCTGG
```

FIG. 15F. Continuation of (CJLB-13-1 [organism=Campylobacter phage CJLB-13] partial genome contig_1)

```
TTTACATTTGAAACTTTCACCATATTCGTATTCCTCTATCATTTCATATTCATTTTTAAA
TAACATCCAATCCGCGACATATTCTTCTATGTCATACTCGGATGTGTTTCGAGCCCTCAA
TATTTTTGCTATTTTATTAAACTCTTTCAAATAAAGATTATAAAAATTTGAACCCGGTTT
TGTTATTATCAGATCAGTCTCAGCAAGCCTTGTCCCAAATATTTTTTTCTTTGATAATT
TTCATCCTCAATTGAATATACACCTAATGCAGTATTTCCTCTAAAAAGCAATATCTCAGA
AGGGTCTCTTAAAACATACATATCTAAATCTATATGTATATGTGTAAAATTTGGATAATT
ATTAGTTGCTGCTTGACCTGCCTTGTAAATATTTACGAAGCCATAGTCAGATAAGCTGTT
GTCAAAATTAACATATAAATATTTAATATTATCAAATGGTAATTTTAGTGTGGTATCGTC
AGTGCAAACCAATATGTCTATGTTTTTTAGTGATCCAACCATTGTTGCGCCAACAATCAAT
ACAATGTAGTAATTCATTATAATAATGTCTAGGCTTATGTATTGTTTTTAACATATTATT
TCTAGCATTTTTTTCATAAGTTAAATTTAATAGTATATTATTCAAACATTTTCCTTTTTT
TATTGCCTATTTTACATCCATCTACTGAACATTTATAACAAGGATAAATCTCGCTGCGTT
TGTGAGCTAACATCAGCGACCTGTGTTAGTTTCGATAGACCAGGCTTTTAATAAGCTCA
TATCCTTTATATTAGCAAACACTAAACGTTTTTCCCAATCGTGTGGACAATATTGTATAT
CACCATCGATATCTACATATAACGCATAAAAGGGGTAGTTACAAGTTGTTTTGTTTACTC
TGGGTTATGTATGAATTATCTACACTACCAGCGCGGTTGTTTATATGCTTATCCTTTAAAT
TGATACTTTTGTCTAAAAACATATCCTTTATTACAACATTTTCTAATGTTTTTAGTCCAG
TATATTTTTCAACTTGTTTAGAATCATAAACTGAAATGTTTAATATTACATTTTGATTTT
CAATTAAGTTGTATAATTTTTTACGAAAATCAAATCTTTTAGTAATTTATCACCATTGG
TTGTAATTCTTATATAATTTGTAGTTTTTTTTAATATATATTCAATAAATTCTAAAAAAT
TAGGGTGTAATGTAGGCTCACCACTGCCTATGATATCGATATTAAAACTGAAATCTTTTA
TGTTTGATATTTCATCTACTATACGTTTAAAAATTAATTTATCCATAAATAAATTATTAA
AATTGTTTAAAAATTTTTGATATTCAACATTACTGTGTGGACATATTGTACAAGTTCGGT
TGCACTTACGTCGATATATTAATTTCTATTTCTTCAAAATTTTTTGATTCTTTGTGTAAAG
ATTCTCTCATTTCTAAATAATTATTCACATTAAAGTAATTCATTATAAACCTCATAATTC
AAATTTAAATATTGTTTACATAAATTTATAGAGTAGTTTAAAGCTTCTCTGGTCACCACA
CTTTTATCAATGTCTGTATATTTGTCTATACCAAGATGATTTAAAAAAATCATCATAACAA
ATAACATTTGCGTATTCATTGATATCAACCATAAACTTCTTAAATTTTTTAATTATATTT
ATGTTATATTGATCGTCACTCTCAGCTGTAAAAAAGTTTAAAGATATTGCTATCACAGGG
TCGCGCCACACACATATTTTTAACCAGTCATCATCAAAATAATTAAAATATTTTATGTCA
AATTTTAATACTTCGTATTTGCCACGCTTCTCAGCCAATCCTTTTAACCACAAATCATTT
TTTGCTTGTAAATTTTTTAAAATATTATAGTATTTTTTAAACTTTTTTAAATTAAACTTA
GTATCAAATACATTATTATAAAATGATTGGTTCAAATCATCATAACTATATGTATATACA
TTATGATTGCGAAAATTTAAGTATTTAAGAATACCTTTTACACCACAATAATCGTAAACA
TTAAAAAAAACAATATTTCTTTCAATATTCTCAAGTTCTGAGAAATTTAAAATGTTACTC
ATATTTTGGATACCAACATAGTTCTAAACATTTACAATTTTTATGTGGGCAGGTTACTAC
AATATTATCATCTATATTTTAATATGCTTAAAACAATCATTCATAAAAGTGCCATCAAT
ATCTAATAAAAAATTTAAAGGTTTGCATTTTATATCTTTGGTATTTAGTCGTAATATTTC
AAAATTATCATCCAAAATATTGTCGTGTGTTTTGTATTTGAGATTCCAATCAAACATATA
TAAAATTTTGCTATGTTTTTTTGCAATACTATCCAATGGCACTCCATTACAATCGTGTAT
AGGATTTATAAAATAGTTAATATTATGTTTATCGAACAACGCTACAACATTTTCTACAAG
TTTGAGTTTTACCGTGTTAAGTGATATTATTTTACGAGTCTTAATTTTATAATATTTAA
AATAAATTTAAAAAAGTTTTTGCCGTGGTAGGATGCAACTATAAAAACTTTGCTATTGTT
AAAATTATATGAATGTAGAGGTGCTGTTAAATTTGTTATGAGAGCAATCTGATTTATATA
ATTATTATGCACTAGTATTTCCACAATTTTTATTCAATTTGGGGTGTAAAGTAGGCTCCCC
ACCAACTAATTGTATATTAACTGGTCTGTGGATATGTTTTTTAAAAATAACATCAAAGT
TGATATTTTTATAAATTTAGATTTATTAATATTATTGTGATAACCAATACAATATGAACA
ATTGAAATTACAAGCGTCTGTGACGTTTATGCTAATTATAGGTAAAACTTCTTCAAAACC
TCTTACCAATTTCATTTGCGGTACTCCATTATTTCATAATCTTCACAAGCTATTTTTTA
CAATTTATATCAACACCGAACATTGTTTCTAATTTATTAGATTTAAGTTACGACATTTA
GACGTAAATATGCCATTATCATAATATATCAATTTGGGGTTGCATAGACAACCCAGTGAT
TTATTCAGATTATTTTAAAAATATTAAAATATTGTTCATCCCTAGTTAGATTAAATCTA
TTGGTTAAAATATTTTATTGTTTAAGAAGATTTGTTCAAAAAATTAAAAATTTTTCT
TCAACAGGAACTTTCAATCCTTTTTTATCCGTTAAAAAAATTAGAAAAAAATGATAATTA
TTTGTACTGAGAAAATCAATTATTTTTGTAGGGTAACCTAAAACTGGTAACGCTACATAT
AGTTGTTTATTGTTTGTTTATTTATTATGTTTATAAAACTATCTTCATCAATCTGATTA
GGATGGTAACTAATAATGGTATGTACTTTTTTATAATTATTTAATTTTCTAAATTATTA
CAACTACCATTAGTAGTTATTATCACCCGCTGTATATTTTAACGTTATTTAATTTTTCA
ATAAATTCTAAAAAATTAGGGTGTAAAGTAGGCTCCCCACCAGTAACTTTTATTATAAAA
CGACTTAGACTTTTTTCAATTTGCTTTATCAACATTAAAAAATTAAGTTTAGTTAGAGGG
TTTGAATTCACTTTTTTAACTTGACTTGATGAACAATATTCACAATTAAAACCACAATAA
TCTATTAAATTTAAAACTATGACTTTACACATATTTTATTAATTCATCCGCTCTATTCAA
GTCTAAAGTAGAACAATGTATACCACCGCCAAAAAACTCAGAATCTTCTAAGTCAACTTC
TATAGTTTCTATACCACGTTTTTCTAATTCTATTTAACTTTATTATACGAATTGTTACT
TTTTGATATTATACATTTATTTGTAGACAACATTAAAAAAATTAAGATTCATACCCATTTC
AGAACAAAGACAAACACCATCCTTACGATGACCTTTTATATGTTCAATTTTAACTATTTC
```

FIG. 15G. Continuation of (CJLB-13-1 [organism=Campylobacter phage CJLB-13] partial genome contig_1)

```
CCAGTTCTTAAATATTTTCGGTATCCTATTAGTGATATAAGATAAATCTTTTACAAATAT
TAACCCCGGTCTAACTATTCTAAAAGAACCATCTAAATGACTAGTATCCATAGTAACTAT
ATGCATATTAATATCTGGATTAATTTTTTTTAATTCTAAAAACATATTGTATTGAGAATC
TGATGCTACATTAACTATCCAGTCTTTACCTAAAGGTATTATGTTAGCACCATCCATACA
AGCTTCAACCTTGTTATTTTCTTTTATTATATAATTTAAAGATTCTACAGATGGTTCATT
TTGTATTTGCTTAAATTCTACAATTTTGTTTATATTTTAAAAATATTTTCAAGACATTT
AAATTCATTTACTCTGTATTTTAATGGCAAAGCCATTTTATAAAGAGTATCACCAAAGCA
GAATAATATATCTCTAACATTTGAAGGAATTATATCATCATTTATATAATCTGGTCTCAA
TACTTCTATGCCATTTTGTTCTAAGATTAAACTTAATGAATCTAATTGTTCTATACGTTT
TAACACTCTATTTAATGGGTGTGTTATTAGCTTAGATTTAATACCATAGAAGTTAGCACC
AATAGATGTTAAATCTCTTACTAATTTACTTGTTTCTATGCCGACAATTACTGTTTTAAG
GTCACCAAAAGTTGTGTGACAATTAACATCAATCAAAGCTAAATCCTATATAAATTTTTT
TATATTATATCTATTTTTATTCATTAAATACAATAAAGATTTTTTATAAACATTTTTATT
ATTTTTAATAATTTGTTTCAATAATTTTATATTTTCTAATGATAAATTTTTATAATATTT
AATATCTTGTGGTATATTACAGGGTATAACATCAAAATATATATAATTATAAGTTTTTAA
AAAATTATCTAATTTATGAATGTTATCATCAGTTACGATAACTAAATATTCTATGTTATT
CTCAGTGTATGTATTTTCAATGGGTTCCAAATCTACAGTACAATGGTAATAAATTTTAGT
TGCTTTATCTACAAAATTTTTATATTTTTTTATAAATGTTCCATTCGTATTAACAGAAAC
ATCACTATGTATACTGAATAGTTTTAATTATATTTTCTGGTATCAGACCAGGTTCACC
ACCACTTAATATAATAGGGTTATCCAAATTTTGTTTAACTTTTAATATAATATCTTCATA
ATTAGGTGTTTTTTTAGAATTATGTATATTTTCACAACAATAATAGCAATTCCAATTACA
TTTGGTTGTGCAAAAAATTTCGATCATCTCATCTCCACTTTTTAAATTCAAGCCCTCTAT
GGCACTGCTTAACTCTACAAATTTTATAAGGTACAAAAAAATTATTTAAATCTAAGTCTT
TTAAAGGTAAACCTTTTATTTCTTTATTATTAAATTTATTAGATTCATCATCACAATGGT
AACACAATTCATCATAATTGATAACCAAGCTTTTAGATCCAACTTCACATTTACAAAATC
TACATTGTTTATATAATCCTTCGTTATATGCTTTATCGTAAATAACTTCTTTAGAATCTA
TTAAAAATGTAAATTGTGTTTCCAAATAATTATTTAAAAATGGATAAGTTTTTATTAGTT
TTTCATAATTCATATGTTTTGAACCTGGGTTAGCATTATCTACTGTAAATCTCATTTTTA
ATTTATCAGGTATTGCTTGCGCTAAAGCATTAAATTCTTTTATGAATTGTTGTTCTTGAT
CTAAATACGTATTCATAAAACAATAACCTAATATATTTAATTCTTTTAATATATTAAGTT
TTTCAATAAAATCTTCAACTTTTTGTTTATTCATATGATAAGAGGAACAAAACTCAAAAT
TATTATATTTAAAATTATAAAGTCTATTTTTATCTATACTTAAGTTTGTTTGACATTGTA
TAAACAAATCTCTATCTTTGTAAACTTCAAAAAGATTTTCGGTAAGTTCTTCAAGGTGTT
TAAACAATGTGGGTTCACCCCCATAATAGTACACAAATATTTTTTGAAATCTATCTGGGG
TATCTTTTAATTTATCTACGAGTCGTGTAATGGTCGATCTATCCCATTCCGGGAATGTAT
TGTCGTATTCACAACAAAACGAACACATTTGGTTACATTTATAAGTAGGTTTTAACGTTA
TTTTCAAATCTGGATTATTATTATAATTTTTAACTTCTAGTGTTTTAAACAAATTTTGAC
CTATTATAAACATTCAATATTATATAAACAACTTTAATTTTATATATTATACAGCTA
AGAGTGATCCTAAAAACAACACTATAATTGTAAAAACTACACACAATAATATAGCAATAG
TTATAGAACCTATGACACTGACTAAATACGAGAACATAAACGTATATAAAACAACTACAA
ATATAGCTATAAGCAAAACAAATAACCCCGTAAAAAATCTTTCTATTAACTTCTCAAAAG
AAAACTCACTGAAAATATTACAAATTCGACTTTTTAAATTCATTCTAAAATCCTTTATTA
AAATTATATTATATAAAGAAATAACTTAAAAGTTTATTAAACTATATCATCGAAATAACA
AAAAATGATGCAATTGCAAAAACTATGCATAATAGCAAAGCAATCATAGGTGAGCCTATA
ACAACACTTAAATATAAAAATACACTTAAATATAAAAATGTCATAAACATAGTTATACAC
AAAAAGAATACATTCAAACAAAATAGTACCAAAATCTTTTCAAAAACAGATTCATTAAAA
ATTCTACAAATTCGACTTTTTAAATTCATTTTAAAATCCTTATTAAAAGAAGTAGAAATT
GTGATAAAATCAAAAAAAAATGTAAAACATAAAATAAGTCGTTAATTAGCTTACGATTAG
CAAATGCGAATACGGTTCGTAATTTGAAAATCTTGAGTACTTTCGTACCCAGATTAATCT
AGGATTTATTTCTTATATACAAATACATTCCAGAATCTAAAGTAAATCTAAAATTTTTAG
AATTCACTGAGTTTAATTTAATAGTTCCTTCCATCACGAATATATCTGCTTGTTTTTCTT
CCATTAATTTATTAATAATTTTTTTGAATTTTTTGGTTTTATAGCTACGTATTCATTAT
CTTTACCACGATAACAAGTTATGATAATATAGCTTTTACCTTGAAGCATTTGTATTCTAT
ATTTAAAAATATAATAATATATAAAACCTTTAAAAAATATAAGCAGAATCATTATTATCTT
TAAAACAATCTATAAGTTTCATTAAACTCCTTTGATATATTTATGAACTAACATTACCAG
CACTATTGGAATCCACTAATAATGATATTATAGGGTCTTCAAGGCTCATAAATCTGGATT
CTAAATCATAGTCAAATGCTCTCAAATTAGCACCATCAAAACAATCTTTATGTTCAACAA
ACTCATAAGGGACACCAAAATATTGACATTCTTGAAATAATCTAGGTTTTACATCAAAAA
ATACAGGATCTTGTATATATAACATTTCATTAAATTGTTCGAATATATTAGACATAATAT
TTAAATCACTTCTAGTTATTTCAGATTCTTTTTTAATGTATTTTGCTCTGGTATTAATAA
ATTTTTGATTCTTTTGAAATCTAGGTTTATTCAATATCTCAAAAAATATTTTACTTCTAT
AATTAACTGATTTACCGACAGGTTTTAAATGCTCGTATTCCACAAAATAATTACACTCGA
GTGTATGATTTTTTGAGCCCACTTAAAGCATATAAATTCTTGCATTTTAAAAATGGTTTAT
ATCTATCGAATGATCTATACAGTACATTTCAAATAAAATTAAATTATTGATAGACATAA
AACATTTTTTAAATATTATAATATTCTTAAAACAATCTTTATTAATATTATATTTAATTT
CAAGATATTTTTTAACAATCTCAAGAGATTCAAAAGTAGTATCTATTATAAGAATAATAT
```

FIG. 15H. Continuation of (CJLB-13-1 [organism=Campylobacter phage CJLB-13] partial genome contig_1)

```
TTTTATTATATAACCAAGAGAAATAAAAATATTCAAAAGCATTCGAAAGTGACCCATCTA
TGGGGATTCTCGATTTGCAAGGTCCTATTAAAATAGCATTCGTATTCATAGCTTTATAAG
TCTAGTATTTTCAGCCTTTTTAGTATAACAAGCATAGGTTAGAACTTTGATATATTATCA
ACTTCTAAAAATTTAAGATTACCATCTTCACAAACTGAAAGATCTCCAAGTCTACCATAA
TATATTTTTACATTTTCAAAATAATTTTCAGAAAGGAAGTTATATGTATCGGCCATACTT
TTAGGAGAAGTGTTTATATAAAAATTATTAGCAATACGTTGAAAATTATTATCAAATAAC
GTTAATTCAACATCTTTGCTTATACTTTCACTAAAAGAAATAAAATACATATATTACTCC
TTAATTAGAAATTTTTATCCACAAATAACATTTCCAGATCCTTGCGCTACAGCTTGCCCA
CAACTAATGGCATCACCTATTCTACAAGCAGGTTTTGAATTGACCATAACAGTACCAGAA
CCTGTAACAATGCTTCCACCGTGTGGTGGTGACGGGCTAGGACTTGGGTGTGGTATCATA
GGATCACCTTGTCTAACTGTACTAATTGAATTAGTCAAGACATTCGTAGAACCACTCGAA
ATTGTATTAGGCGGAAACGAAGAATGCCCTGTACTAAAATCAACACCAACTCTAGTTAAA
GGAGGCATTATTTAGCTCCGTTTAACATATCTTTTAATATCTCTTTATCAGTTTTAGATT
TAGTTTTAGCTTTTGATGCTTTAGACTTACTTTCTTTAGCTTTAGACTCAGTTTTAACAT
CTTTGACTTTAGTTTTAGTTTTAGTTATCCCGGCTTCGGTTTCAGACTTTGTATTTAAAT
ATCTAGTTTTGGCATTACTAGTAGATATTAAATAATCATTTAATTTAATATGAACGTCAA
TACCTTTAATTTCTTCTATAATTTTATTGCGAGTGCATATAACTTCTTCTATACAAATAG
CTACTAAAATCAAAGCATAAGTTGCTGGCTCTACGACAACCTTACCTGCTGTAATTAAAG
ACACTATATCACAAATAATTGATATTATTAGTATTATATAAAATGAGAACTTAATATTTT
TGAATATTTTCATTTAATTCCTTTCATTGAATTTAGTTTAGTTTAGTTTAGCTTGATGAC
TCCAGCAGACATAGTAATACTAGGTCCTGCTGAAATTGTTTCGCTGCCGGACACATTTAT
ATTCTGGTTACCAGAAATTGTTACATTTTCATTACCTCCTACTTTACGTGTTCTATCAGA
ACCTACCTCTAACTTTTCGTTTGACTTAACATTTAAATTGTGGTTAGCGTCATATTTCTC
ATTAACGTCTTTTTTAACGTATTCATTTTGTTCACCATCGATATGTAATAAATTATTTTC
TTGTGTATATTCTTTTTTATTCTTTACAGTATTGATAGTCATTTCACCATCTTTATTCAT
AGTAATTGTAGTACCAGTTCTGTGGTGAAAAATAATATTACCATCTTCGTCACTCCATTC
TTCGTAATGACCTGTAATACTATCATATACTCTAGTATTTTTAGGTTTTGTATTTTTGTG
TATTTCGTTTTCACTTGCAATGCAGCCTATAACAATAGGTAAGTTTGGGTTATTATTGTC
TAAAACACAAAATACCCAAGTTCCTGGTGTTAATATAACGTTATAACCAAATCCTGGATA
TTTTCCAGATCTTGTTATAGTTTTGTATCCAGATTTAGAACCTTTACCATCTATATTGTT
GGCATATTCATCAGAACCATCTGAAGGTGCTGGGTAATAACCAATATAATCAATACTTTG
CATAACTTCTGCCCAAGGCAAATCACTTTCCTGTATTTGATTATATTTAGTGTCCTTTTC
TCCAGAAGTTACTGGATATTGGCCAGGAGTAGCATTTTCACTCATTCCGTGAAGTTCAAA
TATACGAACTTGAACTCTACCTCCTTTTTTAGGGTCATCATTATTAACAACAATACCACG
ATATATTCTAAATTCTGATTTATTCATCAGGTACCTTTATGTATATTTATAACATTTTAA
GCTGCTAGCACATTCTAAATACTAAAATACTTAAGATGCTAACAGCATTGCTGTAGTACG
TTTAAAAACATTTAATGGGTCAATAAAATCATTAACACAAACTAATTCACCCTCACGATT
AAAGAAAATATTATCCGGAGTTACCATAGTTGATTCGCGTCTAAGAATATCAAAATCTCT
AGCATCGGTATTGAAAAATGTTTGCGATCCTGAATTTCTTAAAAAATCATTAAGTTCATC
GAATTTTAAATCTTTTGTATTTGTAATAATTATACCCTTTGGGTTCTTTGTATTGAATAA
ATAATTGCGTGTAGTTAATTCTATAAATTCATTGAATTCTTTTAGTGTATCCTTAGATGG
TTCTTCATAACCATATTCAAATGGTATAGTACTAAACTTGTCAATAATAGAGCCTGAGTC
AATAACAATTTTTCTATATAAATTTTTATTGTTTATAATAAAATCATATTTAATTGAACC
AAACTTTACACTTTGTGTTAATTCTGGATCCAAAATAATTAATTTAATAATATTATCAAT
AGATTCTTTAGTATCTATAAAAAAATAATTCAGTACTTAGATCAAAATCATCGGATAATTC
GAACTTACCCGGACTTGTTTCTTCGTAGTCTTTAAAGAAACGAATAGTTTGAATACTTGG
GTTGACGGCAATATTAGATAATTCAATTGCAGAAATCATTTTTAAACTCCTTTAAATGTT
TTTTTTACATAACAAAAAATTAAAGTCGATTTTAACCGTGTTTTTGAGTGGTTATAAC
CGTATTTAGATTCTAGTTTTATATTTTAGAGCCAGACATATAACACTAAAGTGTCGTATG
CTTAGAACTAGAATCTAAAATTGTTTTATTATATAAAAAAAGCTTAAAAATTAATTAAG
GAGCTGTAAAAGCTCCTTGAATTTACATTATGAAAATTTAGGGTTTAAAAATCTACAATG
TGATTTTGGTGTTTCCCAATATTCAACTGCTACAACATTGACGTCTAAATCTTTTAACAT
TTTTTCAGCTATTTCTAACCACCACTTACATAAGTTTTCACTAGTAGGACAAAAATCAAC
GAAAACAAAACCTTCTAATTTTTCTTGTATAGCATTTTTATGTTTTGTTGGTTGTATTT
AGATTTTATTTCATCAATAACAGATTGTTTAATAGTTTTATATCCATATTCTTGAGTATC
GAAATATTGTGGATCTAAACCATCTAAAGATTCTGAATATAATTCTGGTAATTCGTGGAT
ATGACCTGGATCATTAAAATCCCAAACAAATTTATGATCAATAACTTCATCAACTAGTTT
TTTATAACAATTTAAAAATTTGAAATCTAAAACCATATTATTGATTAGTTCATCTGAACC
TAAGAATAGTTTTATTACGCCACTGTGCGAATGATGATGTCTGCAAGCACAAATACTATC
GATACTATATTTTGGATCTAATGTTTGAGTCCAAACTCTGTGACCCATACAAAAATCAAA
TTGTTTGTCTATAGTCCATTTAAATGTTTTCATTTTTACTCCTTAATTTTCTTTATTATA
ATATAACAAATCTTAATTTCTATTTAAATTTCGCATTTTCTTAGAACTTAACGCAATATA
TCTATCACGATTAGCATAAAAGATATCCTTATGTATTCTAGTATTTTTATTAGTTAATGT
ATCAAATACTGGAACTACACCTTAGGTGCACCTAAGTATTCAATATTACGTTTTGTTC
TTTAAATTTTTTATATATAGATGATGGTAATTTAAAATTTTACCGTCTAACATACATTT
AATCAAAGATTCATTTATTATCTCGTGGTAATTTTCTAAAGAATCGTTGAATATACTTTC
```

FIG. 15I. Continuation of (CJLB-13-1 [organism=Campylobacter phage CJLB-13] partial genome contig_1)

```
ATAAATCTCTAATTTTCTATTATAAACGTTTACGCGTTTTCTTTCACCTGTATTTTTTAC
AACAACGGAAACTGTGCCAGTAACGTCAGCATACCCACATTCACATTCACTATTAGCTCT
ATTAAAATAATCGTCGTTTATAACCACATTTAATTTTTTATGTAGAAAAGCTTCGTAATA
AAGTGCTTCTAACCTGTTGTTAAAAACTTTAAGTATTTTTAAACTGTAATTGTCAGGATT
TTTTAAAATATCATTTTTCTACAGCTTGAAGAACCGTAACTCCAAAAATCCGATATCAGA
TCAGTTTGTTTAGAAGTTCTAAATCCTATGTATTTTTTATTATCAATATTTGAAGTTACT
TCATATACATAAGATTTAAATACTTCATCAGCTTGATCAATAAAATTATATTTTAATTTG
AATTCTTCAAAATCTAAATTATTCAATTAAATAATCCTATTGATTCCAAACCCTATGGCC
GTAACAACATTCAAATGTTTTACTTATATTAAACATAAAATCTCCTTGTCTTAATCATTC
ACTTCAATAGAATCTATATTATTAGTTCCAAATATAAATTCTCCAATAGCATTATAATAC
TCAGTATCTTTAATAACACAACGAATATAACCATCACTTGAAGATTTGAAAATGTGTGCA
CCACCGCCTAGCACAACCAAGAAATCTAGTTTATCCAATATATTGCTATATCTTTCATTT
ACTAATGCTAAAATTTCTCTTAAGTATTCTTTTTTAATACCTTCAATTTCTTTAGTATAA
TCATATTTTTGGCCTCTTAGTTTATAAACACCCGTATCTAAGATTTCTCTAGCCTCTGGC
AATGAAATAGATCTGTTGTGTTTTCATTTACTAATTTAGCAACTTGCGAAGCTATTTTC
ATCAATCCGTGTTGTGAAATTCCTTCGAATAATTCTGGTGAAGTAACTCCTTTATTAACA
AGAACTAAATCTAATGTATTGAATCCAATATCCACAATACAATATGTTGAATCACCTAAG
TATTCTTTTTGAAGATTTGGAAAATCATTTCCGAATTTTTCATAACTTAACTTAGCTCCA
GCTCCTTGAGGTAACAACATTACATTATAATTGTATTCAGTACCATCAACCACAAAATGA
CTTAGTACATTTTGAAAATATCCAGATTGTTTAATTTCTGCAATACTTAATCCTGAAACT
ATTAAATCTACTTTACTGAGTTTAGCAATTTTCACTGCGTGATTCAATAACAATGGTCCA
AAATATTCTAAATTCTTATAAGTATCTAAATCTATGATATTAGAACTTGGTAAATGTTTG
GCATCTTCACCTACCATATAATAACGTTCATTGTAATGAACTATATTATCATTTTGAACA
CCTTCAAGTTTTTTGGTTTGGCCTATAACACTTGGAAATTTAAACTTTTTAATTATTTGA
CCATCACCAGTGCCTACACAAACTTTAACAAAGCTGTAACCTATGTCTACACCTAAAATA
ACTTTTTCTGTTTTCATTAATATTCCTTGAATGGATTTACATTATTATATATTAAAATTA
CTTAAAACAAAATTAATTTTTAGTTTTAGCTTCAGTCTTAGATTCAATTTTAGACTCAGC
TTTAATTGAAGCTAAAGTTTCTAAACCAAATAACAAAGAATCTACCAAATCGATAGTAGC
ACCCACTATAGCATTCAACGCAAATTTTAAAGTAACGTCGTCTAATTTTTGTAGTCTATT
TTCACCTAACATAAGCATATCAATTAAGTGTTCTGTGTCTAAGAGATAAATTTGTTTCTGA
GGTGTTTATTATTTCACAAATTTTATTTAAATTATTTGCAATATAAAAAATACCACTTAA
AACTAAATCTATTTCTTCTTCTGTATAAGCATCTGGGTTTCTCAAAATATCCTTAGCTAT
AAGAATAGTTTCATAATCTATATCTAAAGATTCAATTTCTTCACTTGATCTAAAATATTG
ATTTACATTGTATTTAGGAATTTTGTCCTCGTTTTCATAGATAGATTCTAAGTAGTCTTC
TAAATAAGATTTCAATCAATCTCCTTTAATTTAAATTTTAAGTATTCAATAAACGCATCT
AATCTATATAACTTCAGAGCTTCATCACTTAATTGATATTTAAATATTATTAATTCAGCT
AATATGCAAGCTATATGATTTTTATTATATAGTTTATTAAATATATCAATATCAATTTGT
TTAAATAAAATAGTTTTATTTTTATATGATAATGTAAGTATAAATACTATCCTCTGAATTT
TTATTAAGATTGCAATTTATTGGTGGTATAGGTATACACAATTGTGTTAATAGCATTATG
AACCCTTAAACTTTTAATTCTTACTTAATCATTTCTGTATAACATCTTCACATCTTCTAA
AACTTGAACTATAGCTTCGTGTTTTTCATACCACCATCAATAACCAAGATATCAACGTT
ATTATTGAATATCTCACAGAAATATTTTCCTTGATCTTTACCTTCTAACGATTCTTTTAA
TTTTTTAACGTTTCATAAGCAACCTACTCTTGTAATACGATAAAGTTCTCCAATAAGTTT
ATTTTCTAATAATTTTACTTATTGGCTTTATTGGCTTGTCTTGCCATTTTTTCAACTATT
TTATATAATCTTTTATATTCGTCTATAATAGATTTTATGATAGCTTCCAGATTTCTATTA
CTAATGTGAGAAACAGAAACATAATCGGATTTTAACTCTTTCATAGCTTGCTTGATTTCA
TCTATATAATCTTTGATGATTTCTTTGTATCTTTTCAATTCTTGTGATTGGAGTTCCTCT
CTATACCAAGGCATCTTGTCTTTATAGCTAAGTAGATATTGATTATATTCCATACTTCG
TTCAGTAAGTCATTATAAAGTTTATAATATTGTTTGTTGCTATGCGGACCATCAGCAAGC
TTGTGTAGAATTTTTAAAGCTTTCTTCCCAAGCGATTCTATATCTTTATAATCTTTTTTG
AAGGCCAGACCTGATTTGTTATTGGCTACATTAATCTCCTTGAGCATATCATCAATAGCA
GCTTCATTAATAATGGCTTCATTAATAAATTTCGTAAACGTCATTTGTTACCCTTTTAA
TAGTTTAATTTTATACATAATTATAACAGATTAACCTTATAAACTTATTTATTACAA
ATTATGTATTAATATACTTCTTTCCAATATTATAATCTATATACTAAATCTAAAATCAAA
ATCTTTTAATCTTCTTCCATCTTTATCAAACCAATTTTCATTTTAATCTTCTAACAAT
TTTTTAATTTCTTCTTTTTCTTCTTTGGAACAATTTTCTAGTATTTTTTCTACAATTTCT
ATCTTGTCAGTATTTTTAAAAAACTATTTATGAATTTTTCTTGCTCTGTATTATACAAG
TTTTCATAAATTACAAAAGCTTCATCTGCTGTAACGCCTTTTAACTCATCTGCGTTAATT
ATCATCATTTCAAATTTCATTTTAATCTCCTTTGATTTAATTTATCAATGTAATTATATA
GTAATAAACTTAAAATAATATTAAATTAGCTAGCAGAGTCTAATTTTATTTCTAAGTTCT
CAGTATTTGTATTCACTTCAAGTGTGCTAATACCAGAATCTACAAAAGATTTCATAGTCT
CTGGTTCTTGTTTTGAATCTTTATTAAAAATTTGTTCAGCAAACTCAGTTATAGGTCCAC
GAACCACATTAATTAACTCACCACCCCAAGTATTAATTATGCTAGGATTTTTAACTGCAT
TTTGAAGAACTGTTAAAGCGTTGTTATACTTATTAATATATTGATTGTCTATTTGTGAGT
TTGAACCAATTATTATAACTTTACAATCCTTGTCAACTCTTGTTAATATGGTGCTCATTG
ACTTAGTAGAGATATTTTGGGATTCATCCACAATAACAAACGCATCCGAAATTGTTCTAC
```

FIG. 15J. Continuation of (CJLB-13-1 [organism=Campylobacter phage CJLB-13] partial genome contig_1)

```
CACGCAAAGCACCAATCCACATAGTTTCGATACCAGATAACTCAATAATTTCTTTAATAC
CTTCTTGTATTTTAAATTATCAATTTTAACTTTTCTTGATTTATTATCATTAGATTTTT
CAAGTCTTTTTCTAACAATATATTCTAAAGAATCATATAGTGGGTGATTAAAAACCGCAA
ACTTTTCGTCATTTCCAGCAAGATATCCAATATCTTCACCTTTATCTAAAGATTCAATTG
AGTTACGTATATAAACAATTTTACTATATTGTTTTTCTTTAACTAATCTGATACCAGTCG
CAATAGCTAATAAGCTTTTACCTGATCCTGAAACTGCAGAAACAACTTGTAAATCTACAT
TAGTATCTAGCATAGCATCCACGAAATATTTTTGACGGATATTAATAGGTTTGACATCTT
GTTTTTCCAAGTGTTTTTCGTCTATGTAATTAATTCTGTGATTTTGTATCCTTGCTAGTT
TTTTATTACCATCTTTACTCTGTATTAAGTAGTTATAATTTTCGTGTTTATAATCTGGAT
CTACACTTAAAATGCTGCTAAGATTTTCTGGTAATTTCTCAACATCGAGAACTTTAAAAA
ACTCTGGAACTTCATTAAAATCTTTTTTTAAACCGAATGTCTCAGTTTTTACCCCTTCAG
ATATAGCTCTTATCTTGCACATACTATCATATGTTATAAAAATACAATCTGGATATAACT
TAGCAACTTCTATAATTTTTCTATCATTTAGAATATTAATAGGTTCATCTGCGTGTTTAT
ATTCTTTTTACTAGTAATAGTTACTTTTAAAAGAGAATCACCCAGTGTTGTCTCAGTAT
AGTCATTGAATTTATTAAGTTCAATGACATCAAGATTTGATAAAAGTCTTGCAAAATTAC
GGGCTTGGTATCCAACTTCATCGAATAATGATTTTTTAGCATCTAATTCATCAATAACTG
TTTCGGGGATTATAATACGATTTTCACTATCGTATAAACGTGAGAGATTATTTACATCAT
CTAAAATGATGTTGGTATCAACGACATAAGTTTTCATTGGAGCCTTTTGTCTTTTGATTT
TATTTATGATTTAATAACCTGAGTTTTAAATTACAAAAATTTAAACTTTAGTTTTAGTT
GTTTTAAAAGCTTTGAACTTTAGTTTAGATTGTTTATATGTTATGATATTATAATATTAT
AATCTTATAAGCTTTAAATTAAAAAATGTTTCATTTTTTAGATTTACTTGAAACTTTTGA
ATCCCTAAGCGCTTTCTTATACAAAGCTTCTGCAGAAACACCTATAAAAGTTTCTGTTTT
AGTTTCTATAATTTGTTTCATATTTTCATTAGGTATTTTGACTGCTCTTCTATATATTCT
GCTATTAATATAAAGTCTTATTATTGGAAAAAATCCAAACTTTTTGAGCATAGGCTTAAT
TCTATACCAATCTATATCTAATGGTTTATTCTCTTTAATATTCTTTTTATTTAGTCGAAA
TATGGCATTTAAAAGCATTTTTCTCATTGGTATCGGGCACCAGTGAAAATTTATACCTAA
GGTATAAGATTTAGATTTTCTGAGTACCAGGCACAATGGAGTTCTATCATATTTAACACT
GGTATCTTTAGGATTATATTTAAAAATTACTAAATTACCAGGTTTTAAAATTTGTCCTTT
TTCAACCGATTTGGTTTTAATAAGATTTTTAACTAACTTTAAACTATCCATTTCTGACT
GTTTTGAAGTATTTATGAGTCTGGATTTCCAGACTCTTAAGAATTATTGGTCTACAGAAA
CTACGTTAGTAGCAGCTGATTTACCATCTTGTGGCATATTAAATTCAGATCCATTAGAAA
TAATCCAATCTGAGAAGCTAAATGTGATATCACATTCTTGTAATGTATCTAATTGATCAG
CACCAACACTAATTTCACCAACACCACTTGGCCAGCAGTTTCTTAAAGTATATTCAGCAA
CTTCATTTTCTAATGAATCTAATTGACAAACCGAAACTTCTGTAAATAAACCTCCTGGAT
TACCAGAATGTGTATTTGCTTGGAAGTTATCACAAGCTTTCATCCAACTTAAGAAGTCTT
TACGAGTTTGGTGTGCATTATCCATATAAAATGTCACAGTCCATTGTGTATCATACGAAG
TATCACCAGGTATAGGAAGCTTTCTTCCTTGGTTAAATACTTCAATTTGTCCAATAGTTA
CACCTGGAAAACTAGTAGCTTTAGCTAAGCAGTTCAAGCTTTGTAATTCCATTTTATGTT
GCACTTCTGTTGGAAATGAAAGTTTAACACGGTATTTTGTAGCTTTTGCACCAGATTTTA
GTGCGTTTTAATTTCTTCAATTTGTTAGACATAACTGTTAAACCATTCCTTTGCTTTT
GTTTTATTTATTATTTTGATGATTTTTATGGTTTAAGATTATTTTAAGTTCTAAAATTAA
AATACGACACTATAGTGTTAAACTTTACACTATAGTGTGAAATCTTCTGATAGGAGCAAG
TAATGGTCCTTCAAAAATATAAGGATAGAAAAGATATACGAGTTCTAAAGAATGTCTTGA
GTTTGTGGTAGTGTTCTACCTCCCAGTCCTTCATAAAAATATTATAGAAGTATCCACAGT
TCGCTTATCGACATATGTCTTAGCAAGGTAGAGACTATTCTGAACATTGATTAGAACTAT
AAAGACTTCCGGTGTGCTAAGTTTATACTAACAAATTCCCGATTAAATAAGAAGTATGTA
TGATGTTCTGCACATAAAAGTCTTTATAGTTCTAACATTCTAAGTTTAGAATTTAAAACT
AAAATATAACCAAAATTGTGAGCATCTCTCTGTTCAGATTTTTAAACTTTTTAAATTTTT
TAATCTTTCAATTAAGTTACATTGCAATCTAAAGAAAAAGGAGCACACTATGATGATTTT
CTCTGTCAGGAAATCCGAAATGCTCACAATTTTGGTTATATTCTAAATCGTTTAACAAT
GATATTTAAAGATCTAATTTATTTATATTTATAATTATATACTAAGTATCCTTAAAAGT
TCCTTAAATTTTCAAATCTTTTGTCGATAATTTTGACAGCTGCTTTAAATCTTTCGTCTA
CAGAACCACTTAAATTAACTACATTAATACCGTAGTAATTCTATATAGTAATCGTAGTAAT
TACTACAAATATTTCTAAATTCTAAATCAGTAGATCTGACACCATCCGGAACTAAATCAA
ATTCTGGTTTAATATAAAAACTATATCATATTTTTTCATTAATTCAATAGAAACTATTT
CAGCTAAATCTAAAAATACATCAGGTATTGATTTTTTAATCTCTACTAAATACTTAGTAT
AAACTACAGCATCTAATATTGTTCTTTCGTATATACCATCTTTGTTAAGATCTTCTATAT
GAATTTGCAAAGCTGCTTTTTGAGTTTCCATATCACCATCTTCATTTATATTAAAACCCA
ATTCTTTTAATTTTCTTCCAGGCCCTGGAATAATATCCAAATTATATCGTTCTTTTAATA
ATTTGGCTATAGTCGTCTTTCCAGAACCTGAAACTCCTGTAAATCCTATTTTCATTTAAA
CCCCTTTAAAAACCTAATTTTGGCTATTTAAACCATATCAAAGGCCATTAATAGTTCTAAA
ATCCATAATATTTAATAAAATAGTATTGGCGGAACCTTTATAATCTATAAGATCTACTAA
TTAGTACTTATTTTAGTTCTTAAACCATCTTTAGAATATCTTACATTATATATACCGTG
AACAATTGGGTTAGAAGTATCTAAAGATACAATCTCTGGAATGTTCTTATAATTTTTAAA
TTCTTGAGGAACTTGACAACCCAATAAATGTATTTTAGAATCTTTTAATAGATTTAATTT
ATCTAAATGTTTTATAAAATCTATCCTTGCTTGTGTTAATTTAGCTTCTTTAGTATCACC
```

FIG. 15K. Continuation of (CJLB-13-1 [organism=Campylobacter phage CJLB-13] partial genome contig_1)

```
TTCGTATTCATAGAAGTAGTCTCCTGAAAAACAAATAGCTACCATATCTGCATTTTCTTT
CATAAACTTAAAGCAATCTGTTAATTCTTCTAAAGTATTACCTTGAACAACGCCTATTTT
CTTACCAGGTATACTAAACTTAGAAAAGTCTCTAAAAGATTGTATTGTTGCACTAGCATT
GCCTAAAGCATCAGGGACTATATAATAGAAATTACTAGGATTGATAGAACCTAATTCATT
TGCTTCTTTAGCAAACTTATCGTGATCGTATAATGTTCCTAATTCAAATAAAGAATTATC
TAAATAAACTGTTCTACGCTTTTTTAATGAATCTATGTAAATTGTTTGTATTCTGGGTA
GATTTCAAATAAATGAACTAAAGCATAATCATAATCATTAAACGTTCTTGATTTTCTAA
AAGACTTAACGGAACTTCGTGAGAAACAAGCATATAACTCCTTTTTGTTTATTATATTAT
AATTGAACTTAAAGTTCTATGAATCTTATGTTAAAAACTAAAACTCTAGTTTAAATTATT
TTAAAATTTAAGCTTTTAAGTTTAGAACCAAAGTCTAAACTCTATTGAATCGAACTCTTC
ATAAGTAGGTATTACAAAAGATTTCATCATAGCATCCACAACACTTTTATTAATTATTTT
ACCTGTAGCATTTCTTTTTTCAAGTCTATTTAATATCATTGTATATGGTGTTAAAAATAC
TACTGCTTTCTTATGATAATTTCTAACCAAGCTCGAAGTAGCAAATAATCTACGCCTCGA
TTTAATCGAAGTATTCGTTTTATCTATTAAAATATTTTGATTCTTTTGAAGTGCTCTTAA
AAACTTATCATTAAATAAAGAATCGATTTCTTTTTGATCAGAATCTGTTAAGTTTCTCCA
AATATCTGAATATTCAACTTGATTGTATTTTTAAAACCGTATCTCATTAAATATCGTC
TCTTGATATAGCTGCTTTATCATTCATATAAACATAAGTTGATTTACCAGAACCTGGTAA
TCCTACTAATACTTCTAAAACTGGTTCATTGGCAACATTAGATCTATCATAAGCTTCAAT
ATTTAAATCGGGAAGTTCTTTTGGAACTTCAGTGATTCTACCTAAAGCATCAGCAACTGA
AAACTTGGATAATAATTTTAAATCTCTATAAACATAACGTTTTTTAAGTGTTTCTAAATC
GAATTTATAAATGTCGTGATGGGCTACTATTTTAATTATATCTATTATTTCTTGTTTGGT
TAGATTTAAATCCAAATCGTGTAAAACATCTAATGCAAAGAACACACCAGCATTTTCGTG
ATTTAAAAAATGTATTTTTCTGGGTTATTTTTAGATGGTGTTCTAGTTATTATTTTACC
AATATCGTGTAAAGCTGCTCTAATATTAATACTTTATAATCAGGATCATCTTTATATAA
TTCGTTGACTTTGGCCATAACCATTTCGGTGTGTATACCAACGTTCGGTTCTAAGTGGTA
TTTGTTTGGTGTATTTTCAGTGCCATTCAAACATCGATATAAAGCATCAATATATTTGTG
ATTTAAATCTTTTAAGTTCAACATTGTTATCTCCTTTTTGTAATTATAATATATTAAAGC
TTAAAACTTACTTAATATTTTAAAATATATCTAAAAATTTTAATATATTTTTAAGTTTTA
ATATTATATAATAATATTATTTAAAAATAGGATTTAAATGAAAGTAACTTATAAAAATAT
AACGATAGATCTAAACAAAACTTTCAAAGAAATACTCATTGAATTAAAACAGTATCCACT
TTATAGAAAACAAATTATTGATATTCTATTAAAAGACCCTAAATATAATGGGGAATTTCA
TTCAATATACAAAGACTACAAGGATTTACAAAACAATCCTAATTTTTGTGTAATTTGTGG
AACTAAGACAAGGACACAATATTGTAAAGAATGTCTAAAATCACCAGATTTTAACAAAAT
ACGCATAGCTAAAATCAAATCTACAAAATTAGAAAGATATGGTGATGCTAACTACAATAA
TATAGATAAACATAAAGAAACAATAAAAGAAAAATACAATGTAGAAAACGTATCACAGAT
ACCAGAAGTAAATGATAAAATTAGAAACACCAAAGCCAATACAGATTATACCGAAATAAA
CAATAAAAGAAAAGAAACCAATTTAAGTAAATATAATACTGAATATGCGACACAAAGTGA
AGTTGTTAAAAATAAAACAATTGAAACAAATCTAAAAAAGTTTGGAGTTATCTGTAATTC
TCAAACAAAGGAATTTAAAGAATCCGTTCGTAAAACCTGGGATTCTAAATCCGATGAAGA
AATACAAAGAATCGCTGATCAAAGAAAACAAACTAATTTGGAACGTTATGGTTATGAGTG
TGGTAATAAAGATTTAATTATAGAATCTTGGAATTCAAAATCTGAGGAAGAAATCATAGA
AATAAACGAAAAGCGAAAACAAACAAATTTGGAACTTTATGGAGTCGCTAGCCCAACTCA
AAGACATTTAAAAAATAATGATTTACTGCACGAGGATTATTTTAAGACTTTCATAAAAAA
TGAAAGATTTGATGCAGACGCCTGTTCAAATTTTATAACTTAAGCCCGACAGGTGTTCT
AAAATATAAGAAAAAATTTAACGTAGAAGAACCTAATGTTACTAGTATAGCTAAAACACA
ACAAAAATATTTGATTTTATTAAAACTGATATAAAAAATACAATGTTAAAAATATTAT
AAAGGGTGAATTAGATATATTTTTGCCTGATTATAACTTAGCAATTGAATACGATGGTTT
ATTTTTTCACAGTAGAGGTTTACATAAACATAGAATGTTTAATACACCTGATTATGATAA
AAAATATCATTTAAAAAAGACAGAAATGTGTGAAGCTTTGGAGATACAATTATTTCATAT
TTTTGAATCTGATGATTTAGATATATGGTTTTCTATGATTAATAACAAACTAGGTTTAAA
TAAAAAAATTTATGCTAGAAAATGTATTATAAAAGAATTAAGTTATAATGAAGTAGTTGA
CTTTTTAAATGAGAATCATTTACAGAAATCGACAGTTTCAAAAATTAATTTAGGTTTATT
TTATAATAACGAATTAGTAGAAGTTATGACATTTGGTAACCTAGATTTAATAAAAACTA
TGAATATGAATTAATAAGATTATGCACTTTAAAATATTGTTCGGTTATAGGAGGAGCTTC
TAAATTATTTAAGTATTTCTTAGACAATTATAAACCAAAAGTATAGTAAGTTATGCTAA
TAGAAGATTTAGTAAAGGGTCAATATATAAAACCTTAGGTTTTAAGTTCGTAGAGAATAC
TGAGCCTAATTATTTTTATTTCAAAGATTTAAAATTGCTGGCTAGACATCAATTTCAAAA
ACATAAGCTAAAGAAAAGTTAGAGATTTTCGATCCTAGTCTTTCAGAAAGTGCTAATAT
GATGCTAAATGGTTATAGAATAATATACGATTGTGGAAATATGAAGTTTCAGTGGATCCA
AGGATCGTAAAATCCTTGAATCTTTTGTAAATTGAACCTTGGGTTTAGCTTACAACAATG
CTGAAGTCGTTTGAACCGACATTCGTGAATCTGAGATGAATGAACTCTGCAACATAAGTC
GGCTTAATATATACGTCTATGACGAGTTGGTCGCTGCAACTACACTTGCTGGATTGTTT
GATGCGTCACATATCACAAGGTAGTCTTGGATCCCGCGGCCAGCTTTTACTTGCGCCAAG
AAAGGTTTGATAATACTTACAAGGTAATTTCTTGTAAACTATCATTGAACTCAAATAGA
CTATACTTCGACATACGCCCTAAAGATCTTTCCAAATGGTTAAACAAGCTAACAACGTTT
ACACGATCGAAGCTTGAAGCTTTAGTTTGTAATGTTTTTTGACCCCAAAGAACTGCACCA
```

FIG. 15L. Continuation of (CJLB-13-1 [organism=Campylobacter phage CJLB-13] partial genome contig_1)

```
GTGTTTGGAAACATAACTACTGGATTTATACCATTCTTGTAAAGTATCATTGTGTTCAAC
ATCGTTCGCTACGCGATGTCCGTTCGAAGTAATGGTAAACAACGAACTGCTTTAACTTTC
GTTAAAGATCAGACTATATCTTGCTCATATCATAATGACTTAGAGCGCCCCATTTCGAAT
TCGCTTGAATTCTACTCTACTTGGTGTCTATAAGACCCTTTCGATAGTCGTTGAACGTTC
TCTTTTAAAAAAGAGCTTCGCTGCTGATTAGCATATTGTAAAGTGATTAAAAGTTTCGGA
GTTTTAATCACAAAATGCAAAGTAGAATCTTTTTTAAATAGATTCAATTTATTTATTTGT
TCTACATAAAATTGAATCTTTTAAACAAATTCAATTTATTTATTTTGTATTATATAATTA
TAGATATCATCTATTTCGATATCGCACCTTCTATTTTTACTTATATTTTCAACTGCTGGT
ATAAATCTTAAATTTGATATGTTACCTATTAAATAAGCGGGTATATTATTGATAAATCCC
ATTTTTATAGAGTATATATGATCTAAATGATACCCATTGTTTTTCAGAGTTCCTCTTTTA
TCATAATTTTCTAAAGTTTTTAAATCGTTTTTATTAGTATATCGCCAAACAACGCGTCTA
TAGTACTCGAAATCAGGTAAATCTTCGGGTTTAGGCCAAACACCACTTTCTTGCATTTTT
AATTCTGTGTCTATCATAGAAATTTAAACCATTTTCATCTTTTTCGAGATTTTGTATTTG
CATCCTATCATAGAAATTTAAACCATTTTCATCTTTTTCTAATTTTTTTAAATGTACAAA
TTGATAATGATCTATAATTTCACCGTTATATTCAATCTTTTTATTTTTCATAGTTTTTGC
AGCTTTGATAGCGGCATTTTTAATAATTTCTGGATTATTCTTATCTTAAGTTTCATTTCTTTT
AATAATAGCTAATTTAAAGACTTCTTTATGTTCCTGATATGCTTTCTTAGCTATATTGCT
TAGATCTTCGTGTGTATATTTTTACGCTTGGTTTCTTTGGCTTTGTTTATAGCTTGCTG
TTTTTCTTCTGGTGATTTATTTTTAAAAGTTTCTTTAACTTTTTCACTCTGTGATTTTGC
TAATACATTGGACATCGTTGAGTTCGCGTGTCTGCTTGAACATCCATTAGAAAACCCTTC
TCTGAGATTTCTAAATCTTTTCTTATTTCCGCAAGTAGGACAAACTAAATCAATAGGCTT
TAAATCTTCTATTATATAATAAACTCGTTCTAATATGCAAGCGTTATAATCGTCTAAGAA
TTCAGTATTTTTATATATTTCTTCTTTTAATTCTTTGATAAATTTACTATTACGAGTAAA
ATTTTCACAGTTTGGATATTTTCTTTAAATTTTTTAATTTCTTTTAATAATTTATATCT
AATAGATATATCATAAGAATAATTTAAATTTAATTTAGTAGAACATTTTAATTTAGGTGT
TTCTACAAATATGATCAAATGAGGAAGCTCCGACCTTTCCTCATTTAAAGTTAATTTTTG
CATTTTATTCCTTTGGAAATATTACAACTTAGCCTTCCAGCAATTAAAGGCTTTTTTCAA
GTTACGTTTCCGTAACCGGTGACATACATACTTTTATTATATTAAAAGCATTTGTTGCT
ATCACGCATCGCACCAGTTGGGCTATATGCCAACGCCTCGCAGTTTTTAATGAGACCTCT
GTTAAGACCAGCAGCTGCATACCAGTTAGCTTGATTATAATTTGTTTGAGCTTTAAGACC
TGCAATATCTGCAGCTAAGTTCAGCCATCTGTAACCACCAAGCTCAGCACAGTATTGATA
TTTGTAATTGCTACACAAAGTTACATATTTAGAATCTATATTTAAAGATTTTCTAAAATC
AAGTGTTTTTTGATTAGCAATTGTAGATTTATAACCCACTGAACAACTTTTTGGTGCACC
CATAAATGCTATACAGTCACCACGAGTAATCGCAATATCAGTAGCTGCTTTTGGATAAGT
TTCGTTACAAATTAAGATATCAACATCGATTTCTTCTTTGTTGTCAAAAATTGTATAAGC
GTCTATAATATCGCCAATACCTGGAGCTGAATCCATACCATTTTCAAGTTTAAGTAAATC
TTCACCTAAACAAGTTTTTGGTTTACCTTGAACTGCTTCATTTACAGAAACTAAGATATA
GCTTGACTTGCCATTAATCATTGTTTCTATATAAGTAAATTCATTTTTCTCATTTTTATC
AGTTAAGCCTAAGCTTACAATAAATGATTCTTGAATTTCGTTTGCGTAGATAACAATAAC
AGCAAATTGATCACCATAAGGAATATAATCAAATTGAGAATCTAATGGTATACCATCAGT
GATATATTTCCTTTGTTGAAATCATCAGGGTGTGCGATTGCGACATCAATTTATTGCC
CCACTCTCCCGGTGTTTTAGCAAATATTTTTAATTTTGCATCTTTATAAACAAATGGTTT
AGATAATTTATCTTCATCAAATGTATTGAAGTTACTAATGGTATGATCATAAAGTTCATA
TTCTGACGCATCGTATTTGGTTTCAGAACCTTCTACAGGAACTTCAACACAAGACGATTT
AGTAGCCTTAACTAAATAAACTGGAAAACCTTTAGTTGCTTCAACAATAGCTTCAGAATC
CTCAGTTCCTTCATAAGTAATATTTGTGAAAGCTTCACCATTGACTATACTGTCAGAGAT
TGCTAAGATTCTGAATCTTGGATCAGTTAAAACATCAGAAAATGCTATAATATCTCCGCG
TTTTAATTCAGTGTTAGCACCTCTAAGACTTAAAATATAATTAGAATCTGGTTGAGATTC
ACCTTCCATTAAGTATACTGAAGTGTCTGCATTTAGTTCACCTGGTTCTTTGTCTAAAGT
AACAATAGTTACTTCTTGAGTTATAAACTCTGGTATATCGTAGATATCTGCCATTTATTA
TCCTTTCTTAGCTTTAGATTTTTGGTTAGCTCTACCACTTGGATCTGCATCTTCGGCTTT
ATCAAAACTGAGAGATTCTTTGTTGATAATTATGTCGGAAATTTCAGGCAAATCTTCAAT
TGTTACTGATATTTGACTTGAAAAATCTTTATGACCTTCTTTTGAAACTGTTACATTAAC
TGTAGTGTTTCCCGCAGCTACTGGAGTAATTTTTAAAATATTGTCACTAACTTCCAAAGT
TGCAACTTCACTATCTTGTATAGTAGCTTTAAGTGTAGCAGATTCTGGTAATGTAGCAGT
TACTGTTTGAACACCTTGATTAATTTTAGCTGTAACTGATTCTGGGCTAAAAGATACTCC
AGTAATTTCTGGTAAGTCAACTGCTTCAGTAACGGTTACGGTTATAGTTTTAGTAACTTC
AGTTTTTCCTTGAGCTTGAGCTGTGATTTCAATTGTAGTGGAACCCACTCTTACACCATT
TACAGTTTTCTTATCACTTTCAATACTTGCAATACCTAAGTTTTTAGAAACAATTGTATA
ATCACTAGCATCAGTGTCGATATTTAACACACCTTGCTCGCCTTGAATTATATTTAATTG
TTCTGGAGAAACAATCAATTTTGTTTGTTCTTTTTCTTGAACGTCGAATTTTAATTCAAA
TGAATTAGTTCTCGAACCTTCTTTGGTAGCTTTAAAAGTTACAATAGCAGTCCCTACTTT
TAATGCAGTCAAAGATTTATTAGATTTGTTAACAAGACCACATCAGGTCTATCTGTTTC
TACAGTATAAGATTCTGCATCGGTTGTTATTACGTAGCTAACAACTTCATCAACATAAGC
ACTTACTTGACTTGGGTCCACTACTAATTGAGTTAATGGTTGATAATCTGGATTTGGTAT
TTGCTTAACTTCATTTCTAACATATTTAATTTTATATTCTTTATTAGAATCGTTGAATTT
```

FIG. 15M. Continuation of (CJLB-13-1 [organism=Campylobacter phage CJLB-13] partial genome contig_1)

```
AAGAACTTGTCCAACTTCGAATTTATCAGTTTTTTCGAATTTAACGTCTACAGAGTCAGC
TTCGATAACTTTAACACCTTCGATTTTACTAGCGTTAACATTTGTTTTATATGCATTTTC
TTCAAATTGTAAGCCATCTAATTGTGTGGGTGTACCATTGATGTCTGCTGCACGAGAAAC
ATAAATTGCACCACTGTAAGCTAAGAAATTTTGAACTTGATAATAATCATTATAATTCTT
TGTATTAGGCATACCGTAATTATCTCTGAGTTCTTGAACACTTGAGATTAAAGTATGTAC
ACCAACTGGTCCTTTCTCAAAATCACCACCAAAAACGGCAGCAGAGTCACCTTCAACAGG
CGTAATTTGAGATTGATCTACTTCAGAAACCTGGATACCAGGGCTAAGTAAATTTGCCAT
TTTAATCCTTTTAATATGATTTGATATTACAAAAAGTCTCTCGAACTGCATCAAGCTTCG
TTGTTGAGCTCTTAAACCAATTTCGATGCCTTTAGGCTAAAACGACTAAAGTATATTGGA
ATCTTATTATTTATTTAAGGATTTAAAAATTGAATTTTAAGAGTTTTTTCAGTTTATGTA
TTAAAAATTAGATTGGGGATTTAACATCCCCAAATTATTGAAGCAATTAAGCTAAAATAG
TTCCTGTTAAATCTACACCGAATGTTCTTGCGTAATTTTCTGGTTCAAGTGGATTAGTAG
CTAAGCCATATCTTGTTCTTGCAATCATACCTGGTTGTCCTGATTCTTGATTCATTACTT
TTTGGAAGCTTAATGGTACATATGGACAGAAGAATCCGAGACTATCTTGAGCGGTTGTAC
CCTTATAAAGAACAGTGATATAATCAGATTTAGCATATTGATCAACAATTACATTATATC
TACCATCATAAGTCCCTACATCACCAGTAAATACATCAGTAGCTATATTGCTTGAACTAG
AAGCAAATTTAAATGTACCGATTTGATCTAACATAGTAGCAACTTTTGGAGATACAAGCA
ATGTATTACCTGAACCGCGTCTTGTCATTAACCCGATGTTCTTGCTTCTAAATCTATTT
TGATAGCATTACATCTATATCTTTCAATTCCCATCTACCAGCTTCTTTGTGTTCAGCAC
CTGGACTTAAAGTATCAGCGACAACGGTAGCTGTATTGTTACGAAATTGATAATCTCAC
GATCTATTTCAGTTTGCATTTCAGCAGCAATAAGATTAGCTAAATGTCCATCTGCAAGCA
CACCGTGTTGATTTTTAAATCTTCATACATTTCTAAAGTATATTCAGCTTTAAGTTTTC
TTGTTTTTGCCTCAACAGTATCTTTTTCAATTCCAAAACCTACAGTGTTCATATCTTCAG
CAAGTTTTTCACCGTCAGCTGTACTATATGGTCCTGAATAAGTTTCTAAGATTTTATGGA
AAGTAGCTTCGTTAGAATAAACGTTAACGATTTTAGTTCCTTTATTAGCAGCTTCGTTTT
GGAATTTTTATCGCTAGTTAACTGAACTAAAGCAGTTTTACCATCTTTTTCAACGTGTA
TAATTTTACCTGTCGCACTTGAAGTTGTACCTGTAACAGTATCACCTTTAGTCACATTAG
CTTCAAACACAAGAATTTGAGCTTTAGAAACTGGAGATATAGCACCGTCTTTTTTATTAC
CTGTATATCTATTGACTAATGCATAAATGTAACCTGTAGGCATTGTTAAAGGTTGAATAC
CTAAAAGTTGATTAGCAACTAATGCTGGGTAAACCCTTCTTACAATTGGCATTAAGATTG
GTGTAAATTGAGCGATATCACTAGAGATAACACTTTCACCTACAAGTGCACCTTGAGATG
CTAAAGCAGTGTTGCTGAGCAATGTACTCATCAATACAGCTTCACTTTCATTTAAAGCAG
CGTATTTTGAATCTTTAATATAAGACTCTACTTTTTCATTAAGACTTACATTTTTATCCA
TTGTTTTTAACCTTTTAATTTTTTATATATTTATTTTTTAACTGAATTTTAACTGAGCTT
GTTAGTTGAACTTAGTAGTTAGCCCAGTTAATGTCAGCGCCTGCTTTGTTTTTAAAACTT
TCTTTGATATCCTTTGAATCCTTTGAATCCTTTGAATCCTTTGAATCCTTTGAATCATCA
GAATCATCAGAATCATCAGAATCATCTTCGTTTGTTTTTTACAAGCTTCAAATAACGCT
TCTAATTTAGATTCAAAACCTTCACCTCGTTCTACCAAGCTAGCTAATTTTTTAAATTTT
TCACTTTCTACAAGATTTAAATTAGCAGCTAATTCATCAATTTTTTTAGATTCTTGAAGA
ATCGCAAGTTCAGCTTTAAGTTCTCTATTTTCAACAACTAATTTATCAAATTGATCACTT
AATTCAGAATCTTTGTTTGCATAATTTTCGAGTATGTTTGATCCAGCAACATCTACTAAG
TTATCAAATATACTTACTAGAGTAGCAGCCTTTTCATTCTCAACAACAGCGTCTAATTTT
TCAAGAACTTCGTCTTTAAATTTATAAAGTTCTTCATTAATGAATGAATCTATATTTTCA
GTAATTTTAGATTCAAGTTCTTTTTTAGCTTCTTTGAACTCTTCTACTAACTTGATTTTT
TCGAGTTCGATTTGTTCATTAGCTATTTCAACAGCTTTAATTTCAACAGCTTCATTAAAC
ACAGATTCAATTTCTGATTTAACTGATTCTGTTAGAACATCTTTAAAGCTATCGTTGCTT
AAAACTTGTCTAACATTTAGGTACCTTTCTTTGAATTTTTTTATATTTATTAAAATCGG
TTTAATTTTGTTTTAAGCTTATTTTTTGTAGTGTTAGTAGTGTTAGTAGTATTTAGTATT
GGCAGAATCGAAGCAAATATCAATTTTAACACTTCGTGTAATTTATGATATTGCTTATAT
ACATAAAATTAAAAATCATCACTAAAAACAGTTTTTTAGGACTTTTATAGAATTTATAT
TTAATAAGATTTGCTTCTATATAATCTTTAAGTATGCATCCTCTGATATCAAAAAACCA
AGTTCTTCTAAAGGGATATCATTTAAATCACAAAAATCTTGCATTATTTCCATAACACAT
TCATTTTTATGCTCTCTTAAAAACTTGTAGAATTTATTTAATGTTTTAATTTCCTTTGCT
ATTAAATCTTGGCTAATATTCATTTTGAATCACCTTTAGTTAGATTTACATTAAAATGTT
TATAATTACTTAGAACGTTTTTAAGTTCAGCGTAATCATCAAATGATATAAAACCTTCAT
TGTATCTAATATTAATATTTTGTATTTGATTTCAGTGGTATCTAAAATATTTTCAATCA
TTTTTAAATTAAAATTGGGTATTGTGTAATCTACATATAATTCATTAACAATATCTATAG
TTGAAGCATTCCTAGATTCATTATGTATATCATATTCAGAATTATACATACAAGCTAAGT
TTTCAAGTTCTTTATCTTTTTTGTTTTCTCATTGATAATAGCTAAAATACTATTATGAA
TTATTTGTGAAATATAACTAAAACAAGATACTGATTGGTTTGTAATTTTAGATTTTAATG
TATGATCGAAGTTATGAATATATTTAAATACACGATAGCAAGCATCACTATAAAAATCAT
CTTGCCAAGTATACCCGGAAAAATTAGGTTTAGTTAATATTTTTTAATCATTAGAATAA
CAATGTTACCAAAATATTCGTGAGATTTTGGTGATATTTTACACCCTCGGATATACTAA
TAATATAGTCTTTAAGATCTGGATCTTTTGTTTAATATATTCTTTTATCTTAATGTCTA
AGTCTTCATTTATAGAACCATCAGGATCTTCAGAGCCTAGATTTAATTTGAAGTTTTTTT
CACGAATAGCTAGCGATTTTAGTTCAAGTTCGTTAGTATAATCGTGTTTCATACGAGTTT
```

FIG. 15N. Continuation of (CJLB-13-1 [organism=Campylobacter phage CJLB-13] partial genome contig_1)

```
CACTCATTTTACCACCTTTAGATTTTAAACTTTAGTTTTAAATTTAAATATTAAATATAA
ATTAAATATATTTTTAATTAGCTAATAGTTCAGCTTTTTTGAAATGCTCTAAAGCTTGGT
CTGTATTACCATACAAATCTCTGAATTCTTTTAAATACATATCAAGAGCTTCTTCACACC
CAGGTCCAAAAATTCTGCCAGTTATTTCAACTGCTAAATCTTCATTATATCCAAATTTTT
CCATAGTTCTGAGTTTAATGAATTGAAAATATATGGAACTAATTGCTGAGCTTTTTGTT
TTTCTGGAGATAATGGTCTTCTTGTGTATACTTCTTTAGCTGCTTTAGCGCGACGTTTTT
TACGTTCTAATAGTAGGCTTGTAAATCTATTATCGAATTTACGTTCGTGTTTGAATAATT
GTGGTGCTTTTTTGCCATTTTCTACAAAATTATTAATGATGATTTGTTCAAATCATTGA
AAGGTTTTTGTTAACAATTTTAGTGTATAACTTGCGTAATTTTTGTGTATTGAGACCTT
TTTTGGTTAGTTTCGTTTCAAGCTCTTCTATTTGTTTTGAGTTTTAAGTCTTGTATTTT
GTGTGAATAAACTTGAATATCTAAGTCGTTTGTAATCCAGCTTGAATAAATTAAACTCTA
CTTTTAAACGCAGATATGTGTTAATAATATCTTGATGTTTGGTATACAATTTGTGTTTGT
AAGTCAGTTTCATTATTTTCCTTTCAATTGGTATATTATATAATATATAAGCTTAAAAAA
TTCTTAAATTTATTAGAATGGTTTAAATATTTGCAGTCTTCTGTGTTGATCTAACAAAAA G

>CJLB-13-2 [organism=Campylobacter phage CJLB-13] partial genome contig_2
TTAAGTTTTAGATTTAATACTATAGTATAAACTGTAAAAACTCAAAAAAGTTCGTAACA
ACACAATTTAAAAAGATCAAAAATATATTATATAATAAAAAACCTTATTTTGTACTTATA
AAATTTTCAAATGAATCTGAAACAGAATCCAATACAGGTGAAACTAGGTCGTCCAAAGCG
CCAAAAACAGCATCCTTTAAAGTATTGGTAACACTATTAATAGTATTCTGTATAGTATTC
TTGATCAAACTCGTGACTTCAGAACTAGTTAACCCTTCCCTAGAAATTGTATTAATTTCA
AAATGAGTATATGCAAACTCAACTGTAAAAGTTTCAATTTGATTTAACCCGTCGTATTGA
ACTGAAATTTCTCCTACATTTGTTGGAAATACATTCATCATAGTATACACAACACAATCT
TTAGACATTTCAAAATCTAATTGATATATAGAAATGCTTGGTAATATACCTTCAAAATTA
CCTTTAGTTTTATCCTCAAATTGGTGAGCTTGATCATAAGTCATCCAATCTAAAAATAAC
TTTCTAACTGCGTGTTTTCATCATTATAAAAGTTGCTGTCCATTTTTGTTGATAAGTT
TGTACTGATTTGACTGGTAGGGTTCTACCTCTATATTTAAAATCTATTGTTTCTACAGTC
AATCCCGGAAAACTTGTAGCGTGACAAAAATAGTCTAAATATTGTCCTATTTCAGAAGTA
CTGGATGTTGCAGAAGCTCCTTCATTTAAAATACTTAATTCACACTTAATTTCTTTAGGT
GGAAATATTTGACATTTAAACTTAGTGGGCGAGCTAAATCACCCATCACTTGATTCATT
TTATTTTGAATAATATCAGCCATCTAAATCCTTTATAATCAAGTATTTGTTTTATTAATT
ATATTGTCGGGTTCTCTATCATATTTTCCAGTATATATTTATTAGGTGCCACTGGTTCA
GAGACTTGACCATTTCTTAAGAAACTATCACTAAAATCATTTGACTTACTAGTTGGATAC
CATTTAAACATATAATCTTTGTTATATCATTAGATCCTATAACAATATAATCATCCATT
TGGTATACGCTGGCGTGTTCTAATCTTTCGTATTTTTCATTAAATCTTTCAAGATCCCTA
GTAGTTTTATAAACGTCAACATATCCCGATTGCCAACCCATTTATTTTGATAGAATCCT
GTATAATCATTTTTATAGACTTCTGTGATTTTTGGCCAAGAATCAATAAATTCAAAATTA
ACATCAAATCCATCATTTGTAGCAGTTCCTGTTAATTCAAATGTATCTATGGCTGTTAAT
CCCCAAGGGTTTGTTTCTCTGAGTTCATAATCTAATTTGTTCGACGTACCAGTAAATACC
TGAGTTGGCTGAACATTATTAGCTGCAAAATATCCTACATAATGATTATGATAAACTGAA
CTTTCTCTATACCACAAGGATTCTTCATTAAGTTTATTTTCTTTGAATTTAATCTTATTA
AAATCTATCTCATAGAGATAATCACCAAGTGCTTTAAAGGTATATTGTGGTGCCAAATTA
AAATCTATTTGTTCCAATACTTCAAGATCTTTATTAATAGCTCTAATTGTTGAATTTCTA
TTTTTAATATCTTGATTGAATTTAAGATCTAATGGATTAACATCTAATTGCATAGATTCC
TTATTTTCAAACTCAACAAAGTCGTCATTTAAATAAATTTTAATTGGAAAATCAACATCC
TCAAAGTTTGCGTTATTAATACTAAGTATTGTTTTCTTATTGTGTTATTCTTTAAGAAA
AACAATTTGACAATATCATCGTCTTCTTTTGTAAAAATAATTCTATTATTTAAATAATCA
TATTGATAATCTATTAAATATTTTATAGAATCTTTTTGCGCATCTATAAATAAATCATCA
TCTTTTCTTATACTATAAGTATATAAGAAACTTTCTTCGTTAACTTTTTCTGCGTATCTA
ATATTAATATCTTTTTTAGTTGCTGTGTAAATTGTTAATAACTTCATTAACTTTGAAT
TTTAAATCATTGTTAAAACCGGCCATAACTGGCAAACCATATTCAATATTTTTAATAAAT
TTATATTTACCTAGTTTTGAATCTGGGTCGTTACTTTCCACAGCTTTTAAATCAGCTTTC
TTAATTTTAAGAGTTTTTAATCTTGAAAATGAATAAAAATCTTCAGTAGACACTGTATTG
ATATCTTGTTTAACTATGACACCATTTTTAACAGCATATAATAATTTTGTGGAGTCCGGG
TCTCCAGCTTTATTATAAGTAACATCAGCCCTATTTTTAGTATCATCTAAATAATATATT
CTTACTTTTATACCTTCAGAATAAGATATTTTAAATCCAGTAGTTAAAATACCTATTTCA
ACGTCTAAAACATTTCCATCAGTATCCATAACAACTAAAAGGATAAGTTTTCATTTCGTTG
TGCTTATAAACATATTTGTTTGTACTAGTATCCATATTTAATAATATATCTTTATTTTA
AATATTTTTGCGTTATAATTAATGTAACTAGTATCTAATTTAAATTCAGCATCTATTGTA
TATGTTCTTGGTATACCTTCATCTATATTATCAAAGTATTGTATTGTAATAGCTTCATTT
GTATCAGTATAAAAGATACCCCAGTATTTTCAATATCATAGTCTAATTGTATTCTTTGA
TTATTTTTATCGAATATATTAACAATCATAATATTTTCGATTCTAAAATTATAAAGGAAT
TTACCTCTTTTATCATTAACTTCTGAAAAATTTCCAGCAATATCAAATGTTGTAGATTTA
ATAGTTATTGGATTTTTAATACTTGCAGAATAATCTAAGTATAATAAACTTAAATTATTT
GTTTTTGCATTACAATCTAATGTTGCTAATTTACCTTCAGAATCGTAAACTATTTGTCCT
```

FIG. 15O. Continuation of (CJLB-13-1 [organism=Campylobacter phage CJLB-13] partial genome contig_1)

```
TCAACGTATTGGTTATCAGCATTGATTAAACCTAAGAATATACTATTTTCTTTTGCTTGT
ATAGTTTCATTAGTTGCACTCAGTATAGTTATCGGAAATCTTTTAGAAGTATTATCTATA
ACATATACTCTTATTTTTTGAGCAGTGCTTGAAGTTATTTTAAAACCTTTTTGTAAACCA
GCAATATACATAATGTCCAAATCTACATTGCTAATACGATTAGCTACGCTGACAAAATAG
TATTCTTTTTCTGGTGTAGTATATTCATATAATTTAGAATCTTTATTATAACTTAATTCG
GCATCAATAATTTGAAATGGTCTTGAATCGTATTCATAAGTATCATCAATAAATTGAATA
GTTACAGGATCTTTTATATTTAAATAAAGCCTATATTCAGAATCTACAAGCCTATAATTA
CCTTTAACTATATAACCATTAGAATCTACAATATTCAAGTAATTAACACCTTTTTAAGG
ACTGTATAATATTGACCTAAAGGCTTATTCATAGATTCTTTAAAATCTTTGTAAACTTGT
GAATTGTATTTACTGAATAATGTTTTATCTATATATAATAATTGTGTATTTTTAAGTTCA
TCTTCAGCTATAACTTCTAATGAATCTTCGTTATATTTTATTTTAGCGCGAACTCTATAC
CCGTAAGTATTAATTAATTCAAAAAATATTGCATTTGGATTATATAATCTATAATGATAT
AAATTGTCAGATTCTAAAATAAAATTACAAGTACTTGATTTTACGTGATCATCAAAACCA
GAATAAACTTTATCAAATACCTGTCTAATAGAATTATCATTTTTCTTATATAATGCTTTA
AAGTCAGAAGTTTGTAAAACTTTATTACGAACTCTAGTTCCATAAGTTACTGGTGTATTT
GCATTGATTCTATTTTTACCAAGAACCCAAGTATCTGAACCTAGATACATATTACCAGCG
CCAATAGCTGCAAATTTACCAGTAGTGCTAGCTAAACCAAAATCTACTTGAAATTGATAT
TTGTCTTTAACTGTGGTTACAACTCTTCTAACATAATTAAGTTCCAAAGCACATTTGCTT
AAGAAATCAGTATAATCTTTTTTAATTTCTTGATTTAATGAATTAATACCTTTATAATAA
TATAATATTAAATTCTTAGGGTTTGAATTTTGTTCTAATCTTTCACCAGATTCAAAATAT
ACAATTAATTTGTCATTACCTTTTATGCTGGATTTTTCAATAGTTCTAATAGTAGGATCT
TTAACTAATTTTAATTCAGATTCTAATGTTAATTCTGGGTAATTGACACCAAATCTTGTA
ACATTAAATACTGGATTTCCATCAGCTTTATACATTTTTGGTTTATTATTTTCATATATT
ATATTATTAATGTCAGTTTCAAAAAGATATCCGGTATTTGTTTTAAAATTATCTTCA
CAATCAGAATCTTCACAAGTTACTCTAAAAACATTTACATCGTAAACTTCTTTGCATAAG
AAATAATCTTCGAATTTAAGAACGTAAGTTCTTGTAAATAAGTAAGTCCAACCTACTGGA
TGTGCTAAAGGCTTAACAAATGCTTCGAATATTTCTGGTAACATAGATCCGTAAACGCGG
TATTCAAATATATTTTCACCGGGCTCTATTGTTAATTGACCGTCGGTTTCTAATACAAAA
CTTTCAATATTTAATTGTTCTATAATACGATATATAAACTCAATAGATCTTAAAGTTCCT
TTAGATTGTTGAAAGTTTTTAAATAATTCTAATTGTTCTTGTGATAATAAGTGTATTACA
TTTATATCTAATTGCGTTTCACTAAAATCAAAACCATATTTTTTGTGCGCTTTTCTAACA
GCTTCTGCAAGTTTATGATTTTTTGAACCATCGGTTATAGTCTTATAAAAGTTTGCAGCA
TATGTTTTAATAATTTCTTCATATAGAACTTCATTTTTAGAATTATATAAATTATTGATG
TCAATCGCTAGGCTTGAATTATCATAGATATAATCTACAAAAACGTCAAGGACGTCCATA
ATAAATTTATTAGATTTGTAATTTTCTGGTACTAAGTTTTTAGCTATACTTTTAAACACA
GCAAACCTTTAATTATGCTTTTAGTATATTTATTTGGTTCTTAGTCTTAAATTAAATTAT
TTTAATTTTTTGACTTCTACCTTAGATTCCATATGAACACTTTTAAGAACCACTCTATGT
AAAGTTCCTACTTTATCGGGTGTTGTACTCCAAACTCTTTCATCGTTGTGATCATTTAGA
TTTACATTCTTTGCTAAGATACCTTGATCTAATTTAATTATATCCACTGTAAATCCTGGG
TTATTACTAAAAGAATAATATATTCTCCTAGCATTTTCATATTGTTCAGAATCACCTAAT
AAAGTATATTTAAGAACGGTAGTTGCTAGATAATATAATAATTTGCCTAATCTGATACCT
CTATGGTCTCTATCAACTTCTACAGCACTAACTGTATAAACATTTTTATAATCCATTCTT
TTAATTTTATCTGTAGGCAATAATCTAATCATAGCTATAGGACTAAATCTATCTTTGGTA
CCATTAGGGTTATCTTTAGTCGGGTAATCTTCAGGTACTTTAGTAGCTAAAATATGGTAA
GATTCTCTACGATAAAAAAATATTCTTTACCATTATAATAAACTTTATATACAAAAGGT
GATTTATCAAATGTATATTCTATCGAAGTCAGACCATACTTATTAATATAGTTTAAATTC
CCAAAATCATAATCACCTGATTTAGCAATTGCTTGCTCTTCTAAAAAATCTGAAAACTTC
AATTTAGCTCCTTTAATTTGTAACTTTAGTTAATACCAATCTATTAAATCTACCACGTAT
TCTTTCTTCTTTAGTTCCTGTTAAAAATAAATCTTCATCGGTCCAAATTCTTGGATCTAA
AGCATCTTTTAATTTAACATTTTTAGCAATAATTTTACCTGTTGCTAACTCAACTATATC
AACGTTAAACCCAGGTGATTTAGACAAGAAAGTCCATAAGTTTCTTGCACCTTCATATTG
TTCAGAATCACCCATCAATACCCATTTAAAATCATCCACTAAAATAGTATATAATTTTTT
ACCTATCCCACCACCTCTGTATGATCTTAAAGTTTCGACACCTTTAACTATTCTAAGAGG
ACCATAACCTAAACCTCTGTATTTTGTTGTATATTCCAAAAGTATAGCAGCTAATATCTT
AAATCTTGTGTATAAGGTTCAAATCTTTTATCTATTTCTTCTTTAGCTACACAATAATA
TTTTTGTTTAGGATGGTTAGCATTACATTCAATAATGAATAATTCTGTATTATCACCATT
TATATCAAAATTGAACTTATGGAGAACTTTCACAACTTTCTTTGATATCAAACCTCCAGC
GCCTATGTAATCCAAGTTACCAAAATCATAATCACCTGATTTAGCAATTGCTTGCTCTTC
TAAAAAATCTGAAAATTTCATCATAGCCTCGTTATTTTAATTTGCATAATTATATCATAA
AATAACTTAAAATATATTTAATTAGATAATTAAACACTCATAGTGCTCATATCAATATCA
CCAGCTCTTAAACTATCTCTAACTCTTGATAATCCAATAAATCATCAAAAACTACAGAT
CTAAGTCTAAATATTGAATTTCTTATTAATTTAAAATTATGTGATGGATAATTTAACATA
AATTCATAATTATATCCAGGTTGAAAAATTTTTGTTTGGAATTTAACTCTAATATAAGGT
ATCCTTGAATTAAATATTGTATAAGAACCTACAATTTGTTCACCTTCTTCTGGCGTAGCA
GCACTTCTATTCATTAATTTAATAGGTATTCTTATATAAGCAACTTTAGATAGATCCAAA
TTAATATATTCTTCAACTGTTGTATAAAATGGTAACATAGTCTTAACAGATTCTTCATCT
```

FIG. 15P. Continuation of (CJLB-13-1 [organism=Campylobacter phage CJLB-13] partial genome contig_1)

```
ATAACATAGTTAGCAACTATTTTTTGTTCCGCCACATAATTTGTTAAATTTGCTGGGATA
ACTTTATGTGTTTTGCTAGGTTCTTGTATTTCCTCAAAACAAATAGGTTCATTATCCTCA
CCTTCTGCAGGATTAGCTTTAGCAAATAAAGCCCATTCTATTGTGGGTATATTTTCTGGT
ATTATTTGACCCTTGGTATCATATATACCTTCAATTGGTAAATCTAAATATACATAAGCT
CCTCCTGGGCCTTCATCCACTGATAAATCTACCGCAGCTTCTTTAACATATACTATTTGA
TTTTGATATAATAAATCACCACGTTTTACTTGAACGTCTAAATTAAAATTAAAAGTTCCT
GTTTTTCTATAATTATTTAATACTACGTATGGCGCTTCGTATTTAATGGAGAACCTTCC
GGTATACTGACTGTATATGAATCTAATGCATCATCGTGATTTGCAATTAAATTCCTGACG
TCGAATTTATTATTATAATTAACATAAAATGTAATTTTTCATTAGATTTTAATTGAACT
TCTCTATCAAATGTGGTTGTGGGCGCATATTCTGTTATATTTTCAAACTGTTTAGCAACA
AATTGAATTCTATCATCTTCTACAGGTGTTAATTCATTTGTCTTTCTACGTAAGTAGGA
TATATACCGATAGAACCATCAGCACTACCAAATGAAATTTTTGTAACATCTAATAATATA
CCATCTATTTTGTATCAAACTGCCTTTGAGCTATCATAGCGTCTGTTATAACAATACTT
GTAGTTTTTGAGCATAATCTATTAATAATGTATCATTGGCTTTTACTGAGCTTGGTATC
CAAACTCTAATATCTATTTGACCGTCAGAATCTTCATACCAGTTATAATATAAATTAGAA
GTTTCTATATCACCAAAAACATTATCTTGACTTTCAGTTTGGTTAACTGCAGATTCCCAA
GAACCACTGGCAGTTCCTAATAGTTGATTAGATTTTAACCCATTGCTATCAGGTTCTTCA
CTATCACTTGGTTTTAAAGATTCTCTATTACAAGTATAAACAACTTTATAATCACTTGCT
CCTACAAGACCTGCATATTTACCCCTTTGTAAATCATCACATTGTAGATAGCCTTGTGAA
AGTATCTCTTCAGTAATATAGAAATCATATATTAATTGTTCTGCTTTGCGAGAACCATAT
AAACCGTAAACTTTAAAACTATCACCTACACTAACAAATCTTGGCAATGCTATTTTAATA
ACTGATAATTCATTACCTATATTAACATTAAAAAATACGGTTTTATTTTTAAGTTGTAT
AAATTAATGTCGTTTCCCCATAGGTGGTCAATCCATCGTATGATATTATTCTAACATTT
AATGATTCTTCATCAAATCCCACATCCTTAAAATAAAAAGATTTGTAAGATTGGTTGATA
TCAGTATCCGTTAATTCATAAGTATAATGATCTGTATTGTCTAAAATAAACGGCAAACTT
TCTTTATTAAAATAAACTTCTAATTTATCACCCACACTAGCCAATAAACTAAAATAAACA
CTAAGAACTAAATTCTTAGATAATTTGTCATATGATTTAGCATAAAAACAATTTACTTTA
CTAAAGTCTTTATTTTCTTTAAATTGTTTTACACAGTTTTCTTCACTTAGTAATAAACTA
AAATATGGATTTACTTCTATACCATTACCCAGACCCAATTCATTGTCTAAATGCCTAACT
AAGTTAGAATGGATAAATTCACCTTCAAATTTTTCAATTTCTGCCATTTTTTCACGAATC
TTTGCATAGATTTTTTTACGAATATCTGATTTTGGAGTACAAAATGGATATTGTTTAATA
AGAACTTGTAAATCTATATTAACATATGTTGGATTTTTAAGATTATTCTTAAGTGCTGGT
AAATTATATGTATCTACTAAGTCAAAATACCTGGGTTTTTATAACCGTTAGCATCTTTT
TCTGCAGAAACAACTTCACCATCATTTAAATATAATGTGTCAGGATCATTATAAGATTCT
TTTATGTAGTATTGATTGGTACTCATTTCAGTAGTATTCAATAATTCACCGTTTGCTAAA
GTAGAGTTTCTTTTTGTAAGTATATGTTCCATCACTTTGTTGAACTTTTTAAAGATT
GTAAATTCTGGTTCTTTTCTTCGGGGTTCAGCTGAAAAATACAAATTACCTGGAGCAACT
GGATATTCATCTTCGCCTCCCCAAGTCACTACATTTTTAACACTAGAGTGTGTTTTTATA
ACTGAATTATAATCGTGTATAGTTACTGTTCTTGAAGCACTATTATAAAACATTGGTGCA
TTTGTTTTAATAGACTCTATACTTTCTTCATCCTGAGCTTGGGAAACTAATACAGGTACA
TCTTTACCAGAAGTCAATATTTTACAAAAAGAGCCAAGATCACCGTTAACGGAAGCTGAA
TCACATCTCTCATAATATGCGTCTATTCCAGAAGTTCTTAAAACATTAATATAAACTCTC
GTATTAGAAGGCAACTTAGTACCAGCAGTCCCTAGTTGAAAATATATCCTAGCATTGCCA
GTATCCACATCATCTTTTCTAAAGAACTTATTATTGGTACTATCCTTAATATCAATTAAA
TTAAAAGAAGATTTTACAAAAGTTGCATTATCCGATAAATTTCCAAAAGTATCATAATAA
GTAACATAACATTCCACACCATCATCTTCTACATCATTCCAAGGTATATCTATGTATTCA
AATTTTTCATCTATTTTATAAGTTAAAATATCAGGATATTCTTCGTTTTTAATTAATGTA
CCTTCTTTTACTTGTATTGTAGTTGTAGCTCCTATTTTATCTATATTGAATTCTAAATCA
TCGCCTAAATAATTGTAAGTAAAACCATTTATGATAAATGTGCTGTATTTTGGTATTTTA
AAATAACCAGTTCTGGTAAAACTTAATGTTATTTCGAGTATTGTAGATTTTTTATGAGAA
GGTTCATAAGACAAAACCCTAGCATCTTGTATAACATTTTTACGTTTGGTCGCCAAAGTT
AAAACATTCTCATTAACATTTACTGCTGTATTGAAGTTCAAAGAACTTACGATATAAGAT
AAAACAGATGCTAAGATTGCTCCCATTAGAACCTTCAAAGCTCCTCCATCCCAGCCTTTT
TCAATTAATCTTTTAGCTATATCTTGATATATTTCATCATATGTAAAAGGTAATGTTTCT
TTTATAATAGCCATTTGAAATCCTGATTTTTGTAATATTTATTTGATTTTTACGGCCAAT
TTTTTGTTTAATAAATAATAAAAAATTATTAAAGGATTATCAATGTTAAGTATTGCTATT
TACGTTGCTATATTCGTTGTCGGTCTTGCTGTAGGTTATTGTATTCGCGTCAACGGCTCT
AAAAAAGCTGAAGCTCTTTATGAAGCTCTTAAAAAAGAATACGATGAATTAAAAGAAAAA
TATGACAATAAATAAGGTTTAAAATGAGTGGTCAATCAGAAGATTTAAAAAAGAAACTAA
AATATTATTGGTTTGTTTTCAGATGGTTTTTAATAGGTAGATATCATTGTTCTGGTGGTG
AACATTATACCATTTCATTAAGAACTGTTTGGAAAATATGTAATAGAACCATATGGGGTG
TCATTACATTTTCATTAATATATGCAATAGCTAGTTTTTTAATTATATTGATTAACCCA
TTGCTTATCAATATTTTATGTTAATAAATAACATAAATTTTTTAAAGGGAGTAAAATGTT
GAATATTTATGATGCGCTGTTTAGCTCCCTTCCTATACTACTTATAGGTGCTGTTATAGG
TGCTGTACAATTCTTGCATATAGATAAAGCTGCTAAATCTAAAACCAATTTTTTAACGAG
ATTCAAACTTTTTATAAAAACCTCTTCAACCTCTGGTATTTTAGCGTTATCTTCTTTTTT
```

FIG. 15Q. Continuation of (CJLB-13-1 [organism=Campylobacter phage CJLB-13] partial genome contig_1)

```
AATAACTGATAATTTTGATTTAACTTATTCGAGTAGAATAGGTGTATCGATTTTTATAGC
ATTTGCTGGGTATGAAAAAATACAAAGTATAATTGATAGATTATTAGATAACATATCTCC
CAAAGATAAAGATTCTAAATTGTGACATTCAAATATTTTAAATATACTTAATGTTAGTTT
TAAAACATATAACATTAGAATGTAAAATAAATATTTAATAATTAATAATTATGAAAGGTA
TTTTATGGCATTAGAACATATTACTGCAGATCCAGTTAAAGTTGACATAAATGGTTCAAT
CTATGAAAAATCACAGGCGGAGGTTAAAGCTATTATAGCTGAAAGAACTACTTTATCTTTAAA
GGCTGATAATGAAGAAAGTGATCCAGAATCACCGTCAGTAGAAACTACTTTATCTTTAAA
TCCAGCTGATAAACAAACTATTGAGAAGGGTCAGACTAAAGATATTAATGTAACTACAAA
TGCTAGTGATTTCACAGTTGAGTCTAACAATGCCAATGCTACAGTTAAAAAGGTTCAGG
TAAATTCACTATAACTGCTGCAACTAAAGGAACTTCTGAAATTACTGTAAAAGCTACAGA
TAAGGGTGGTTCTGAAAAAGTTGTTAAATTAAGTGTTGAAGTAACTGAGTCTGAAGATTA
ACATAGTGAAAATTAAGGTAAAAATAAGTCGATATTAAATCGGCTTATACCTTAAAATAA
TATAATAGGTATATAAATGACAACTTATAAAGATTTTCATAATGATTCTTTGAATGCTGT
AGTTATAGATAAACGAGCTATAGAACAAAGTATTTTTAATATATTAACTACTAGAAAAGG
TTCCTTAGCTGGTAAACCAGAATTTGGTTGCAATTTATATGCTTATTTGTTTGAAATGAT
TGACCATATTACTATTAATAGTATGCAAACCGAAATTACAAGATGTCTAAAAGTTTACGA
ACCTAGAATCAAAGTTCAAAGTGTAGACATTTATTCACAACCAGAATTCAACAGGGTTAT
ATTAAGTATTAATTATAATTTTACAGGAGTAGAAACTTCAAGCTTTGAAACTTATACAAT
AACCTTAAATACTAATTAATCTATTTAAATTATTTAAGCCTCTGATCAAAAATAAATACT
AAAAATATAAGCAGGAGATTTAATGTCTGATTTTAGATACCAAGGCTATAATTTTAACTT
AACTAGTTTTAGAGAGTTCGTTCAAGAATTCAATATTATGGATAACCAAAGAGCTAGTGC
AGACGCACTAAACAAGTCGGTTAATAAACTCAAAAGAGAGGTTAATCAATTAATCGGCCA
ATTTAAAATATTAACTTCAAAAGAATCTATCAGATGGGATGCTAGCATAATTTATGAAGC
AGGTGAAATAGTTTCTTATATAACAGAAGATAATCCAGATGTAGAAACCATTAAAAATTC
ATATTATTTAGCATTGCCTAGTGATATCGAAATCAAGGGTATTATCCAGATACTAATCC
TGATATGTGGAAAAAAGTTACTTTAAATGAATTATACCCTTGGTTAGATGTAGATAATTA
TCCTACTAAAACTGATAATGATAAAGATTGGCCCATCAACGACGATTACGATGTTATTAA
CTTAAAGTATCTTAAATGGGCTTTAGAACAATTTAAAGATTTCTTAGATGGTTATCTCGC
AGGTATCTATATTAAACAAGATAATAAAATAGATTTAGAAGTATCTGAACCCGCTCACGT
AACAACTAAAAAATATGTAGATAATTTAATAGATGAAGTAAAACAAAGCATTACTAATAT
AGATGATTTGTTAACGGATTATGTATTTGTTGATTCTAAATCTAAACAATTACAAACTCG
TAAAAGTAAAAAAGAAGCTTGGTTAACCACAGAAGCTGGATTATTACCAGGATTAAACTT
AATATCTACAATTGGCTCAACAACACAACAATTTAAAGCTATGTACGCTCAAGATTTTAT
AGGAACTGCTTTAAAAGCAAAATACGCTGACTTAGCTGAGGTCTACGAAACCGATAAAGA
GTTTGAAGTTGGTGCTGTTCTGGGTATTAATGAAAATTCAGAAATTGAATATTTCGACAT
CTATAAACATAATAGACCTTTAGGTGTAGTTTCAGATAAACCAGGGTTTATTCTTAATAA
AGATTGTAAAGGTGTGTTAATAGCTTTAAAGGGTCAAACACCAGTAATTGTTAAAGGTTC
TGTAAAAGCCGGCGACGAATTATATGCTGAGTATGACCGTTATGCCTGTGTAAACCCAAG
CAAAAAGAAGAAAAATATTTTATAGGCATAGCTTTAGAATCTAAAGAATCTGAACTAGT
TGGCTTAGTAAACACTAAAGTATAAAATATGTTAATACATAATGGCCAAGAATATGAACA
ATTAATAATAGTAGATTTATTAATACTACTTTTAGTAGTTACATTCATTTTAGCAAAAGA
AGAAATATAAATAATTATAAAAAATTATAAATAAAAGAAAGGAGTTTAGAATGTTATCTA
GAAAGATAAGAATTGATAGTTTTATATCTGATGCAGAAAAATCAGAAATATTTCAATATT
CTAAATCCCTTTCTGCTGTCTATAACGTATGTCTTGATACGCTCAAAGAAAATTTAAATT
TTAAAGATTTATCTAAAATCACAAAAGGTAGGTCTAAAACAACAGGCTTGCATTCAAAAC
ATATACAGAATACCTCTAGAGAGGTTATAAATGCTGTAAAATCTTATCTAGCAAAAAAGA
AAACAGATAAAACTGTTAGATTTCCAAAATTATATAGAGAATATAGTCCTATCATTATGG
ATATAAATCTTTCTTCTAAGATTGTAGAGGTTGTTAATTCTGAAACAGGAGAGGTAACTC
TTGTAAAGAAATATTGTCCAGGCGGGGGATTTAAACTAGAAGGTAAGAAAATAAACTTTA
CTTCAATAGGATTTGAATTAGATTTAAGTAAATGCCCTTACTATGATATAGAACTTATCA
ACTATGAGACTTTAAAACAGATAGTCATCAAGATTGATGAGAATAAGAGAATAGATTGTA
TTTTTGTTTTCTCAGAGAAAAAACAAGAAAAAGCACTAAATCAAAATTTTCTTTCTATAG
ATCTAGGAATAAGCAGTACAGCCATCTTGCTACTCAAATAAGATTGATTGTCTGAAGATAC
AAACTAAGAGATTTAAAGGTTTAGAAAGAGCTATAAATGAACTTAAGTCTAAAAGAGATA
AGAAGAAGAAAGGTTCAAGAGCATATAAGAAACTTAACAAAACAATCAGAAGAAAGCAAG
CAAAACTAACTAATAAAAGAAAAGACTATCTCCATAAGACCTCAAAAACTATGGTAGATC
TCTGCATTCTTAATGGTATAGATAACATCATTTGTGGAGATATCAAGACTAAAAATTAA
AGAAAGACTATAAAACAAGTTTAAACAAATCAACTCAAATGAAGGACTATTGAGTAGAT
TTAAGGGTTTCTTAAAGTATAAAGCAGAGAATAAAGGGTTGAACTTTTTACTTGTGAATG
AAGCATATACTTCTCAGACTAACTGTCTTACAGGAAAAAGAAACTAGACTCGAATCTTA
GTATTAGAGAGGTAGAATTAAGTCCAGGTTTCAAAGTTGATAGAGATATAAATTCAGCTG
TCAATATAGCCAAAATATGTGGGGATTTATGGTTATCCCATATCTTTGAGAAGAATAGAC
TTCTCAAGATACAAAAAATGAATATTACTTTGTAATATTTGATTAAATTCTTGTAGATTT
CTATAAGAATTTAAAAATCATATATTTTTATATGAAGGATTATGATGCCAGTCCCAAGTG
TTAGATTTATTGATAGTGATACCAGTTCAACATCAAATTATTCACAACCAAGAAGAGTAT
TCTATGCTGGATATTTCGATAAAGGTTCACCAGATACTTTAACATCCGTTTATTCTATAT
```

FIG. 15R. Continuation of (CJLB-13-1 [organism=Campylobacter phage CJLB-13] partial genome contig_1)

```
TAGATTTTAAAACAAAATTTGGTAAACCAAACAAAAATAATATAAATGACTGGTTTCAAA
TTTATAATTATTTTTTATATGATAATAATGAAATAGTTATTTCGAGATCTATTGGTGAAA
ATTCAGTTAATGCTAGTATTAGCTATCCATTTAATGACTTTGACGTCAGAATAGATAACT
TAGATGATTTTAGAAGTAAACGTATAATTTCTGAAAATAATTTCTTGAGAATCCTTGCTA
GAAACCCAGGAGAGTGGGGAAATGATTTAACAGTTTGTATTTTTACACAATATGAAGTTC
TTAATAATATGCTAATACACAGCAATTATTTAGCAAAGATATTCAAAATTCAATGAGTT
CAAATCAATATTGTATTTGTGTGTTCTTAAAAGATACATTAATGGAAAAATATATCTTAA
AAGAAGCTGAGGATATGGTAGATACTATTAATGAAAATTCTAATTATATATTCATTGTTT
TCGATCCTAAAAAATACAAGTTATATGATGGTAATATCCACTATGTGGATGGCTTAAATC
GCTTAGCTGATGGAAATGAACCTAACTCAGATAAAACAGTTTTTTATGGTTCTAATAGTC
TTAAATTAAGTAACGGGTACGCAAGTTTACCAAGTGCAGCCCAAATAGATGAAACATATA
AAAGTGTCGGTGAATCTAATGATTATGTGTTTGATTTTATAATCGCTAATACACAAAGTC
CAAATTCTGCTATCAATTTAGCAGATACTCGTGGTGATTGTTGCGCTTTCGTAGGCATAC
CCAGAGGTATCAAACCTGAAGAATATATTAAACAATTACAAATTTCAAACAATGCTGTTG
TTTACTATGGTTCTAAATTACAATTAAATCCATTTAATAATCAAAATATATATGTTAATT
GTATAGGCGATATTGTTGGTTTAAGAACCAGATTAATTAATTCACAAGAATTATCAGTAT
CTCACTGTAAAACAATTTATAGTTTCTTAAATACAATAGATTTGGATATATATTTAACAG
AATCACAAATAAAAGATTTATATGATTTAAATATTAATATTGTTAAAAAAGGATATTCCG
GTATATACGCTTTAAGTGAAAATACCTTAAAAGGATCTAAATTAACAAATAGAATAATAT
ATTTCAATTTAGTTCGAGAATGTGAAAATGCTGCATTATATTATGTATTTGAAAATAATG
ATGAATATACAAGAAATGATTTAACTTCAAAAATAAAAGAAATTTGTAGAAGTTATGTTG
CAGATAATAATATAGAAGATTTTAAAATAGTTTGTGATATTTCTAATAATCCTACTCAGG
ATAATAACATTTATGTAGATGTTTATTATAAACCTAAGTATTTAATTGAAGAAGTTGTAT
TTAGAATTCAAGCAGCTAGTGAATTGCCTAGTTGAATTCTAAATTGATTTCTTAAAATTT
TAATCCCATATTTTTGACTCTATCTAAAGTATCTGTATAATCTTTATCTTCTCTAAATCC
ATTAAATCTTGGATGCATTAAAGCATATATTTCAGAATCTTCAGATTTTGTCAATGCTGT
TGCTTTAACTGTAAAAACTTTATTTAAATACTTAGAACTATTTTTAAATATTTCAGCTCT
TTCAGTATCACTAATCCCAGAAACTTTACCTTGAATTAATTCATCATCTGTTTTAAAAAC
AATAGCACCAAAAGTATCCTTAAACTTACCATTACCTTCTGTAAAATCAATACAACGAAC
TTCAACTTCTATTTCTGGTTTTAATTTATTTGTTCTGTACTAGTACCATTCTTAAATAC
AGCGTCACAATTTTTTAAGATAGCACCTTCTTCACCTTCTTTTAACCAAGTATTTAAATA
CTCATTAGCAGCTTCTATATTGTCAATAACTCTGGTTCTAACAACAGTTAATGTATCAGA
TTCTAAAGATTCAGTTAATCTCCAAACAAACTCAAATCTTTCTTTATATGGTGTTTTACT
ATTTCCATTTTCAAATTCTTCTAAAGTCAAATAATCCCACATATAAAAAGTTACATTTTC
AGGTGGTGTTAAACTATTAAGTAAACCATTAGATTTATATCTGATTTCAGTTGAATTAGT
ACCTTCAACTTCATTACAAATTAATTCACCAATATAAGCACCATCTGGCAGATTCAATAA
TGCTGAATATACTTTAGGGTGATCATAACTTTCACCAGATCTTGAAAATGCTTGGGCACT
ATCACCTTTTTAATAAAAGTTCTATAAGTTCCATCCGCTTTTATTTGAATCATTGCTGG
AAATCTAATATTCTTAAATTTATCCATTAATGAACATCTCATATATGGAAATTCTGTTAT
AAGTTTTTTATGAACTTTGTTGATTTGTTTAGTTGAAATACCTGAATGAATATCTCTATC
CAAAATATAAGTAATAATCCTGGTTATTTCTGGTGTTTTATTGTTAAGTAATGACTGAAC
AACACTAATCGCCTTATTCCCTGTAAAATCGCGATTATGCAACGCTATGAACGTATTTTT
AATTGTATTGAAATCTATGGTTTCATTATTATTTTGAAATTCTGGTACTTTTTAATTCC
GTAAGAATATTTGACTTTATCATAAACCAATGAAAGAAATTCTTTAATGATTTCATTGTT
ATATTTTTAAGAACTTCTAATTTATAATTAGAACTATTTTGAAGCATTTAATTCATTTAA
AAAATCTGTTATAATTTGCATTTTATCTCCTTTTGATATATTATAATATAATTGAACTTA
AAAAATTATTAATTATGCATTTTCTCGTTCTAAGAATCCACAACATTCTACACAATTAAC
ACAGTTTTTACAATTTTTGCAATCTTCACAAGTATAGCAATCAACACATTCTACACAATT
ATAGCAATAATCACAACTTTCACATTTTTTGCATTTTTTGCAGTCTTCACAATCTCCACA
TTTTTTACACCTGACACAATTGTAACAACAATCACAACCTTCGCAGTCACAACATTTTGT
GCAGTTCTTACAACCTTCACAAACAAAACATTCATAACATTCAGCACAACCATTACATCT
GACACAGTCTTCGCAACCAAAGCAATCTTCGCAGTTTTTGCAATCTATGCACTCGCTACA
TTTTTCACAGTCTTCACAATCATAACAATCTTCGCAGTTAAACAATTAACACAGTCTTT
ACAATTTACTAAAGATTCTGAAGCTTTTTTAGCTTGGTCCTCAGAATATAATTCAGCATC
CCATTTATTGTTGTTAGAATCTACATAATAACCATCTATTAATTTCATTTAAACTCCTTT
AATATTATAATTTAAAACCTAAATGATAGCCAGCCTTCATAAACTTCAAATGAATCTAA
ATTTATATAATCTTTCTTATTGAATATAAAAAGTTCACAACCAAGTACTTCCATACAACA
TCGATCTGATTCTGAATCCAACCCTCTAAAGAATAGACCAAAATCTTCACCGTGTTGATA
AGAATCTACATGATCTAAAAAATATTTTTTACCGTTGAATGTAAATATTAATTTTTCATT
TCTAACGCGATCTATTAAATCGTTCATAACATTGTGTGCATAGTTGTTAGGGTCTTTAGC
TATTTTATTCATTATGGCTCCTTTATCTTTTAATGAAATAATTATAATATAAAATAACTT
AAAAGTTTCTGAATGTAACTAAAGTTTTAAATCAGTGAGTCTTTTTAATAGATAAACCG
GTTTTATCATATTCTTCTTCGGTATCTGTATTATTAGCATTGTTATTAGAATCGTTGTAT
TTAGGTTCATCACCAGAATCAGAATCTGAATCTGAACTGAATTCATCCCCACTTTCAAAA
TCTCTGTAAAATTGTTTATACAATGGATTTTTAGATTCTTTTTGAATAGCTTTAAGATTC
TTTTTGATTTCAACATCATTAAATCTAAAAATTTCTTTATATAATGTATCTACAGGTAAA
```

FIG. 15S. Continuation of (CJLB-13-1 [organism=Campylobacter phage CJLB-13] partial genome contig_1)

```
ACTGTTCCTCCAAAATCTTTAGCTGTTGAGAATGCATCTATACGTTTCATAAACAATGTT
AGATTCATTCTTTCAATAAATTGATTTTCTTCGCTAAAGTATATATATTAATAGAATCTTTA
AGTTCTTGAAATTGTTTTTCAGTACAAACTTTAGTACAAATTAATTCTCTTTTTAGAATT
TGCATAAAGAATTCCGTGTATACTTGGCGAATCCTAGTTATTTTTTGGAAGAATTTGATG
TCCTCGTTTGTGATAGCATCTGCTTGCAAATCAAATAATGGTTGTTGTGATTGGTCATCT
AAGTAGATTCTATTAACTGGTATTCCCATAGATCTATATAATAACTTGTAAAAAAACATA
ATATCACCAAGTTCTCCTAAATTACCAGTTTCATCCAAGATATCTACTTGCATACCTTTA
GCACCAGCTTTATTACCAATCCAATAATCTTCGACCATAGTGACAATATGTTGGTTATTA
GTTACTTCACCAGTTTCTGGGTTGTATTGTTTTTTATATTTGAACTTATTAGTCAAATCC
CTCATATAAGCTTCTGCTTTAGAATTCGGTAATTCACTTAAATCTATATTAAATACACGT
CTTGAAATTGATCTTGAAATCTTAAAGGTATTAACAAATCTTCAAGTGTTTTTAATTGA
TTAGCTGTTTTAACGGAAGCTTCTAATTCACTTAAACAAATACCAGAATCTGAAAATAAA
CCAAAATTTTGATGAACTATTTCCTCTATATCGTATTCTAAAGCCGCTTGATCTATTCGA
ACTGGAGCTTTACCATTGATATTGATATATCTTTGATTTCCTAAGAAATTATTTTTAAGA
GCTACTGAAGAATTTATATCTATGTATTTGTATTTAGAATCTGTTAAATCATACCAAAGA
TATCTAGGATCTAAATAATATAATTCTTTTATACCTTTTTCTTATCATCGTGGTATTTA
ATTAATATATTCATTTGGCCGTCTATATAAGATTGTCTGATAAAAGAATGTAGATATTTT
TGGGTTCCAAATAATTTCATTATTTTTCAAAAGCATTAGATATTGCTATGTCTATTTTC
TTATTCGAAGTATCAACTTCTAATTTAATAGGATCTTTGAAATCTCTACAATATGCGACT
TCGTCTACAATTTCTGTTAAACCACTCCAACATTCAGCAATCTTAGCAGTTTGTCTGTAG
ATATCAATTTTTTGAGCTTGTTCTGATGCTTTTTGTAGATTATCAACATAAGTTATGTCA
TTTACATTATCAAAAAAGGTTTGGAATCTTAAAGGTTCATCATCAGATAAAGTGTTTATT
ACTCTACCGAATGGAACTGTAGTATCTATTTTATTAATAGGTTGTTCTAAGAATGGTCTA
TCTATTTTTTCACCTATAATACTATTTTTTATACTTTCTAATAACCCCATTATTAACCTT
TTTTTTTTAATATTTATGTACTAAACTTTTAAACTTTAGTTATACTTTAAACTTTAAGAA
TACAAATTATAAGATATTAATAAATCTTTTGTTTTTTGACTAAGATATTTTGTATACTTA
ATTTTCTTTTTAATATAATTAATATCTTTTTTAGTTTCTAAATGAATTGCTTTAATCAGT
TTATTATATAAAGACTTCGGAAAAATTTCTTTTAATTTTTTTGCTTCACTTGGGTATACA
TACGGTGTTGTATCAGTTTCCAAATAATTTGCAGCATTTCTTAAAAAATCAGCCAAGTTT
TGAATTCTATATCTTTTATAATTATTTTCCATTTTACCTAAGAAAATATTACAAGTACTG
CAAATAAACATTTCTGACTAAGCCAGCGCCTTGCACACCTAAATTTCTTGTTTTTTACTA
TGTTTGTGATCAAGTACAGGATTGAAGATCTTAGAACCGCATAAAGGACAAATTGGGTTT
GATTCTACCATAGAATCTCTGAGTTCTTTTGCAGTTTTTGTATTTAGAACTATAAGTTCT
TCTATTTCATAAGTTTTTAGTTCTCGAGGTTTTAAATCTTGCATTTTTAGTCTTTATATT
TTATGTTTTTATATTAGTATTTGACGGTTCATTAACAACATCACGAATTAATTTAATATC
ATAATATATAGTTATTATACAAAATATTAAGAACATTTTCCAGGATAATGTATGATGCAT
ATAAAAATCAATTAAAAAACAAATTATACCCACTGATATAGCTATAGCCATATTTAAGAA
AGTTTTAATTAAATGGTTTGACAAGTGTTAAATCCTAGTTTAAACTTGATATTTCAATAC
CATTATTATAAAACAATTTTTTAGTTTTCTTAGAACTAATTAAAACATTTTCTGGTATTG
TTGAGTTATCTAACGTAGATGACACCCAAGTTTTATTAGAACTATTATATGTCCATTTTT
GATTGTTTGATATATCTATTATAGTATCATCATACACACCTGATTGTGAATCAAAATAAA
ATTTAATATTTTGAGACCAATTACCAAAACCCATTTGACAAGGTGAATTTAATAATTCTT
TCAATATATTAAATTCATTATCGGATAAAACACTAGGTTTTGTTGTTGGTAATGTATAAT
CAATTAATGAGTTGTCATCCAATGCTTGGTTTAGATCTGAAGTCCAACATTGTACTCTAT
TTTTAGTTCTAGCCACTTTTAATAAATGTTTACCTGCTCGCCAAATTGTTTTAGGATAAT
TATCTGTAATATTGCCTTTAGAAGCTAATAACCTATAAGTTGTATAAGGTTCTTCATTGT
TGCCACAATAATTAAAAAATAAACCCCACGAAGTACCACCTGGTAAAGCGTTTAATTGTA
AAGATCTCACTGCGCTTAATGTATATAATTTACCATTGATCATTTTAGCTGCTACAACAA
TACTTAAAACATCATCATCATTATCTTGGCCCACAGCTGATATTTGCACACTATAAGTAT
CTTTGACGCCATTACTTAAAAACATATTATAATAACTTGAATTTATATTACTTGCTATAG
CATCTTCTGCTTCTATGTAAGACCATTTAGCAGCTTCTGCTTGACCAGCATCATCATCTA
ATTTAGGACCACTAGCAGAATTCATAATAGAATGTCTTACCCAATTATCAAAAACATTTT
TTAATGTAACACTTGATTTTAACGTGGCTAAATCAGTCGCATTATCACATATGTTTAAAA
ATTGAACTGCAGGTGTGTTTTGAACTTGAGTTATAGTGTTATTTACATTTTGTATTTGCT
GAGTTATAGTGTTATTTACATTATTTTGAACTTTTTCTATTTCGGTTTTTAAGCTTTCTG
CATCTATAATTTTATTAGCTTTGTTACCATCACCTAAATACACGGCATTTTTAGAAAATG
TTAACATACCTCTTTGGGTAGATTTATAATCTCCCGCTTCTATGATATCTTTAGAATCTA
CATTTAATCTTAACTCAGTCATTTTAAACCTTGCCCGTCATTTTTTGTTATTTATTTTCT
GGTTCTTAGACAAATCTGATACTAAACCTAAGCTTTTAAATCTTTTAATATTTTATTA
TACATAGAATGTATTTCACTTGGTGTATTTCTTTTAAAGAAAATTTCTGAATTTAGATTC
TCAATTACTGCAGTTGCAGAAATAGCGCCAGTATCTCTAGGCGTTTCGACAACTTGAATA
TCTGGGTTAGCTCTTAATTGGTTTACATAGTCATTATATCTATCACTACCACATAAAACA
GCATTTATATTCATTTTAGATTTATTCATAATACTAATAATATTTCCTGTACTATGTTGT
ATAATTTCAATTTCAGGAAAACAAGATTTTAACATTTCTAATCTAAGATCTTCAAATTCT
TTAGTATCTTTTGAAGTTACCAAACAGACTACACCATTATCGTATTTTTTTAATCCATTT
TTAATAATATTATAATGAGCTTTAGTTAAAATTCTAAACTTGCCTAAGAATAAAAAGTTA
```

FIG. 15T. Continuation of (CJLB-13-1 [organism=Campylobacter phage CJLB-13] partial genome contig_1)

```
TTATTTCCTTTAAGTCTTTTAATAACGATCATTTTGATATTACCTTGAATATCATCTTTT
ATTTGAAATTGTGTCTTTTTAGGATGTGTAAAATTCAACTTATATTTCTTAAGAGCTTCT
CCATACCTTTGAAGTATTTCATTTAAAGAACCTTTAATATTACTAGCTCCAATAATATTT
AAAGCTGCTAATCTAACGTTAGCCCAATAAGCATTTTCAGTATCAGGATCTCCTTGATAT
TGTGAACGTGTTTCTGCTCTTGCTTTAGGATCCACTTGATAAGGTTGTTGAATTTTTAAT
AAGAATCCAGGATAAGTTAAAACATAACCTTCAGGTTTACCACCATACTTAGATTCCATT
TTAAGAAACATTTCAGATATTTGTTGTATATATAAATCTATGTTTTCTATTTTAAGAATA
TTTTTATAAGTTCTAAAAATATCATTGAGTTCTTGTGATTTGATACCACGTTCGAAATTA
GCGAAATTACCTTCAAATATAGTTCTTGGGTAATCAATCCTAATTTCTTAGCATAAGTT
TCTCTTGAATCTGTATAGAAACCTTTTGGTTTTGTGAATAATCTCCCAAATTTGACTTCA
TAAGTACAAGGGCTATAAGCTAATAAAATTGCGCCCATCTTCTTATACTTATGTTGTAAT
GTAGGTTTTTTCATCAAGAATTCTACAAAGAATTCATAATTTAAAGGTAAACTCTTTGAA
TCACATTTTTTAAGAATATCGAAAATAAATGTAAATTGTGAATTATTAATGCTTTCAGGT
CTTATTTTGGATTTGGCTGCGTATTCAAACTCATCAGGATATATAATATTGGATTTGTAT
GAAACAATAAAATCTTGTTTATAATCACCAGTTTTATCTATATGAACTATAGTTACTTTA
ATACCATCATATTTTCTTCTACTTTAACTTTATCATAGATAAAAGCTTCTTTTCTTTGCT
TGGCTAGTTAAATATTTGTTTGCATTTAATATAGATATATCAATTTGATCTTTTTGCATT
GTATTCACTTTTTGTTTTATTTATTACTAAATAAATATATCAAAAAATCATAAAGGTCTA
ATATGAATTTTAAAGAAGTTCAAAAAACACCTGCCAGAGGTTATTTTTGTATTGAAAGTT
TAGATGCTAATGGTAATATTATAGATAAATTCGAACAGAAAAATCTTATTACAAATGTAG
CAAGAGCTGAATTTGCTAAATTGATTGCTGGTATCAATGAAAGCAATGCTATTAATAGAT
TTGTTATGGGTACCAAAGGACACCAAGGTTCTGATATTTTAACACCAAAGGATGAAACTA
CTGGATTTACTGCGTCTGTTACTGATATTTTCAGTGGTCAAGAACAAGGTGATATTAATA
GAACTTGGAACCAAGTAATTTTTACACCAAGTGGTAATATGGTTAACACTGCTGCTACAA
ACGTTCAGGATGGTGCTAATAATAACTCTACAGTAGATATTACAGTTACTGGTATTGAGC
AAGCAGAGCCTGTAGTAACTTATACTATTAATATTGCGCAAGATGCTTTTAACTGTGCTA
ATGATGGTGTAGTTTATACTGAAGCTGGTTTGTATAGTGGTACAAATTTAATTGCTATGA
GAACCTTTAAAGGTAAAGTAAAAGAATCAACAGTTGCATTCAGAATTCAATGGAGTGTAA
TGTTTTAATTATTGGAGCTAATATAGCTCCTTTGATTAAGATTTACACATAGAATCTAAA
ATACTTGCATATAATTTAGCTACTTCTTTATTTACCTTATATTTTAATTGTATTTCTTTG
ATAGATTCTGATTCAGCTAACGCTTTCGCAAATCTTATAAATTTTGGTTTATTTTTTGTG
TATCTCACTAAATTATATTGTGCTTCATCTGGTAAGCTTTTATATAATATATTAATATCA
TTAGCTAATTGTAAAGTGCTAGGGCTTGACCCTAAAAATCTACAAAACATAAAGCTATTA
AAACCTAAACTCTCATTATAATCTTTGTCTTTGAGACAGTTTGTAAATTGTTCGAATATA
TTTGCCATAATTAATTATATCCTAATTTTGTTTAAATTTTGATTAAAGGCTTTTAAAAAT
AACACTCGAGTGTTAGATATACTAAAGGTATCAAGATCCAACTTCAAGTCTTCTATATAG
ATAATCTTTGTATTCTTTAGTAGAGTTCTTAAAAACAAACATAGCCCACTTAAAAGAATG
TTTAAATAAATGACATACAGAATCTATTGGTTCTCTAACCTTCGAATTTAGCTTCTCGCAT
TTCTTGGTGTGTACACCCAACATTACAATACTCACGAATTTCGCACTTCATACATTTCTT
GAATTTTCTTGGGTCAGCGTATTTAGACATAAACTTAAGATTCTTTAGATTTAATCCAGA
TTCTGGACTATATAGAACCATTTTATTAGTTGATCTGTATCGCTCGCAAGGCCAGAATTT
ACCATCTACCGCATATAAACAACCGTTATTTCCTACGAAACAACCGTGGTCTCTTTTACC
AAATCTAGCACCTGCTAAAATATCTAAAGCATATAAATCAATAATCCTACACTTGCTGG
TATTCCTTTATGTTGATATTCAAGTACTTTATGTGCTAATCTTTCAACTTCTATAGCAAA
TGTTTCTATTTGACTTTTAGTATAAATGTTATCACGAACTAAACAAAAATCGGGTCTTAA
GAATTCATAATCGTTAACAAAAAACTCAAAATTTTCAGTCATTGTTGTGAAGTTCTTGGG
TTGTATCATAACTTTACAGGTATCTGTAATGCTATGAATTAATGCTTTATTTTGCTTAAA
ATAATCTAAAGTTCCTTCAAAAGTACCTTCAGCCACTGGTCGATTAGTATTTTGCCATAG
ACCATCAAAACTCAGTGAAATTCCACAATTATGAGCCTTTAAGAACTGAACTTTTTTAGG
GTCTAATAATGCACCATTAGTTATCACAACATAGCTGGTACATCTTGGATCTTCTTGGAA
TTTTGGTAAAGTTGCTTCAATCACTTCCCAGTTTAATAAAGGTTCCCCACCAAAGTATGA
AATATGATAGCTATCTTTATCATAATAATCTAACATATAATTAATTCTATCAAAGAATTT
CATAGCTGTGTCTATAGACATAGGGTTTGGTGGCGTATGCGCACTATAACAATATTTACA
AGCTAAGTTACATTTAGTATCTAAGCTAAATTCTACTATTAGTTTACCTGCCATTTTAAC
CTTTGTTTTTAGTTTTGGTCTTAGGTAAGCAAGTTAAACAAGCTAAAAAGTTTAGTTCTT
CTTGGCTTAAATCCGAATCTAAACTTGAGTTAGATTCAGAATTTAAACTAATCTTTTTAG
CACAACGCAAAGCATATTTTATACCCACTCTGATGTCTTGCAAATCTTGTATTTTTAACT
GAACTTCGGCTTGATTTTATCTATTAAATCTTTTACCACTGTCTTTAATCCTTTGTAAA
ATTGGACCCAAATAAGCATCAACTTCACTAGCATCATATTTTACATCATTTATAAGACGT
TTTTAGTTTCTGCAATAATTTTGAGAACATTTTCTTGAGAAGTTTCTAAAATTAATAAA
GAATCTACACTTAATTCTATAATAATATCTTTAAACATTTGCTTTAATTTGTTATATTCT
GGTTTATCGGTAAACTTATACCCAAGTAATTGGAAAGCACTCATAAAATCCATTATTATA
ATATAATCACTTAAAAGTTCTTTATAATTAACAGAGTTTATTTTAGCATCTAAACCTTCT
TGATAAAATAATTCTTGTAATGCTTTAACAGCATCAAACCCATAATCATAATCACCAAGT
TCTAAAGAATGTCTAATCTTAAGATAATTTTTATAACTTGGTCTATCTACTTTATCAATT
GTTTGTCTAAATACAACCTTATCACCTAAATAAGTCAGACATTTATTGATATTATTAATA
```

FIG. 15U. Continuation of (CJLB-13-1 [organism=Campylobacter phage CJLB-13] partial genome contig_1)

```
TTATCATCAAAATCTTTACCATTGATAGAAACTCTGTACAACGCTGGTGTGTTGTAAACT
ACTGGGTTATTTGCTTGTGCGTAATCCAAATCATTTTTATCAAATGTTGCTATTAATTTA
CTATATTCAATTAAATTGTTTTCATAACAATTCATAGCTAATTTACATTGGAGCATTTTG
ATATCTGGAAAAATATCAGTAGCTTCTAATTCACCCAATTGTTTTAAATAATCTAAAACT
TTAGATTTATCATCAGTTGTATATATTTTCGAAATTAAATACGCAGTTCTTGTTTCTATA
CCCTCTGGGTTATTTTCTATGATATATTCGTATTTTTCGAACATTTCTACAACTTGTGAA
AGCAAACGTTCATCAAATAATATAAAAATTATTTTTCTTAATTCTTGTTGAACCATTATA
TTCCTTTTGAATCTTTAACTTCAGTTTCTACATTTGGTGTAGATTTAGATCCATTTAAAA
TCTCATCAAATAAAGAGTCTACTTCTGCTTGTTCTTTCTTATTAAGTTGAATCTTAGGCT
CAGTTGTTTTAGTATATCCTAATTCATCTAAAAATGCTTGGGATAATCCAGCTTGATCTA
ATAATTCAATAGCCATAGAATTAAACATTAAAGACATCATACCATTGGTTTCTTGAATAT
ATTCTGAAGCTTGACTTAGATGATAGGCTGTCATAAGAACTTGTTTTGTTTGATCTTCAG
TAAAAGAAAATTTTGGATTTTGTACATTCATATTCATTTAACACCTTTAAATTTAATATA
TTTATGATTTTTTATAACAATATCTAAGTCGATTATTAGCTTCTAAAATATTTCTAAAGA
AATCTCCAGCTTGTTTAGATTGTTTATTAGACTCAAACGTCAGTGCTTGGACATCTTTAG
GAAAACATTTACCACCAAAACCTTTTTTACCATCTACACATAACTTAGCCATTAATCCTT
GAGAATCAAATCTTCGAACTCATTTAATAATAATTCTATTTTTCTAACATTGAACCCAG
CTTCATTTAATTCGTGAAAGAATAATACCTTTAAAGCACCTAAAGCATTTCTAGCGTATT
TAACTTCCATTGCTTCTCTAAGACTACAAAAATCATAAGGCGTATCTATTAATTCAGCAA
TTTCTTTAGCATACATAATATTATTAGCGCCTATCACGTGATATTTTGCTCGTTTCAATG
ATTCAACTTCTGTTAGAAATTCTGGCCAGGTTACAAATTTTAAATTGTATTCAGATTCTA
TAAAATCTACATTACTAGGCAACAATGTTGATCTAATAACAACTAAACCACTAAAATCTT
TTGATTCTATGGTATTTAAAATTTCGTATAATGTTTTTGTGTCTTGATTTGAATCAATAT
TATCATTTAACACATTAATGCATATAAAAATCTTGCTATAACAATTTAAACCAATTTCAT
TAAGATCTTTATCATTAAATCTTGGATCTATTATATTATATTCAATGCCTTTAGAATCAA
AATAATTTCCTAAGCTTTGTCCGACTACACCAAAACCAATTATTAAGTTCATATTAACTC
CTTAAATCTTAAATATAAATTCAATATTAGTTAAACCTATAGTATAGCCTAAACTTAAAC
AAGCAAACGCTGCTAAACCTAAAACAATAAAAACGAATAACTTATAAAATACTCCTGGTA
TTTTAAACACACTGATAATGCTAAGAACTGCTAAAAATAAAGCCGACACATAGAAGCCTA
ATTCAACTAATAATAACAAAAATTTAATAATAATTAAACCAGTTGTTTCTAATATATTAT
ATTGTGCATAATTACTTAACATTATATACCCTCCTTAGTATCAAAAGCTAAAATATGTGC
TCTTGGACTAAAACTAAATCCGTGCTCAGCACATTTTTCAAACACAAATGGTGTATTCTT
AATCTGTAATTCACGAGTTTCACCCATAGGCATTAGATATACTTCAGTATATATAGGTAA
ATCATAAAGTATTTCTTTTATTTCAGTGTAGTCCGTATCCCAAGTTTCTGGATTAACTAC
AAATTTAAGATAAGATTTAGGACAATTTTCAAGAATCTTACTGATTGTTTTTATATTAAT
TCTTTTCTTTTTAGGTTCTCCTGAACAACTTAATTTAACTGACATACTGAACATAATTTC
TTTTTGGTATTCTTTAAAGAACTCAATATCCAAACTTGCATTAGTCTCTATTGTTATTTG
ATGTTTTCTTGAAATATAATAAGCTAAGAAATCTTGAATAACATTAGTATCCCAATATAA
TAAAGGTTCACCGCCAGTTAAAATAATATCTTTGGTATGTTTAATTTCAGAGTTTTTAAA
TGTGACTAATGGGTCAATAATTGATGTTAAATCTTTGAAATTATCAAAGTATTTCCATTG
TGATTTAAATTTTGGAGATACTGCACGAATAGTATCACAACCTGTTACTACCGAACCATC
TGGAGCTACTGCAGAGCATCCAAAACCTTTACAAGTATTATTACAACCAGCAACTCTAAC
AAATACTGCAGATTTAATCTTGGCCCTTCACCTTGAATGGTGTCACCAAAAAATTCATA
GAATGGAACTTTTTTAGTTCTTGTTTTGAAAATCATTTAATCTCCTTTTTCATATTATAT
AATATAACAACTTAAAGTTTTTTGAAATTGTTTTAGTTTTATATTTAAATTAACACTAAA
GTGTTAAATATAGCTTATTATTTAATGAATTCTTCAATATAAAACCTAGCTCTATTTCCT
AAATGATTTAGAGTTTCAGGATCATTAAAGTTAGCACCGATAAACTCATTAGTTAAAAAT
CTTACTAATACCTGGTGTTCAAAAACTGTTAAAGTCCAAGAATCTAAAAACTTACTGATA
TTAGCTTCAGCTTCTAAAATATCTTTCATTAAAACTTCTGCATTTTGGTTATTCATTTAT
ATCTCCTTTTGTTTTATTATATAATAAAATAACTTAAAGTTTTTTTGAATTTAGAAATTT
AAATGTTAAAGTGAGAAAGATCTAAGTTATCTTAGATCTTTATTTTTGAGTGTCTGTAGT
CTGATTTGAAGGCTGAGCTGAATTTTGACGATTTTCATAATCTGCTTTAATTGTTGAAAA
CCATCCTTTATAATCCATAGTTACGAAATTCTTTTGACGTATAAATAATTTAAAGC
TTCTTGTAAGATTTGATCTAAAGTTGCTTCATCATCTGTCATTTCCATTTCATCTAAACC
ATTTAAGAATTCTTGATACATTTTTTCATATTGATTAATTGATTCACAATCTTAAGATA
TTCTTCAAGACTAGCGATTAATTTATCATTATCAGTTTCAAGAATTTTAATATACATCTC
TTCACGATTATCATCAGTTATAAAATAACCTTGTGAAGCAAATATATTATTAAGATATTG
GAATCTAAAATAAGTATATTGTGGTATTCTCGTAAAAATCTGACTAATTGCAGAAGTTAA
TTGGAAAATATATGAATTCTTAACTAAGTTAGCACTCTCGTCAATTTCCAAGTTTCTAA
AGTTAACACATCAATATCTTTATGAATTTACAAGTTTTTTATCTGCTAATGCTTCCAA
AACTGCTGTAAATAATTTACTATCAAAAACTTCTAATGTGCTAGACCCCGGTAACAAAA
AGCATTGTCTCTTTGCGCGGAAACAATCATATTATAAGCACCTTGATCTATATATGTTAT
ATACATACTCATAATTTAATCCTTTCTTAACGTTTTAACCATTTGGGGGTATAATATCT
GGTATTACATCGAAATTAAAAGTTGAACTAGCACCACAACGTGAACAAGTTACTGTATGT
TCCCTAGATTCAATTTAAATATCATTTTTTCAAATGCTTCAGAAATCTTATCCATTATA
TTAATATCTAACTCATTGAAGTAGTCCTTAATATCTTGGAAGCCTTTTGTGTTATCCCCA
```

FIG. 15V. Continuation of (CJLB-13-1 [organism=Campylobacter phage CJLB-13] partial genome contig_1)

```
TTGATAGATTTAATATGGAAAATCAAATCATCTGTGCTTGGTGAATCTGAAGTTCTTAAT
TTGTTATTATAGAGTTCGATATTTTGAACATCTTGTAGTTCAATTTTGATATCACCAATA
TCAATATCTTGGATTTTACCTGATTTTGTTGTAAATAGTTTGCTTAATTTAATTTTAGAA
TCAGTAGTTTTTTCACAACTTCTGCACCACCAACTGTAATTTAAATCATCACCAAGATTT
ATAATTCTTAACAATAAAAACAAATATTCTAATTCGTCGTTATTTAAAGCTGTCGGGTTT
TCTAAAACATTTGTAACAAAACATTCATATCTTGCTTTAAGTTCGTCTTCTGTGGAACTA
GTATTTTTAATTTACTTTTATAGAGTTCTCTATCTTTAACTTTCCAATTACGAACTTTA
ATAGATCTATTACCTAATTTGATAGGGTTATATTCTAATACCATTAAATCTCCTTATTTG
TTATTATATTATATAAATGCTTAAAATCTGCTTAAGTTTTTGATTACGATACTCTGATGA
ATAAGCCTTTAGTATCGCTTATTTTACCAGTACATTTCCAAGTACCTTGCATATATGCAT
AAGTGTCTGTAGATAAACCAGATCCTGCATATAAATTATTAAAAACTAAAGTTGTTTTTG
AATCTAATATAGCTATACTGCCAATTTCATTAATGCCAATATTAGTTAAGTGATTTGTGA
ATTGAGTTCTTGTTATATTAATTTCAGCATTTCCTGAACCTGTGATATCAGTTCCATTTA
TAGTTTTTATAGAATCTAATTTCTTAGATAAAGCTAAATCATTTGAAGTTTTATAATTTG
TTAAATCATTATTAACTTGGTTGTATTTAGTTTCTAAGCTTTTAATATCATCAGTAATGG
TTTGTATTTGTTCAGCAGCTTTTAAAAGTTTCTCCATATTTTCGGGATCTAATTGTTTTA
GAACTGTAGATTGCTCAATTATTTTATCACTAACAGTTTTTAACCACGTAATAATATTAG
CAAAGTTTCTATCTACTTCTTGGTGTGTTAAGACATCTAATTTAACATCTGTAGTTAAGT
TATCTTCTTTAGAATCTGTGAAACTTGGTAATTCTGGTACTTGCTGATTATTAATAATAC
GTAATCTTACGTTCACTGCTGAGCCTTTTTGGATATTTATTTCCGATCTATAATATAAT
TTATAACAAATGCAAAGCTAACTTCTCTGGGTTTAAATCTATATCTTTTGTGCTGCTAGG
GCACCCAATAAACTGGCTAAATGACCATTTCCTCCAGTTAAGAATATCATAACACTCCTT
TAATTTAAAATTGATTTAAACCCTGTTTTTGTTAAGATATGAAGGGATTTTAGATCTTAC
TAAAATCCACATTCCAAGGTGTCATTTCTATAGGTTTACTCATTTCATTCCATAATTGAC
TAAACCATTGACTACAAGTAGTTATATTATAAAATGAAAAATACTTATTAAGATTTTCCA
TATTAAAATCTGTACTAGATTCTGTATATTTCTTTAAGATTTCTAATTCAATATCAATAG
GTATTTCACTATCCATAACTAACTTATAATTACGATTATAATTAAGTCTATATATTTCGT
TAGAATCTAAGAAGGCGTCTAAAGAACCAAACTCTTTAATCTTTTTATTTAAAGCAGCTT
CACCAAATCTTTGTTTTTTATAAACTTCAACATCAGGATAAATTTCATTAAAATTATTAA
TAATACCTAGTTTTAAGTTTTCATCTAACTTATAGAAATCTAATTCGGTTCCTTGATAAT
AAGCTTTAAACTCAGGTGTAAATTCCGAAAAATCCACAACACGTGGTACATTATCAGCAG
CATCACCTAAACAACAATGTATTCTTTCCCAACCTTCTGGATCATCATTAATGATCCATT
TATTAGTTATTGCTGAATATTGTTTTATATCGCCTAATTTATGCAATTGTTTAAAGTCTT
TATCGGGACTTAGAATTAAAATAGATTCTGCTTTGCAGAACTTCCTAGTTAATACACCAA
TGATATCATCAGCTTCAGCTCCTGGGACACCAATAGCTTTAAATGGTGTATAATCATTTA
GAATTCTAATTAGTATATTAATATGTTTATAAACTTCTTTAAAATTAACTTCAGATTCTT
CTCTTTGAGTTTTTCTTTGAGCTTTATAATCTGGATATAAAGATTTTCTCCAATATGGAA
CACTATGATCATCTATACAAATAACCATAGTATTATATTTACCTCTATAAAGTCTATAAT
TTTCTAATAATTCTTCTATAATTCTAAAAATAGTCCCACTTATGAATTCTTCAGTAATAT
ATTTACCGTCTTTTTTATGTGGATTCATTTGCTTAATACTAGTATGTAAAGCTCTGTGAA
TCAAAGAACTTAAATCATATAAATCATATATAATCCTTACAATAATGGTGCTAATTCCA
TAATACAAGCAGCTAAATTTAAGTTTCTATCTCTTGAGAAAGCACTTTGGTATTGATATT
TAGCTAGTATTATGATAGCTTGTGGTTATTATTATTTTGAATATCTAATTTTTTAAATG
CATATTCATAAAAAGCATCTGGGTTTGTTAAACCATAAACTACTTTCATTAAATTATCGA
AATCGCGAGATCTAATTAAGTTAATTAAACCTTCAAAATCAGAATCTTTTTGAATGTCAA
GAACTAATTTATTATTGAAATTACATTTTTGTAAACAAGCAATCATACCTCTTATACTTG
GATAATAGTTCTTAATAATATTAACAAGATCCTCATTTGTATAAGAAACTTTTTCATTAT
CTAAGATTTCTTTTAGTAAATTAAAAGCTTTTTGAACAAGTTCTTGTTATTAGAAGCGT
GAACAACATCAAAATCAAATACTTCAAATCTGTTAACTATAGGAGGCATTATATTAGAAA
CATAATTACAAGTTAATATGAATCTACAATTAGCAGCAACTTCTTCAATAAGTGCTCTTG
CAGCTGCTTGACCATTTTGGCCAAAGTAGTCAAATTCATCTGCTAAAACAATTTTAGGTT
TTCCATCAAAGCTTTCAGTACTAGCAAATTGTAATATTTTACTTCTCATAGTATCAATAC
CAGATTCTAATGAAGCGTTAATATATAAAGATTCAAAATTACCTTCTTTTATAATGGCTT
GTGCTGTGCTTGTTTTTCCTGTTCCTGGGTTTACTGAACTTAATAAAATGTTTGACGGTT
TTTCAATATATTTTCTAAATTTATCTAAATAAACATTTGGTAAAATTAAGTCATCAATTT
TTTGAGGACGATATTTTTCTACCCAAATATCGTGTTTTAAATCTACTGTCATTGAACTCC
TTTTAATATTTTCTTAATTATAATATATTTTAGCTTGATACAAAATTAAAATTTAATTTA
AAATTATAACATTAATATAAACTTACACCATAGTGGATTATTAAATTTAAATACGACCCA
AATCTATGAAATGATACAAATTTTTACAGATTTTATATCTTAAGAATGTTTAGCACACCT
CATAAAATATTTTATTAAGTTTTATTATTTCTTCAGATATGACATTGACTTCATCTTTTA
TATCACCATACAAAACATAATCCATATTAGAATCTAAAACAAGTTTTAAAATTTCTTTTT
TGCTTTCTAAGTCTAAATTTTCAAATTCTTTATCTTTTAAAATTTTATTTATATCTACTC
TATAATCTAAAAAGCTTTAGTTTTTAACTCTTGATAAATATTATCTAATTCTTTTTCAT
CATTTAAATTTTGTATTTTTTCTTTATAAATTGCATTTAAAGGCATAAGTTCAGCATAAA
CAAAATTTCCACCACCGTTGCCAATTAATTCAAAACTCCCTAAAACTTTTGGACTGAAAA
GTGTGTCTATTTCATTTTTATTTAAAATATTATCAAAGAAAATCTCATTATTTTTCTCAC
```

FIG. 15W. Continuation of (CJLB-13-1 [organism=Campylobacter phage CJLB-13] partial genome contig_1)

```
CTTTTGACGGAACTTCCTTTAATACACAATTTTTGGATGGAAAATTAAGTACTATATTTT
CGATACTCTTTTGTCTTTTTACCATTTTATTATCCTTTTTATTTATAATTAAAATCATAA
TAAAGATTTTAAATGTAATAAAGCACCGAAGCCTTTCTTAAAAACAAGTTCTATTTTAAT
ATTATTTTGAAGCATTTCATTAAAATCTTTTTGTGTTAAATCATTTGGATAACATATAAA
ATGACTATTTGGTATCGAATTATATTTTATCATTTTTTCAATTCCAACTTTGTCGTTATC
TAAACAAAGAAAGGGCACTTTATTAAATCTAAAACATTCTTTGCTATTGTGGAAGTATT
TAAAGCTATTATTTGATTAGTTCTGTATATTTGTCTAAAAGACAAAGCATCGAGAATAGC
TTCAAATATAAAAACTGGTTTATTTAAATCAACATTAAATAGATTCCAAACTCCATAATT
TTGATTCAATGTAAAATTAATAAATCTTTTTTCAGTTAAAGATCTTGCATAGAACCCATA
ATAATTAGAGTCTTTAGAAAATGGAATTACAAGATAGTCTTTGATTCCATAATAAACACC
ATTTAAATTAAAAGATTTAGTTCCATTATAGAAATCTAAAAAGTTAATAGTATCATCGTT
AAACCCACGAGATTTTAAAAACTCTATTTGTTTACTTGTATTAGTGTCTAACACTGAAGT
TAAGTTAATATATTTGAACCCATTGTTGGAGCTTTCAATGCTAGTAGAGCTAGCAATGTT
TTCAATACTTGTATTGCTAGATTCATTAGAATCGCTAGTATTGCTAGCACTAGAATCAAA
ACAAGACTTCATAGTCTCTATTTCATTATTACTTTCTATGTTAGATTGGTACTAGAATC
AATGAATTAATTTTAAATTTAAAATTCTCTGATTTATACGGCAATAATAATTCTGGTTT
ATAAATCTTTAAGAAATTACTTAAACTCATTTGAGTATTTAATTCACAATCACCATTAAA
ACAATGAACTAAAGTAACTCCTTGTTTTTCATATAGGTGTAGTCTTTTAACAGATTTTTT
ATATTTTGAGTCTCCGCAAATTGGACATTTAACAGCAATATCCAAAGAACTTTCTTTATA
AGTTCCAGGAACTGCTAACTTAAAATACTTAATATCTACAAAGTCTAACACCTATATCTC
CTATTAGTAAACGTTTTCTAATCTTAATTCAAACTCTTGTATTAACCCATCACTACCCAT
TGTAGATAATTTTAAAATATCAGTTTTACCCGCTGGTATTAATTCACATTCATTAATAGA
TTTAATTTCATTTCATTTAATAATGCTAGAACTTTATTATAGTTCTTATTAAATGTATG
TTGATTAATATTTGAGATTGAACTACATATTCCTTTTGTCTATGATAAAATTTTATTGT
ATTCATACTTAAATCCTTATTAAGAATTATTAAAATGTGCAAATCTTTTAAGATTTACCA
CTCGATCCAAATCCTTTAGACCCTCTTTCTTGCTTAGCTTCAAAATCCTTGAATTCAGAA
TTATTAAGTTCGACGAACTTAAAACTATATTTTCTATGAATTAAAACTTGCGCATATCTT
GAACCTTTTTCAATAACTATAGTTTCTTTACCAATATTATTAATTTTAACTCCAAAATCT
CCAGTATATCCAGCGTCAATAATACCAATATGTGGAATTAGATCTTTTTTAAAACCTAAA
GAACTTCTTAAATGAACGGTCATATAAAAAGGATCTTTTTCATCAATTGAAATTCTTAAT
CCATTTGGAACAACTTTTGATTCTCCTGGTTTAATTTCGTTGTTTCGGTGCAAGTAATA
TCAAATGCTGCTGAAGTTCCATTATAAGCAATTTCTGGTATTACGGCATCTTCATTTGTT
TTATGTATATAAAGATTCAAATCCATTATTTCTCCTATTAATTAGTTTTAGATTTTATAG
CTTCGATTATTTTAATATCCTAGAATCTGGGTCTAATTTAGAATCTAAGTGAATGACGT
TTTCTAAGTCTACTTTCTTAAAAATATTGTTTATTTTAGATCTAAATTCAGGATCTATTG
ATCTAACACCATTTGATTCTAATGGTATATTTTCAGAATCTAAAACAAAAATAAAATCGA
ACTGTTTATAATATTTTATTAAAGAATCTGTGAATAATTTTAAATCGATGTCTTTGTTAA
TACCTGTATATACTATAACATCCAAAATACACCTATCGTGCACAGTGGGTGCATTTATAT
TTTTTAAAGCATTAACACTATAATACAACATTTGCAACTGTGTTGCTAAGTTTGTATTTT
CTGAGTGTTTCTTGTTTGTTTTAGCTATTTTATTAGAAAATGATTCTATGAAATCAAAAT
TCTTAAAATAACTATGTTTCTTCATTAAATTAATTAATGTAGTTTTACCAGAACATTGAG
CTCCTGAAATTGCTATTCTAACTGGTCTCATTACAATCCTTTTTGTAGATCTTCAAAATT
ATATTTAATATTATTAATTTCAATTGTATCATTTTCATTCATAATATATGTTTTACCATC
TATTGTGACTTCATAGAATTTACCATCTTGTAGATCTTCAAATTCTGCGTTCTCAGAAAG
TATTTGATATAATTCAGATAATTCGCGATTGGCTGCAAATTTTTGATTAGTGACATCCCA
AGAATTTAATGGTTTACCTTTAAGAACATAGAAGCTCGTATGTTCATTTCCAAGAACTTG
TGATATACCACCATAAGCGGAAAAACCTTCACAAATACAAAGATATTTTTGACTTTTTGT
TGCTCTAAAATATTTTTCAGATTTTAACTTCTTAGATTTTTCTACACTCTTAAGAGCTTT
ATCTGCATTTAAAGCTTCTTTAACTTTATATATGTCTATAATAGGATCTATAATAGATTT
ATTTTTAAGAATTTTATTGATGAATCCATAATCTATGTTAGAGAATTCATTAAATTCTTT
TACTGAGTTTGTAATTTTTTCTTTAGATTGTGAATTAAATTTAAGATTTGGCATTCCATT
AATAAAACAAACAATCATTAATTTATTTTTAATATCGCCAGGTTTAATACTTTTATATTT
TTTGACTAATTTGTCTCTTATACCCTGAACTACGTTATTCATAATAGTATCTATGTGAAC
ACCACCGTCTGGTATTTTTAAACCATTAACAAAACTAAATTGTTAAAGTCATCCAATTC
ATTTGGGATGATACCAATTTTAATATTTTGATTTCATATAGTTCAAAATCTGAACTAAA
CATATTTAATAATTCTTAAAAGATTTAAAATCTATTTCTTAGAATTAAATTTAAAATT
AATTTCTGGGTAACAAATAGCTAAGTTTAATAATCTTTGATAGATTATATTCTTATGAGT
TTCATCGATTTCTTTAAGATTAAATCTTTCTAAATCTGGTTTAAATTCTACTAAAGTTCC
TGATTTTTTAGAAGCTTCTATATTTTCACTATAAGTTTCAGCATTGTTTTAGATTTAAA
AATATATCTATTTTTACCATCGTCTGTAATACCTTTAAAATTAATACTCCAAACATTTGT
ACAATAACTTCCAACTCCGTTGGTACCTATTGTTACACGATTAGCATCATCATCGAAGTT
AGAACCTGCTTTAGCGTGATTCCAAGCTAGTTCTGGCATATAGTGGTCACCTGATTTAT
TACTGGTATACCAGTTCCATCATCTTCAATGCTAACAGTATCATTAGATATTTAACACT
GATATTTAAGCCAGATTTAAATTTAGATCTAATTGCAGCATCTACTGAATTATCGATAAT
CTCATTGATTATTTTAATTAAACCGGGTACATAATTCAAAGTAGTGTATTTAATTTTACC
TGATTCTATAATAAAATCTTCTGTATTTGTAGAATCTATAGCACCTATATACATACTAGG
```

FIG. 15X. Continuation of (CJLB-13-1 [organism=Campylobacter phage CJLB-13] partial genome contig_1)

```
TCTTTTTAGAATATGTTCTCTATCAGTCAGTTTCTTAATCATTATATCTCCTTTATGATA
TTATATTGTAAAATATCTTAAAAGTATCTTAACGTTTTTATTATTCACACTAATACAAAGC
TTCAATACAAATATTTTAATTTGTTTAAACTATCAGAATAACCACTACAATATAATCTAC
GTTTAGTATTTAAACCTTCAATATAATACCCGGTGTGTAAATCCCATTTTAAATACCAAG
TATCTTTTTCATTTTTATGAATTTTAAGCCCTTTGATTTGTGCTATTAAATTATAAAAAA
ATTCTTTCATTTCAATCTCCTTTGAGTAATTATATTATAAAATATCTTAAAACATTCTTA
ATTCAAAACTAAAGTTTTAAATCAAAAATCATAAAATCATAAATAATATTAAAAGAGGGT
CTATGAAGAATCTAAAATGTTTCGTTATAGCTTTGTTAGCTTTGTTTATAATAGGGTGTG
GATCTGATTATTCCAGCGATAAAACAGGCAAAGAAGTTCGTGGAACTTCGGATTCCAGAA
TTAATCAAGTTTGTGTAGACGGTGTTTTATACTTATCGACGGGAAATTATGTAACACCAC
AACAAGATCTTAATGGTAGTTTAATTGGTTGTTCTAAAAAACCAGAAGTTATTATTGATC
AGCTCAAAGAAAAACAAAAAAATAAAGATTTAGCTAAACTTGCTGAAAATATTAAGAATG
ATATTAAGGATGATATTAAGGATGATGTAAAATCTGAAGTTAAGTCAGAAGTCAAGAATG
ACTTAAAATCTGAAATAACTGTTGAAATCAATGAAAGTATTAAGAGTAGATTAGATAAAA
ACCATACAAAGTAACTCACACAAGCACTTAAAGACTAAGATTGTTTTTTAAGTGCTTTAT
TTTGTTCTTCTACTTCATCATTTATTAAACTTATAAAGATTTCTCTTTCAAATGGATATA
AATCATTTAAAATACCATCTATGGTAAACTTACCTAGAAATGATAATCTTGTCAAACTTT
TGTAGAACTCACCTATAGGATTCTCTGAAAATATATTTTATATATTTCTGGGTTTGTTA
AATCAATTTCAAGATCTTTCTTACAATTATAACATTTAACAACTTTAATAAAGTTAAATT
TAGTAGTATTAGCTTCTAAATACATATCTAATTCAGAATCACAATCCACAATATTAGATT
CTAAGTAAGAATCACTGTATATGTCGGTTAAATTTGGGCTATAAACGTCTTTCAAATCTG
GGTATGTATTTGTATCAATACTATGGAGATCTCCAATTTTTCCTAAATCTATGTTAGATT
TAAAAGTACAACCACAATCACACCTAGTATTTAAAGATAATTGGTCAGAAACTGAAGTTG
CTCTTAATCTATAAAGTAAAAATAATTTTTCTTCCGGATATAAATCATAAATGTTTATAT
TAGAATCTATATAAGGTTCTAAGATTCTTAAGTAAATGTCTAAGTTTAAATCATTTAGAT
CTTTACTGCATACAGTATCATCTGAGCTTGCAGTTAATAATAAATCTCTTTCAGTTTTAA
CTTTGTAAGCTGTTAAAGTAAATTTTCTATCGTTGTATTTAATATATTCTTTCATTTAGA
ATCCAAAATTTTAATAATATTCCAAATTACTGAGATTCAAATCCTTATTATCAGTATTAG
AATCTGGCTCTGTACCTAGACCATCTGCAAAAGCTCCAAATGTTAGATACTCAAAACTTT
TTCCTTCGGAACTTTTTAAAGAATCTACAATTTCTTTCATATCTTCAAAGTTCTTAACAT
TTGTAAAAATACCAAAACATAAACAACAAGACATTACTAAATCATCGTGATATCCCACAG
CTGCTTGGTACTTACCATTATCATTTAATGTAAATACCCCAAACTCCTTAATAGTTTCTT
TGTCCACTAATAATAATTTATTAGCTTGTGCTAACGTTGATACAGTTTGTAAAATAACAT
CCCTTGATAATTTTGTAGTTCTGAACCCAGGATATTTAATCTTTGTTTTTGTTTATTGA
CGTCATAATATAAGTTTTCATATTCATAATCTCTTTTGAGAATATCAGCAACCACTTGAC
CAGAGCCTTCATTATTTTCTACAATTATTAAAGCTTGATTGAACCTTAAACCATACTCAT
TGAGTAACTCTGGTAATAACATATAATCTATTTTAAGTTTTGCTGATGCTACTTGTCTGA
AATTTAAATCTGTAGTATCAAATATTTGGACTCCTGTAAAATCAGCACCTTCTTTAGCAG
TATCAACACCCATAACGTATTTATGTCCGGGTATTGGTTCTTCGTATATTAGTATTTTAG
AATCCTTAATATTATCAACTTCTATTGGTTCTTGTGGTTTATAAGTATCTAATATTTCAC
TAGGTATCAATGTCATCGCAGAACCTTCAAATTTGCATTCGTATGCAGAATTCCAAACAA
CTAAACCACCGGTTTTAATTTGTTGTTGCTTGAATTCTTCAGGATCATACTTAGTACCGT
CAGATTTAAACCTTGGTACTAATCTCCAATCTACCCTATGTCTTACAAATCCATTAATAG
AAGTTTCTAAAGTGTCACCAGCACCCTGCCAAATATCGTAAAAATGATTCTTACCTTTAG
GTGTAGATAAAATGACTAATTTTTTGAAAGCTAAGCCGGCTTGTGATGGTAAAACACCGT
CAGTGAAATCTATCCAGCCCGCAGGATCTAAATATGCACATTCATCTACAACGATTATAT
TTGTGGACGTTCCACGGAATGCGTCCGAACTTGGTACGTCCGTTAAAATCTTTATATTAT
TTTCACATTCTATTGAACCTTTATTCCAAGTAACTGTTCCGGGCTGCATCCATATTGGTA
AGCCTATCAACATTTTCTTTGTTTTGTCTAAGAACTCTCGTGCCGAGTTACCACTGTAAG
CAACTATGCCTATGTTGATATCTTTCTTAAAACAGTATAAATGCGCAAGTTTTACACTTG
TTGTAGTTGATTTAGATGAATTATGACTTAAAACACCATTGGTGTAATAAAGGTGATAAT
GCTCTAAAGTTAAATCATAACAATGATCATATTTTATAAATGTTTTAGATATTATTTTAG
AAGGTCCTGATTTTGTTTTAATTACCTTATTTAAACAATCTCTAACATATAATTCGTTAT
CATTTTCGTCTATTAATACGTGTAATTCAGATGCTTGTAACTTGAATCCATTTTCGGTTT
CTATCTCAAAAATATTGTATTTAATAGTTTTATGGACTTCGAGAATTTTGACTTTACCTA
TAGGCGTTTCTACATATTTGTCTTTACATTCATAACTTTCAATAATTTTCAATTTTATCA
CCTTTCAATACATCTATATCGAACGCTTCGGTAGTAAATAATCTGTTATTTCTTATTATA
TTAATTCTATTGCTATCAAATGATTTTAAAATATTTTGTTCTTTTTTAAAGCATTCATAT
ATTAAATCTTCGTATATGTCTATAATTATATATTGCATACCTTTAATAAAAACTTACCA
AATCTACCATCTACAGATCTTTTAGTAATACCTATTTTATAAAATGTAATATTATTATCA
AAAAATTTGACATAATAACATAAGCCCTTAGTATTATGTAGTTCACCACCTGGTTTATAT
TTAGAATCAATATTAGAAGCTTTGGCTCTGTTTATTCTAATCTTTTCTTCTGTAGACTTA
TTATTTAGGGTTGTTAACCATTTTTGAACTGTGTTATTAAACCTTTTAGTACCTTCTTCA
ACGCCATATCTATATATAAACATATTTAAAGACCTTGTGTTACAGCGTTCGTAATACTTT
TGTTTTGCTATATCATTATCCCCATATAATTTGACATAATATTCATAACGCGCATTTTCA
TTTTCGGGGTGTTTTTGTTTCGTTTGGTGAGATTTCACACGTACATCATTAATTTTATTT
```

FIG. 15Y. Continuation of (CJLB-13-1 [organism=Campylobacter phage CJLB-13] partial genome contig_1)

```
TCAATTTCAGTTTCAGTTAATCCCTTATACTTAATAAAATTCTTAGAATTTGCTGAATAC
AAACCTTGGTGATTAAACCCAGGGTTATTAACCTTAAACAACGAGTTATTATAACGGTAA
ATACCTTCAGTCAAACCAAATTGTAATATTAAATATGCAAGCGTACCACTACCATTTATG
TTGTTTAAAAGTCTTATTCTTTTTAATATGTTCGTGACATCACGAGTCATTAAAATTTTT
AATAAATTAATAGGTAAAAATTCGCGATTTATACGTCTTGTGTGGTATATCTCCATTAAG
TTATTTTGTTGATTCCGTGTTAATTTCACACCACTAAGCCCTAGAGATTTTAATATATTT
TCTGGAGTTACTTTAGTGTTTATTTTTGTTTGTAACTTACTTAAATCTTCGTATGGAATT
AAAAATTGATTGTGTATTATGTTTGAGTATAGTACCTGTATAATTTATTATATAAGCGCGT
TCTATTTTACAAACATAGGTGCAATTAAATTTTTTACGATTCACTACCACGCTTACACTC
CTCAAATAATTCAATAATAGTAGTTTCATTACCATTTACATTTATTTTAGTATTTGCTTC
AATGCATTGACGAGGCTGCATTGATATCACGTTTTCGATAGAATCGTCGCTCAGCAATTG
TATAAATTCATCCTGGTATGGCCTAGAATCTACGAAATCAAAACCTTTTGGTGTAGTCAT
TCGCACATAATTCTTAAGAAATAAAGTGGATCATTCGCACATTTTCAAGCTCGCTGAT
ATGTATCGGACTTAAGTTTAATTTTGTGTAAGCTTTTTTAAGACCACGAGACCCATTATA
ACTAATTCTCGTATTATACGCATCTAAGTAATAGTTATCAGAGTCTTTAGGTAAATCTAA
GATTTCTAAGGCTTGTGCTTTTCCTAGTTTTCCTTGAGCTCTAATTGTTTCTAAGAGTTC
GTCTGTTATTTCATTTTTATGTGTTTGAAAATATTTTATTTCTTCTTTGCTTAACATTAT
AAATCTTTTTATGATTTTGTTTTATTATATTATATTATATATTAAAATTAACTGATTATG
GTTGAAATTTGAAGCTGAAGAGCTAATATTTTAGTATTTTAAAATGTTAGCTCTCGAGT
AAAATTTGGATTTAAATGTTTAAGAAATCGAATCTCGATCTGGGTTATATGCATTATTT
GCAGAAAATTGTGAAGCTCTCATATCCCTATATTTTTCAATAGAAGCTAGTCTTGATCTA
ATTTCTGGCATATAGTCGAACTTATCAATTAGAATAGCTCTGAAATCATTACTTGCTTGA
GCCAGCCCTTTATTTTGAATTACATTCTTTACAATATCGTCATACATTTTTTAACTCCTG
TTATAGATTATTTGTTTTTATTTTTGTTCTTAAGTATTTCAATAAACTCTAAGAAATGTT
CTTTAAGAATAGATTCTTTTAGTTTCGAATCTTCAGTATTATCTTTAGAATCGTTTGAAT
CAGAATCTTTCGAATCTTTAGTATCAGCTTTGCTATCGCTGTCAGAATCTTTAGCACTGT
CAGAATCTTTAGATTCTACTAATTTACCATCCACCATTACAAATTCTTTTTGTGATTCAT
ATATAGATGTTCCTTCCATAGTAGCATTATAATCGCTTGGTGCAGATACTAAATCATATG
TAATTAAATCAAATGATTCGACAATACCATTTTTAACTCTGCCAGAACCTCTACTAGATA
CAGACAATTTAATACCATTATCTATTAAGGATTTTAATTGGTTAGCTCTTGGATTATCTA
ACAATGTAGCTTCACCCATAACATACTTGCCGTTGATTTCAAGTTTATTGATGGCAGCAA
CTGCTTCCATAGGATCAACTGTACCTCTTTCAGGATGTTCCCACTCACAAAGTCTATTAA
TAGAACCGCTTTTTATAACGTCTTGGTATTTTTTAACATTACTTTCCCAGAGTTCTTTTG
GGTAAATTCTACCGTTACGGTTTTTTTCACCTATTGTTGAAAAAATACCAGCAATTTTAT
ATTTTTTAACTTTTTCTTTTTTGTCGTTAACTGATTCTTCGATAAGTACATTAGCATCGT
GATATTCATAAAGTAATTTTAACTTATCTGACATTTAAAATCCTTGTTTTTTTGTATTT
ATTTATACACTTGGTTTTGAATCAGAGTTAAATCCAGGATCTACAGGCTCTGGATCTCTA
CTAAAATCAGAATCAATAGTCTCAGAAGTTATATCAAGACAGATTCTCTTAATATCGCT
GTTTCGTTAAAATTGAAATCAATATTGAAGTGGTTAGTATCATCTAAAGATATTGATTCA
CTAAAAGTTGCGGGATCTGGTTTAGATACCAAATTAATAGAATCTTGTATGCTATATTCT
GGATCATTTTTTATTGGTTCGTTATATAAGAATATATTACCTTTATAAGATTCTGCTAAA
TCTAAATCAACTTTAAGTGGTGATTTATAAACTAACCCCCTCATTTTAATCCTTAAGCTT
CAATTTCTTTAATAATAAAATCTACAGTTTTAATTCCAATTTCTTTTATTTTAGTATAGA
GTTCGTTGCAAGCATCTGCTGAACTAGAAACAATGCCAGCACCTCTGGTTTTACCAGGTA
AAATACAACCTTCTGTATCTTGTGGGTAATTTCCAATATGTATTCTGATTAATCTATTGT
TAAAATTAGCATCGTTTGGTCTTTTAACCCAAATTGCTATGGTTGATCGATCTTTATTAT
ACCATTGTGGGTATTTTTTAGCTAATCCAACATTTTTAGAACTAGCACACCATTCTAATT
TATAAGAACCTGCTGTTATACGTTATCAGTTCCTGATTCTTCTGTGCTTGGTCCGGCAT
TTTCACAAGCAGCACCTTTCCAAAGAATTTGACCATTGTCATCATATAATATTAAATCAG
ATAATGTAGATCCTTCGATTTTTCTTTACTTAGTTTTCTAACATTGGTACATTCTTGTA
TTCTTTGTAAGATTAATTTTGCCATTATGATCCTTTTTATGTATTTATTCACTTATTTGG
ATACTAAATATAGTGCTAGATCTAACACTCGAGTGTAGATTTTAAACATTAATAGCTTG
AATTTTTTTGTCTTGACTTGAAGCACTTACCGGTTGAGGTACCAACATAAATTGTGGTAA
AGAACCTTTAGATCTTAATTGCAATTTCCATAATTTACCGCTCTATTTTAATATTCCATTT
GATATCAGCATTACCATCACAGGAGACAACACAGTATTCGATTTTTAAATCTGAAGGCAA
TGTATCAAATACTTCTAAATGATTTCCTGAAACTTTATAAAAATTAGAACTTAATAGAGA
TCTACTTAAACAATTACAAACAACTTCAAATATAATATCATTAAAATATTTTGAACTCAT
AGATATAAATGCTAAACTCGGTGGAAACCCTTCGAAAAAATTAGCAGCTTTAGCATTGCT
GGCAATTTCATCATAAATGTCAGCTAAGTTAATGTTATTAGTTCTAACTCTAATGATATC
TGAATTTTTATGCTTCTTTAATTCAACCATACATTCTTTAAAAAAATTAAAAAAATTATT
ATCGAATGATTTATATTTAATACTTTTAAAATTTGGTAAACCATAATTACCTGATAAATT
ATTCAAAGCATAGGAACCACCTAAAGCTTCTTTAGCAGATTTCTTAAGACTTATAGGTAT
TATATTATCAAAATCATTAATTTCTTTGTTAAGTTCTTGATAAGTTTTGTATGATTTGAT
TTTATATGTAGGTTTAACCAAAAGAAATCTCCAGGATTCCATTTATCCTCTGCTAATTT
AGTTAATTGTTTACCTTGCTTTTTAAGATCATTAAAAACATCAGTTTTGTGGTGAAATTC
ATAATTTCTAAGGTTTTGTTTTAAAATAATTTCATTTAGAATACATTTAGATGCATCTTT
```

FIG. 15Z. Continuation of (CJLB-13-1 [organism=Campylobacter phage CJLB-13] partial genome contig_1)

```
ACAAGCTTTATCCCAATCTGGATTTTCAAATAAAAATGTTTTAACAGAATCTAATGGCGT
CTTAGTCCTAGTATTTTTAACTTGAGTTTCATTATAGAATTTAATATCGGTTAATTTAGT
ATTTAAAAACATATCTAAATAGTATACAACGCCACACTCTGCTAAGTCGTCTTTGTTGTC
ACTTTTTTGACCTTTTAATGTGATACCAGATACATTAGATTTTATGAATTTTACTAAAAGG
TGCTTCACCTTTCTTTCCATTAATAGAACCTTTAAAGTTTTTATATTTTTAGTATCTTT
GTCATATATCAAAAGTTCTACAGCATCGACATTCATACTTTTAATTAATTCAAATAATCT
AATATTTGTAGGATCTTTTAAATCAAAACTAAAAACACCAAGATCACCTTCTAATAAAAA
ATCATTTGTTTCTAATTTCTTAAGAAAAGGTTTAAAATATTTTGGTTTCTTAATAAATTC
ATTTACACTTAAAGGCATTTGATTTGTCCTATCTGAAATACTTTGTTTTCAATATTTAAT
CCTGTTTTGAATCTCGAATTCTTTTAATAACATCTGCTGTTGAAATAACTTCAAAATCTT
CTTTAACTTCTGTACTTGGATGCAATGCATTAATTTTATTAATATTAATTAAAATATCAG
ATATCCCTTTATAAGAATCCGTTAGAATTTTTAAAGACTTGTTTGAAGTTTCAATTAGTT
TACTATAAGCAGTTACTAAGTCTGGGTTATATCCTTCAATTTCCATTTCTTGAACTAGGT
TGTCACTCATAACTTTTAATTGTGCTACATTAGCTAAAATAATTTGTCTTAATTTATTAT
AATCGTCTACTACTAAATCCAATTGAATTATTTCATCTGGATTTAATTGAGCTTTATTAA
TTTTAGCTTTCTCAGAATCGAACTCAACGATTTCTGCTTCTATTACTTGTTCCATTAGAA
CCCTTTATGATTTTATAACAGCTTCTTTTAATTTAATAGATTCAAAATAATCGATCAATT
CGAAATTATCGAAATTAAAGGTAAGATCAAAAGTTTGTTCAGCATCATCAGCATTCGATA
TTAGTTGTAAAGCACCTAAGTTTGTGATTTTACAACCATACATAGTCATACTGACTAACG
ATTCTCCTTTATTGTCGGTTATTTCCACACCACAAGTAAATTCTTTTAATGGTTCGATAT
TACCATTATTTGGGTGAACTCTATCGAAAATATATTTGATTAATTTTGTATATATTTTGA
AATCTTCTCCCACAAGGAAACCTACAGTTACTGGGTCATAGTCTATGTGGTCACCACCAA
CATAAATAGTTTTACCGCCGAAGTTGGCTTGACTTGGGTTCAGACTAAACCCCGGTAATG
CTATATTTTGAGCATATATCCATTCATCGCCTAGAAAAGGTAAAAATATTTTATAATTAC
TAGATTGCGAATAGCTATTACTAGTCATATATTTCCTTGCTTGTTATATTATATTCAAGT
ATTTATTTTTTATACTTACGGTATTATATTAAAATATAACTGAATTTTAACTGAAATGTA
GTCATTGTTATATACTATTAAAAAGCCAAGCATTTTTTATACTTTTTAATATTGCTTTAA
GTTTTAAGCATATGCTAGGATATATAGCATTGTTATATACTATTAAAAACCCAAGCATTT
TTTATACTTTTTAATATTAGTTTAAGCTTTGCTTTAAGTTTTAAGCATATGCTAGGATAT
ATAGCATTGTTATATACTATTAAAAACCCAAGCATTTTTTATACTTTTTAATATTAGTTT
AAGCTTTGCTTTAAGTTTTGTTTTGAATTTTAATGTGGGATTCCAAGTCCTTGAAATTTT
TTTAAAAAAATTTTTACTCTTTAATATGATATATTATAATATAAAGCTTTTAAAAAAG
TTTTTTCGAGTTTTTAAAACCAAAATTTTTAGTTTAGATTTAAAACTTAAAACAATATTA
AAAAGTATAAAAAATGCTAAGGTTTTTAGTAGTATATACTATAGTATTATATCCTAGTAT
ATGCTTAAAACTTAAAGCAAAGCTTAAACTAATATTAAAAAGTATAAAAAATGCTTAAGT TTTTAGTA
```

>CJLB-13-3 [organism=Campylobacter phage CJLB-13] partial genome contig_3
```
AATGCTTAAAACTTAAAGCAATATTAAAAAGTATAAAAAATGCTTCAAGTTTTTAATCTC
TTAAAAATACCAGCATTTGAAATCTTAAAATCTAAACAATTATTACAAAGAATCTTATAA
TTATCAGAAACAGTGATAACATCGGTATAACTGTGTGTAGCACAAGAACTGCCACAATTT
TCACATATACTAGTTAACAATCTAATATCACTACAAATGGCATAATTCTATTGACATTT
CTAAAGACTTCTACATTATAAGGTTCATTGATATTATTAGTACCACTTTGTAAAGCACAT
AAAACAAATGTTTTATTAGATTCTAATATATTATTAAATTTCAGGTTCAAAAAATTGA
AATTCATCTAATAATATATAATCATATTTAGATTCACTGAAGTTTTCATTGCTATAGTAT
TGTATATTTAAGTCTAAACTAGGTCTAAAACTTCTTGATATAAAATCCCTTGTGTCAGTT
TTGGGTCTATATAAAACATAAGGTTTGTCACTAAAATGAAGTTTCTCTGCTTGTCTTAAC
AATTCAAGTGATTTCCCAGATCTCATAGGTCCTATAATTAATGAAATATCCATTACACTC
CTTTTAAAATGTTAAAAAAATAAAACTATAGTTTAAAATCTAAAGTTTAAGGTCAAAAA
CTATAAACTAAAAATTAAAGAATGATTTCTAAATGTATTAACATCTTTTATTTTAGAAC
CTTGAATAGGTTTAAATTCACAACCTGCTTTAAGAACTTGAGGCTCAATACCATCACAGA
TATAAAAATACTTACAAGTTCTACAAGCATCACATTTCCTATAACTTTTTTGTCTATTAG
ATGCAGCTTGTTTTGCTAAATTTACTAAATTAGGTTCTAAGTATTCATACATAGCAATAT
TCCAATCGTAAATATCATAGATGTGCTGATAATATCCTACAACGTATTCTCATACCCAG
TCATATAACAAAACGGGACATATCGGACATTGATCAAAGGTATACTTGATGAATCTACAA
ATCTTTTTATAGGTTCTAAAATCTCAGAATAATTAACACCTTTTGATTTTGAATTCTGAC
TAAAATAATTCAATGGTAGAAAATTCATTTCAAGTGGTTCTAATTTTTCAACAACTTCGA
AATATTCAGTATCAACTAATTTATAATTTACATCAACTAATAGTTGAATTTAATCTAACAA
CAATATCAAGATCCTTTGCATTATGAATAGCTTTAATTATATAATTATAAGAATTTTTA
TCCCAGTTATTTTATCGTGAGTTTCATTAACACTATGTAATGAAAATAATATTTCAGATA
ACCCAAGATCTTTTGCTTTTTTAAGAAAATCTTTATTCTGAAATTTAGATCCATTTGTCA
AACAAGATATTTTATTATCTGGATTCAAAGATTTAATATATTCTAGGATTTTAAAGAAAT
CTGGGTGTATGGAAGATTCGCCTCCACTTAAATCAAAATCTCTACAACCTATACTATACA
AAGTATCTATTCTTTTTTAATGACTTCAAATGGTGTCTTTTATCTAACTCATTTTGGT
AATAGCAAAATAACAACGATAGTTGCAGTATGTGCCAGTGTCTAGTTTGCTCTAGGAC
ATATAGTGTCATTAGGTAAGTAAGCGCCTGCTGAACTTAGAGTTTGGATAACATCACTAT
```

FIG. 15AA. Continuation of (CJLB-13-1 [organism=Campylobacter phage CJLB-13] partial genome contig_1)

```
GCATCACGAACCTTGGTAAGGTCTTTTATTAAAGACCAGAGATAAGATTATGTTTAAGTA
AGTAATCTGCTAATGGCTTCAGGTCACCTGGATTTTGAATATCAACTGTACAAGGCACAA
ATTTATTAGCATCATTCCAACGAACTAAACAATCATACACAGATTTTCCTTGGAAAACTC
TTGTAACTTTTTTAACTTCAGAAACTTTATTCATTTAATATCCTTTTATTTTAAGCTTTT
AAGTCTTAGGCTCGAATGGTATCAAAGCACCAATAACTTCTGGATTTCTGTCTATACAAC
AATTAATTCTTTCAATACCATCTTTAGAATCCACTATCCAATTATTGTGAGTATGGCCGT
GATATATTTTTTAATACCAGTTAAATCATATGATTTTAAAAACTCTGGAGCTTCTTTAG
GTATTACTGATTTTGAATCTAACGGATAATGACAAAACAAAGTATCTTTATATCTAATGA
TATCAGAAACTGCACTAAATCCAATATATAAAATACTTTCAGTATCTAACCACTTGTCGT
GGTTACCTCTTACAAAAATTTTTTTGCTTGGTAATGAACTAATAAAGTGTCTTAAGAATT
CTATATTTTTATTAGGACCACAATCTAAATCTCCTAAAAACATTAAAATATCAGAATCTT
TTAAAACAGATTTAAAATACTTATGAACTTCTTTTGAATATTCTAAAGCATCATCAATAT
ACCTACCAGTATATTTATAATATTTTGATGAGATATATGTAAATCACTTGTAATATAAA
TCATTATCACCTTTTAGTTTATTTATGAATCTGTGATTTTATGCATTTAAGATTTTATAT
ATTTTTAATACTGTATGTGATTTTCGAGTATGTGATTCATTCGAAGTATTCGCACACTCA
ATGCAATTCAAACAATCTATAGAAGCTCGACACCTCTTGCAATCCACACATTCGTGACAA
TCCAAACAATAAACGCATTTATGGCATTTAAAGCAACCTTGGCATTTATAACAATCAATA
CAATCAATACAAGATTTACAATCAATACAATCTTTAGAAACGCGGCATTTATAACAATCA
ATACAATCAATACATTTATAACAATCAATACAATTGAAACAATTTAAACAATCTTTACAA
ACTACTAAAGACTCAGAAGCTTCTTTCGCTTGTTCTTCAGTATACATAGAAGAATCCCAT
TTATTGTTATTAGAATCTGTGTAATAGCCATCTATTAATTGCATTTCAACTCCTTTATTT
GATTTTTAATTATAATATATTTGGACTAATTTTAAACTTAAACTAAAGCTCGGAATCTT
TCGAATCCTGTATTTTAATATTCATTAATTTCAAAATATCACCACCTATTTTCTTAATT
CAATAGGTATCTTACTGAAATTAAAACTTAATAAAACATCAAAAGATTTTTTATAGTCAC
ATAAAGTCATATTGTTAAAAACGTCTACTTTTAGACAAGCTTTACCAATATGGCTTAATT
CTTGATAATCTTTGCCAGGTGGTACGTGAAAATGATATAAAAGATTTTTAACAGTTCCCC
TCTTATATTCAACATCTCTGTCTTTAGAATCATCAGTATGCTCCTTAGGCTTTTTTCTA
CAGTAGTTTTTAATAAATCATAATTAATACAAGCATTATATTTTTGTTCATAACATAGT
AAATTATCTTTTTGGAAAATCTTGCTCTGCCTAACATTTGTAAAGAACTAATAACGTCTG
TAGAACTTGCACTATCATAATGAAAATGTATATCAACATCATTCAGAATGTTAACTCCTA
CAGTTAACACTGGAGTGTAAATAAAGACATCACAATCTAGCGCTTCTTTAGACCTAATTT
TATCATATATAATATTTTTTGATACTGAGCCGGTTTCTTTATTAAAAATAATTATTTTTT
TATTTAGTATATAACACATTTGTTTAATAATATCAACAACTTTTATACTAGTTGTAGAAA
TAGTTATTTTTTTATTAGAATCTAAAGCATTTTTAATTAATGTATAAAAGGTATTGCTGT
CATTGCAACTATAAAGTTCTGTATTATTTTTTGTATAGCTAACAACATTTAAAGGTTTAG
TAAACATATTGTCCACAATGTATTTACTTAAAAATGCATCAGCTACAACAACTTTTTTAT
TTAAAGCAGTATAGAATTTTATTAAGTTCTCTGTTTTACTATTCAATGCAGATCTTGTAT
GCATTAATAAACTCATAAACTCATCGAGTATAATTAGGTCGTAGTCATCTAAATCAAAAT
GTCTAAAACTGTCGTATTGACAAATTAAGGATTTACCTTTTGATCTAACTATTTTTGGTT
TTTTGGTTTTTGTGACAAAACTAGTATTAGCATTATTTAAATTACTAACGTTGTCAACAT
TACTATAACTTTCAATAAGTCTGATAGCTTCTTCACCACTTATGTTGTTAGAATTCTTAG
AATCCTTGGCTTTAATAGCATCAGTATAATCTTTATAATATAAAAACTTCTTATATTTTC
TTTTGTAATCTTCTGCTAACGTAACTCTATTAGTTATAATTGCAACCTTAAAATCTCTCT
CTAGTGCTGCTTCTATAATTCTATCTATAAAAGTTGTTTTACCCGAACCCATAGGAGCTC
TCAAAGTCAGAGCACCATTATGCTTAAACAAAAAGCTTCTACAATTGAATCTAATTCAG
ACTTAATTTCTGTAAAGTTTCTATCAACTACAATATCTGCTTTATAATCTATATAAGGAG
TTATATCAAAAGTAGGTTCATATTTTATAGCTTCTTTCCAAATATTTACTGACATATAAC
TTTCAGTATGATTCATAATATATGGATTATTTGGGTACCAAATATAATTTTCAGAATCTT
TTGTGTATTTTATAGAACCATTAGCATTGATATCTACTAAGATAAAACCCAGGTTCTTAA
AAATTGTTTTGCATATTTCAGTAGTTTCTTTAGAGGTAATATTAAATTTACAATCTAAAT
CTATGTTATTATATGTAATCTGTAACATTCGTACCTATAGGCATTAACATAGAACCGTTTG
GGTTATCCAAGAGTATATTATCTTTATTCAAAGGCGCTGTATAATAAGTTATTCTTAATG
TATCAGTAGTATATTTACCATACTCAGAAAGTTCTTTTTGAATTTTAGCTTGCAAAACTT
TTAGTTCTTTTAAGCTCATTGGAGCTGTTTAATAATACCTTTTAAATTAAAATTATTAA
CACCATCATAAGATCTGGATTGACCGATAGTGCATTGTGTGCTCTTAAAATAGTCTAATG
CCATATTTTTATTAAACTCTGATTTGCATTCAAAATCAAATAATAAATGATCAAATGTTT
TAATTATATGAGGTTCTAAATCTGTTTTAATCTTCTGGATTTGCCAGGTCCTTTTAAGT
CTAAGGCAATATTTAAACAAAAATTATTAACAAGTAGTTGAAATGCTTGGTAAGTCGTTT
GGACTTCAATTGTTTCAAAAATAAAGAATTGTCATCGTATGGCGACTTAGCAAACTTTT
CATTTTTACTTGCAGTTCCAAAGATTGTTATTTTCATATTTTATTACCTTAGGTGTTATA
TATGATTATAATATAGCTGAACTAAAAAGATTCTTAAAGCCTAAAGATCTTAGCTAAGAT
CTTTAGACTCAATTTCATTATTAGTAGTGGTTTTAGTAGTTTTAGTAGTTTTAGTAGTGC
TGGCTTTCTTAGCATCTTTTTTAGCTTGTTCTAACTCAATTTCAGCCCTTTGTAAATCAA
TAGAATCAAGGTCACCTTCTTTAATAATATATTCAAGAAACTCTATTCTATAATCTAAAT
TATCTATGTACTCACAATAAGCATCTGCTTTCATACTTAAACCAAAAACATTAATATGAG
TAGCAATACCACGTTTACACATTTCATAAGCATCGAACCAAAACTCAACACCATCTATTA
```

FIG. 15AB. Continuation of (CJLB-13-1 [organism=Campylobacter phage CJLB-13] partial genome contig_1)

```
ATAATTCAATTTCTTTCTTGGTAAGATATGGATTTAATAATGACTTCATATATTCATTCC
AATACTTATTAGAAAAATCAAATTGCGTTTTAACATCCGAATGTTTACCAGAAACTCCAA
AACTTACTGAATGGAACATAATACTTGAGTTCTCATAAATTACACGTGAATTACCAATTA
AGAACATCATAGCACCACAAGAATATCCAAATGGGTTTAATACTGTTGTTACATTACCAT
AGAACTTTGTTCTAATTATATTTGTAAATCTATTAAGTTCATTAGCAAAACCACCCACAC
TGGCTATAAAGATTTGTATAGAATCACCTTCATTAGCGTCATTAAGATCAGCAAAAATAT
TTTCTAATTCACCTTCTTCGTGATCAAATGAATTGATATTTAAAGTATAATTAGTATAAT
TAAAACTTTTTTTGTATAATGAATGCCTCGTATCTTTTGTAGATATAATATCCAATTCAG
AATCCTCAATTTTTGTTTATTGTTTATAGCTTCGTATCTCATTTAACTCCTCTTAAGC
TTTAGTTAATATGTTCTTAATAGAATCTAAAGATTCGACATAATTTTTAAATGTATCCAG
ATTTTTTAATGTTTCAAATTTAGCTTTGATTTCTTTAGCATTTTGTACTAATTTTTCAAA
AGTTTCGTTTGTAAACGAATGTATTGGTAACTTAAGCAAATAATCATAACTATTCTCAAA
CTTAATAAACTCTTTACTTTCAAGATCCAATTCAATATCCTTTTTAGATCTTTTCATAAT
TTGTAACTCTGAATCAATGATTAATTTAACAAATCTTAATTTTTGAATATTAATATTTAA
ATCATTTTCAAGAACTTTTAAATCAAAATCTTTTTGTTTAACCAAAAATCTTTTTCTAAC
GTCTATGTAATAATCAATTATAGATTCAATATTTTCAAAAGTTCTGACTTGATTATTTTC
ATCCAAAGCATTATATATTTCTGTTTCTCTTTTAGATAATTTTAATATATCGATAGCTTT
CTCTTTAGAGATATTATCGAAAAATATAACTTCGAATTTAAATTCTTGGTTTCTTTGGTC
TGACAAGTCTTTATAATTTTTAATCTTTTTAGTCTCTACAAGATTATCTAATATTTCGAG
ATATTTTGTATACTCGATAAATGGTGGTATTTCTGTTATAATTGCTTTATTTTTATTGAC
TTCGACAACACCTATAAAGTTCCATTGTGTATTATTAGAACTGGTATCTTCTACTAATTC
AACAGCCCCTTTAAAACCTGCAATATACGGCTTTAAATCAACTTTATTACCTGTCTTAAT
ATATTTATTACTGAATCCAAAGATCTTGGTAAAATATTCTGTTTAAAACCACTAGCAAG
ACCATTCATTGAACCATTTAAAACTAGTATAGGCAAACTTGGAACGTAAAATACTGGTTC
TATTTCTGAACCTTCAAAATTCTGAGAAATCAAGACATCTTTAATATCAAATAAATCATT
AATATATTTTTATTTTTAACATAAACATATCTTGGTGCTGCTGGCTCATTAATAAACCT
CGAACCAAAATTACCTTTACCTTCAAGCAATGGAATATTATTAGAACCAGTATAGCTTGC
AGCCATATTTTGAATAACACCTGAACACGAACCGTGCAAGTATTGTGTATAACTTTGAAC
CATATTATCAAATACTAACTTTAGTTTCTGTATTTAATTTTTTGTCTAATGCTGTGTT
AATGATTTTTCTGCTTGAATTTTTTAAACCATCAATAGAACTAGCTATCATTCTTAAAGT
ACTATAACAAGAATAATTAGTTAATTCATTTAGAAAATAATCTTGAACACTTTTGTGAAC
CATATATCTCCTTTTAAACTTTAGTGTATTATAATATAAAATATCTTAAAATATCTTAAA
ATATCTTAAAATATTATTAAACTTTTAGATTGATGAATTAATAATTGAACAAATTCTTCC
TAATAAATTAGAATCATTATTAATTCTTTCTTGGATTCTATTTTCATCTTTAATAATATA
ACCTTCTTTTTTAGCGTCTTTGGCTGCTTGTTTAACTGCTTTAATAACTAACCTAGTCTG
AACACCTTTTGCTTGATATTCTAATGTATTAAGTTTAAAACGACGTTTAAGATCTTTTAA
TTCTTCTTCATAACTTAATATAATATCAATATATTCAGTTTCTAATTTATAAACATTATT
TTCAGAATCGTCAACATCTGGTACCCTTTTGATAGTTCCCTTGATATCTGGGACTTCGTA
ACCACTTGGTTTTGATTCTTGTGTTTGATTTGTATGTTCACTAGGTGCTTCTGGTATTAA
ACTTGGCGCTTCTTCTAAATGCATTGTATCCACTAAATCAGGAACTTCAATATCTGATTC
ATTTTTAATATTTCTGAGATCTATATATTCCTTAAAAGCTTCTGAATCTGAGCTAGCTAC
CATATTTTCGTTATTATTGCTGGTATTACTAACACCTGATTCGATGCTGTTAAGAACATC
ACCAAAATCATTTAAATCTGCGTTTTGCTCGTTTACTCCATTAACTTCTATGTTGCTTGC
AGGTTTAACAACTAATGGTTCTTGATATTCTATTTCAGGTTTCTTAACAGGTTCTATTGA
CAAGCTTGCTAACAAATCATCAAATTCATCTCTCATTTTTACCTCCTTATTTTGAAATAT
TTGTAATAGCTTCTAAGATTTGTTCATAAGTAGAATCTAAATCTTCAGGTTTGGTTCTAA
TATACATATATTCGGGTGCAAATGCAAAAGATTCGACATTGTGTCTTAATACACTATGAC
TAAAACCAATTACCACTTTTGGGTAATTTGCGTAATCTTTTTAATAAAGCTTACAAAAT
CTGTGTTAATATATATTAATCTATCAATACCACGAACTGCTATGAATTTTTCTTTGAAGT
ATTTAGAATTTTGATAGTTTATATTACTATTATCTACATAATAATAACCACTCATTGCTC
CTTTTTTATCTGTGAAAGTATAACACATATTGAAAACTTGTTTGTCTTTCAAAACATTAA
TATTACAAACTGCTGATAATTTAACAGTTGTATTTTCGTTAACTTGTATTAACATTGTAT
CTCCTTTTAAAATTAATTCTAAGTTTAAACCTAAAGTACATATTTAACACTATAGCAGCA
AGTTTAGATCTAAGTTTAAAATTAATCTAAGCCGTAAAAAAGGTTTGAGCTGCTAGGAAG
CTCTTAGGTCTACAATACCCTTATTGTATTTACCGTCACCGTGACTATCAATCCCCTTTT
AAACAGCTATGTAGAATTATAATATATTTGAACTTAATTCTTGCTGAAATTTTAGAACTT
TAGTTTAAAATTAAAATATAATATTTTATAATAGTTTAGTTGGTATATATTGTAAGTAA
ATCTTTTTATTTCATAACCTTCAGGTTCATAAGATTTTGTTATTCTAGCATTTATTTGTT
TCTTAAAAAAACCATTGTGATCAGCAATATCATATATATTAACAATATCTTTAGAATCGT
GAAGTCTTAATAATCTACCAATACTTTGAGTTATTGTGACATAACTTTTGAGTGGACTAG
CAAGCACTAAATTATGTAAATTCTTAATATTTACTCCGGTTGAAGTTGTCGCATAATTAG
CAACTACGATAGCATTGTTTACTGAATCTATTAATTGTCTAATAGTTTCCCTTTGCGAAC
CTTCTATCATTCCGTTAATAAAAATACATTATTTCTTTGTTGAAACGCCAAATCTTTAT
AAGTCTTTTATCGTAGTTTAATCCTCTGGATTTCAAGAACTTATAAAATAAGGTTAGAC
CGTGTTCAGTATGAGAAAATAATACTAAAGTGTTACCTTTGCTGACTACAGTATCGCCTA
TTCTTTGAATTAAATTATTTCTTGGATCGTATTCTTTTAATTGTTTCAATTGGCTTGAAT
```

FIG. 15AC. Continuation of (CJLB-13-1 [organism=Campylobacter phage CJLB-13] partial genome contig_1)

```
ATTCACCTTCAAAATTAAATTTATATTTAAGATCTATTATATTAATAATAGCATTTGTAG
CCAGACCTCTATCTATTAAACCTCTGGGTGTAATATATGTTCTTGGTAAACCAAAAATAC
TTATTAATCTCATAGCATCTATTTCATTATCTGGAATAGTCCCTGTCAAACCTATCTTAT
ACTTAGCATTAATACACTTATTACAAATATCAAATATTTGATCTGCTTTGGCTGTATGTG
CTTCATCTACAATAATAAATCTAAATCATTTAAGGCTTCTTTAAAGTTTTTAACAGATT
GCCAAGTACTAATTGTTAATGGTTTATCAAAAGATTTAATATTATTTTCACCACCTATTA
ATCTTGTTTCTATATCCAATTTATAATTTATTAAATCATTATTAAATTGATTTGTTAGTG
AAATGTTGGGAACGAGTATCAAACCTTTTAATTTTTTTAATATTAGAATCTTAGCAATTA
ATCCAATAATGACGCTTTTACCAGCACCTGTGGCTGCTCTAATGAATAACTTATGAAATT
GCATAGCATCTTTTATAGCTTGTTTTTGATAATCATAAACTGGAAATGGTTCTAAATGTT
TTATAATTATTTCCAATTGCGAATCTAATTTTTCATTAATTTCTGGTTTAGTTGTTATAC
CCAGGTATTCTAAAACACCGTTTGGTACAATTTGTTGGTTGTTGAAATCTTTATAGAAGT
ATTCATAAGCTAATTTTGGATTCATTTGAGCCCATATATTATAACGAATATCTTCTTAA
ATATTAATTTAGCTTTTTGGTCATCAGTTAAAGATATTAAACTAAATGATTCGTTTAATT
TTTTAAAATTATTTTTTAACATTTAGGTTTACCTTTAAAATCTGGACATAATCCTGCATA
AGGACACCAAGGACATAATTTATTTGGTTTGCTATTCCAAGTATTAGATTCAATAGAATT
TTCAATAGATTTTATTTGATTATTAAGATTATCTTGCCAATAAATTGCAGAATCTTGAGA
CAAACTTAAAGTATTTTCTAAAAGATGTTCAACATAAACATATCTTATTTTTATTTCATT
TAGTTTAAGTCTTTTAAATATATATAAACTATATAAAATTAATTGTGTAAAATCTTGATA
AGATGGTTCTTTATATTTACCTGTTTTATAATCTATAAGCTCTAATCCATTTTCAGTCGT
ATTAATTCTATCAATATAGCCTACAAAAATAGCAGTATCTTTGCTACAAGGTTCATAATT
AGAATCTAAGAATAATTCATATTCTCTTAAAGATTTTCTGGATAGTATTTCTTTTCCTAA
TTCAGAATCAATAAATCTTAATGTAATATTTTGTATTTCTGGATCTTTTGAATTAAGAAC
TTCATTGTATTTTTCAGTGTTATGAAACTCAAGTATTTCGTGTATATCAGAACCTTTTTT
TAATGCTGGGTTCTTTTGAGTTTCTGGAACCTTTTCAATATATCTATAATAATATTGTTT
TGGGCATTTTTTATATGTATCTATTTTCGAAAAACTATATATTGTCATTTAGAACCTTTG
TTTACATTTTACTAGTTATATAATAAACACCTTTAATATAAGGCTTGTGAGAATCCCATT
CAAACAAGCAATTATCAGATTTAATTAGAACTTTAATTTTAGATTCTTTATGTAGATCTT
TCAGAACTTGTATCAAGAAATCGGCATCAACACCTTCATCTACGAACATTTTATGAAGAA
TTTCTTCTTCTATATTAGTTACTTTTAAGATTTTTAGAACTTGTTTTTTAATAAAGCTTT
TTGAATCCATTTTTACTCCTTTAAATAATCAAAAACAAATGAAGTAATTCTTTGAAACTT
GAATTGAATTTAAGCTAGCAACCTTCCTTGATTCTAATTCAGTAGCTTTTAATAATTTTA
AAATACTAGGGTCAAATGCAAAAAAATCTTTTTGAATTACACGATTTCTATGTGTTTTAA
AAATATAACTTGTTTTATGACCTATATTATATTTTTCACAATAAGCAACATTAATTTTAA
AATTTTTAATCATATAATTCAATGGTAATTTATTACTCCAATCTATTCTGGGTTCATTAA
AAATAATTTTCATATTCTTAGTTAAATTAGGAAAGTCTCTGTGAACAAACACACAATTAC
CTATTCTTACTAAATGTTTATTAGTAACAGACTCTGGAAATTTTACATACCATTTTGAAA
TATTAGTCATACTTATATTTAATTTATCCGCTATTTCTGCAGTTAACATATAATCTTTGG
TTACGAAGTTCATTTTAACCCCAAATAAAATAAGCTGGGTATGCTATCATCATTACTACG
GCTACAACTGTGTAAACTAAGTCAAATGTAAATCTATTATCACCTAATTTTGATTTAAAG
TTTTTCATTTAATCTCCTTTATCTTTTGATGAAATAATTATAATATAAAATAACTTAAAA
GTTTCTTAAATAATCTAAATACTAAATATCGAAGTTAATTAAGATAATAAATAACTTAAA
AATACATAGAGGCCAAAATGTATAAACTATTATTAGAAAATTCTCTTAAGGAGACTACAA
ACTTAATTAGCGAAGGTATAGATGCAGATTTTTACCAAGTTATGTTAGGTGATATCTTAA
AAGATAAAATCAAATCGTTTATAGGTCATCACATTGCTGAAGTTCAACCTATGATGCAAC
CATCTGGATATGTTTCGCAAGACAAGAAACTCAAGATACATTTAAAATTATTAAAAAAC
AAATTGATGTTGATACTAATAAATCTATTATCAAATATCACAGGAAGCTTGGGAAGATT
TATTAAATTTAAGTAATCTTAATAAAGCCGGAAATGAACAAACACCAGAATTATTCATTA
ACTGGGTCAAGTCTTCTGCAGCACACAAAGAAACTGAAAAAATTATAAATCTTATTAAAG
AAAATGCAGTTGAATCAGAAGGTATTACGTTAGATGATAACAACGATTCTAAACAAAATG
CCGAAACAAACTTATTTCATATATCTAAAAAGGTAAATGATTTAGTTATTAAAATGAATT
CACCTAATTTTAGAACATACGATAGTTTTTGTATACTTCCACAAACTGGTGTAGGTGGTA
TATTATCATTAAGTTTTACTTATTCAAGAATAGATGACTCAACAGATGAAAATAGAGCGA
ATGATTATTTCTTAGGTAAGATTAATAATACAAGATATTATTTAAATCCAAATCCTGATG
ATAATAATGCTTATGTGGGTTTAAAATCTCATAAAGAAAAGGGTGTTAATTCGTTGATTT
ATAGCCCATATTGTATGAACTTAACAACTGCTTATAATTATAAATCAGGTGAAAGAACTG
TAGGTATATTTACAAGAAATGCATATACAATCACACCCTTTACATTCTGCAACTACTCCGA
TGTTATATAAGTTTGCAATTACGGAAGCTTAAGAGATTCTTAAGCTTCTAAGTTTTACAC
TATAGTGTTAACACATAACACTTTATAGTTTCAAGTTTTGCATTGTAGCTGAAACGTTAG
CTTCTCTTTCTATATCCGGGATTACAACTTTATCAATAGGTTCTGTGTTTGATGCTTTTA
CTGGTTTAGAACCAAAATTAATATCTAAACAGGTTCAGTTTCAGTCATATCAGCTGAAT
CATTTTCAACTTCTTTAATAGGTTTAGAAATCTTAGATTTTTAACTTTTGTTTCTGGTT
CTATCGTACAAGCACCAGAATCATCAAATTCTAAAACTACTCTCTTAACATTTAATGGAA
AATCTTTTATTTCAATAATCATCTTAAATCCTATATTTAGTTTAAAATTAATTTAATATT
AATTTAATGGTTGTGTTGCATCTATAACCGAGTTTTCTTCTTTCATTATTTCTAAGGAAA
CGTCAACTTCTTTTATACAATTTTTTATCATATTGGCTCTTTGAATTTCATAACCTATAG
```

FIG. 15AD. Continuation of (CJLB-13-1 [organism=Campylobacter phage CJLB-13] partial genome contig_1)

```
TTGATCCACGATCTTCGAAATACCATTTAGTCATAAAAAATGTAAAAGCTATACCTGAAA
AAAATCCTAATAAAAATAACGTTATTGTGTATTTAATGAAACCTGAAGTTGCAGATTTAA
TTATTTCCATTTTAAGCTCCTTTGACTATAATTAATTATAAACTTTTATTAATAAAATCT
AAATATTCATTAGAACTTTTGATAAAATCTTTAAATAAATCAAAGTTTTTTGTTAAAAAA
TTCTTAAGTTTAATCTTAGTCATAAAACGATCATTAAAACGATTTAAATCATTTCTAAAA
GTGAAAGCTCTTTTTCCAAAACAATCCCAAGCGTAATAGTTTTCATAGAAAATATTACGA
TCTCGCAAATCAAATCTAATTTTGATTCTGGTTTCATTATCCTCAATAAGTTCTATTGCC
AAACCATTAGGTACACCATTTCTAAAAAATTCTATTTTATTGTGAGATATTGAGATGCCA
TCTGAAGCATCTTCATCTACTTCAATTACACCATATTCACAAGTAGCTATTTTAGTAGGA
TAATAAGCACTTTCTATTATCGAGTGTCTTTAAAAACTACAAATTGAGTTCTATAGTCT
ACTTTTAAGTCAAAATGTGGATTATTTTTTAACATTTTAGATATTAAATCATTGTTAAAA
TCTTTTATTTCTTGTATTTTTGTGTTTTTAATCATTTTATCTCCTTTTTTATTTCTGTTA
TTATATAATAATAATCTTAAAATAAGATTAAAATTTATACATCATTGCTTATGAATTTGGT
TTTTTACAAGAAAAATATTTTAATGTCTAAATCTAATTTTTTATTTTCTTCTAAAAAT
TAGTTTCACTTAATATTTCTATCTTAATATTTTCTGATTTTCAATACCCTCGTTTATAA
TAGATTCAACATATTCTCTTTCTTTCTTATTTCTTCTAATTTTTCATCCGTATATTCAT
TTTCTTTTTCCTTCAAAACTTTTTCAAAAATTTCTTGTATTTTTGATTTTTAATCATTTT
ACCTCTATTATATAATAATCTTAAATAACTGATTTTAAGCTTATTTAAAACAAGTTTATT
TTACGATTTTATATTATTTATTCGTTTTAAACATTTTTTAAGCTTTGGTGCTAATTTTTG
ACTGATATTTGTATAATGAGTAAACACCATAGTATTAAAATTGAAATCAAAGGTATTATT
GCAAACAAATAAACACAATTGATCTTTTTACCATTAATATAATAAAACCAACAACACTA
ATAATAAAAGAAAAATATAATAAATGAACAAATCAATAAATTTAAATTATTTAAAATC
ATTAAAATCCCGTATTGTGTATTAAACTAAATAACTCACAGAATTAGTAAATAATTTATA
ATTTTATCGTACATTTCTTCAGCAAGAATTACTTGATTATTAATATAAGAACAATAAAA
ATAACCTACTATACTACGCACTTTTTTATTATTTGTAAATTCTACATAAATAAACAAATA
ATTACCATCGGTATCTATTCCAATAATTTTTGCGGTTATAAATTCTTTAACTATACTTTT
TGTATTCAATGATTTAACAATATCATCGAAATTTTGACTCAAATCTATACTATTCAATAA
GTCAGTCAATTCATTACTAAAATCTTTAAAATCTGAATCCATTTTATCTCCTTGTAATAT
TATATAATATAGAATCTTAAAAATCAATTACAGTCAACTACAAATTATATTTCTAATAT
ATTCATCAATTAAGTCTGGTGTCACATCTGAATAATTATTAGAATTATTAGAATTATTAG
AATTATTAGAATTATTAGAATTTTTTAGATTCTCAAAGAATTCAAGTAATTCAATATCTT
TTATGGTACTAATCCAACTTAACAAATCAATATTTTTCATAGTCTTCTACTCCGTAAAAA
TTCAAACAATCTAATATTTTTATTGTTTCTTCATCATAATCAATTTGAGGTGTTATACAA
TTAAAATTGATATTCTTTAAGTATTTAACATTGTATTTATTAAATAATTCAAACACATA
CCAACATTACAACTTTTGAATTTACAAACTTGATAATCTTTTAACTTTAGAACTTCTTCT
ACAGTCAAAGTTTTCTTGAACAATTTTCAATGATTCTATCTGGGTAAACGTGAAGTCTC
AAACCATTGCAGACCATACCGAGATAATTTTGACTCGCAAACTCAGATTCATTCATATAT
TTCTTAGTTCCTTGAGAAATCATTACGTAGTCTCTATCTGCATTAAGGTCAACGCCTGCT
ACATTTTTATTTGGATTACTAAAACCAAATCCTGAAATATGAGTACAAATAATATTAGTA
AATCCTTGAGATTCTAAGAAATCTTTAACATTTTGAGTTCTTTCTATTAAATCTGGTTTT
TTATGGTTAAAAAATAATTTAACTTCTTTTGGTAAATCTATGTCTAAGAAATATTTAAGT
CTTTCAATATATTGATTAGAATTAATTTGAGAAGCGTGATAAGTTGTAACTAAATCTAGG
TTTCTATATTCTTTTAGACGTTTATAATGATCTTTTATATATAATAGATTTGTTAAAATT
GTTACGTCTTTTAGATCCTTAAATAAGTCTAAATAATCATAAAGATAATCACACATTAGT
GGTTCACCACCACATAAAACTGCGGATTTTAATCTAGGAAATATAGCTTTAACCAAATTA
AAACATTTTAAATCTGCTTCGCTTTTAGTATTTTTAGCAGCATTAAAATCTGTAAAACCT
GAATTACAACAATATTCACAACTAAAACAACATTTATCGGTTGTCATTATCGCAGCTCGA
ATACCTTCAAACTCTAATGTTCCATTTAGTAGTTTTCATATGAACATTCAGAACCCGAG
AAGTCTATTTTATTCATTTTAAACCTTTGTGTGCTTTTAAACTTTAAACTAAATAATTTA
TAATTGTGTCGGACCCATCCAATATAAATTGATCCAGATCTGTTTCTAAACGTCTTTCTA
AACCAGGATCTTTATAATTGATATTCCATAAATCAAAATCTATACCTAATATTCTACATT
CTATTATAAGTCTAGGTGAACAATCAAAATGTCTCATAATAGGCGTATACACATACTTAC
TAAAATTAAAATTCTTGATAGGTTTGTTTGTCGAATTCTGTATATTCAAATAATCACTAT
ACATTACAATATCAGGATAATCTCTTATTAGATCTTTTATTTGAGATTCTGATAATGCCC
TACAATTTTAGTAATATGAGCAAAGGTTTATCTCCTGGTATATGATTTAAATGGGGTA
ACACCTTCTTAGTATAATTTATTCCCAAACCAGGATATATTTTATGATCTGCTAAAAAAG
TCACATATTCTGGTTTATCTTCGGATTCTAAAAAACTAGGACCACAAGCAAACGAAAATA
CTTTACCTAGTAATTTAGACTTATATTGATTTAAAAACCAATACCCACCATCGGTTACTA
GTATATTTCTAGCTTTAATTGCTAATATCTTAGTATCTAAAAAATATATATCATTTAAAT
CAAAATCTACACTATAGTGTCCTTTTACGAAATCATTAAAAGTTTCTTTAGTTACTACTT
CTGGAATTAAACATTTAACATTAACACCTTTATTTTAAAATACCAGTAATAATCTAATA
CTTCAAATAAATGTCCTGATAATCCGTGCATTTTAGTATTATTAAAGTGAAAACTATGAG
TTACTAATATATCTGCTTTAGTATCTAATATCATCGTTTAATCCCAGTTTTTGTGTGATT
ATGAATGTATTTCAAATCTTTAAATTTATAATAGCATTCATTAGTTTTTCTTTTTGTGCTT
TCAAAATAAGGTTCATCACAAAATTTATATTTTTCATTCGCAATATATTTTTAGTATAA
TATAACAACTCTTTCATAAAAATCAATTTGTTTTTCTAAATTATTAAAATCTAAATCTTCA
```

FIG. 15AE. Continuation of (CJLB-13-1 [organism=Campylobacter phage CJLB-13] partial genome contig_1)

```
ATATTGTTTACATTTAGATTTAAATTACTAACACTTTTTAATTTATTTAAGCAATATTTG
TTAAAATCATTGATTTTAGATTTTTTATATTCTGCTAAACGATCTTCAAGACTAGGTTTC
TTCAAACCTATGGATTTACGTTTTCTATCATATAAGTAAGTATTACATTTCCATATTCTA
ACACCAGCTCTAAATAATCTTTTAAGCCTTGATATTTGTAGACTTCTTTCTACACCAAAA
TCAATATTTTTATAATCTAATGTGATATTACCGCGCCAATCACTATTGGCTACAATTACA
TATTGTTTGTCTGTAACAGCAATATAAAGTATATTTGGGTTTGTTTCAATTTGTTTAGCT
TCGTAGATTTCTTCAAATCTAGCTTCGTTAATATTAAATGAAGGTTTTAAACGTTCAAGA
TTTTTGATAGCACACGTAATTTGTCTTTGTGTTCTATTGAAATATGCTTTGTCGTTTTTA
TATCCTAAAAATATTTTTGTAATGTGTTTCATTTTATCTCCTTTATCTTTTAATGAAATA
ATTATAATATAAAATAACTTAAAAGTTTCTGAAATACAAACCGAATCTTAAAGTTTAAGC
TTAAAAAGTCTTAAAAGCTTAAACCTAAAAGTTTTTAAACGCTACAACCTCCAGACCCAC
AACCTTCAATTACTTGATCACCATCTGCATCATCTGTAGTTCTAAAATTAGCATAATACA
ATGATTTGACACCTAAATTGAAGCATTCTATAAATTCTTCTATAACATCTTCAATATTAA
CTTTTTTAGTTTCTACGTATATTATAATATTGATTTGTACTAATACTTTGATCTACATATC
TTTGTATTGTACTCACTAATTTAAGATAATCTTTATTATTAAAGTCAACACCCCAAGCAG
TCGTATAATATTTTTTGGCTGTTTTATAGAAAGGAACCAACTGTTTTACAGTAGAACTTT
TTTCTGTTTTAATAGTTACTAATTCTCTTGGAGGTTCGATACCAGGTGTTGCTGAGCTTG
GCTTTGAACTGTTCCCAGCGGGCGGTACAGCTGACAAGCTTGAATGGCGCATACCGTATT
TAGATAATTCTTCACGAAGTGACTCCCAATCTAATTTTGTTTTAAATTCAGGTTTAATCC
CAGCTTCTAAATATCTTTCGAATATAAACTTATTATCACTATAAAAGATTCATTATATA
ATTCACAAGCACCTCGTTCTTTTGCTAAATCTATTGAAGTTTTAACTAAGTAAAATAAA
ATAATTCCATTAAATCATTAATATGTTCGCGTGCTTCTTTTGTATTGTAAAATAATTTCG
ATTTAGCAAGATATCCAAATAAGTTAGAAACACCAATACCTAATGTTCTACGTTTTGTAG
CTGAGTATTCAATTTCTGGCATAGCAAAATCAGAAATATCAATCATATTATCTAAGAACC
TAACTAAGAAATCAGCAACTTTTGGGATGTCAGATTCTTTAGAATGTCCAAAATTTATAT
TACCTAAGATACAAGTTCCTAGTTCTCCTGGTATACCCCTATAATTATCTAAACTATGAC
TAGGCACAGATATTTCACAATTGTGAACACACAATCCATTTGCAAAAAAGTTATGATTAT
CCTTAACTTCTATATCGTATACAGGTATTTTTTCAGTTTTTTTAGTTATTTTTATCATAG
CACCTCTTTTATTGTTATTATAATATATAATTACTTAAATTGATATTACTAAGTGATTTT
AGTACATCTTGTTTGTCTAAATCTTTTGATTTTCTGAGCAATAGCACAAGAAAACGCTTC
CTAGTTCCATCAAAATCCGTTCTAATTTCATTTGAAATATCTATAGGAGTATACTTTAAA
TCAGTACAAACATAAGGTAATAATTTTATATATTTTTTCATTAATTCTTCATTAGTCACA
AGCTTAATAAACAATGTATAATGTTCTTTAATATAATCTCTTAGAACACTTAATACATAG
GATAAAACTAATTGAGAATTTGTTTCTATTTTATCTGGGTTTAAAATCTTTAAAATATCC
TTTCTGTGTTTGAGTTGTAACAACAATTGCTTAGTATCAGAAATTTTTAAGATATTTTCT
ATATCAGTTACAAAAGCACCAAAATGTGGTTCTACACAAGTATGGTCACCTTTGACACCC
CTTCTCCTTTCAATTATAACATAATATAACAAGTTATTGTGTCTAAATGTAGCCATTCTT
AAAATAGCCCTTTCTTTGAAACTTGCCATTTCTAATAACCTCTTCTTGGTATACCGAGTTC
TTCAGACATTTGCTTAATCACCATATCCATTTTCTGGCAATCATCCAATACTTTCTTTGC
TACCCACGCGCCATTAAAAGCATATAAAAACTCTGAGAGTTCTAATATACTATTAAAATG
TAGTGGTAAATAGCCTGATGTAGTATCTTCATTTTTAATACCAATTAAATCTTCATTTTC
GTCGAATACTAATCCTAATTCAAAGAAATCCATTAAATATGTTTTCTAAAGAAATTAAG
ATTATGTTTATTCGGTTTATCTAAATATGTTATTTCTTCTAAATACGGGAGGAACATTCT
ACTATTGTATCACTTTCTAAAAGATGTTGAGCTTCAATATAACCCCTTTGGGTTAAGAAT
TTATGATCACTAGTGCAAATGACCACTTTACCATTGAATTCTACTTCAAAAACTTCAGCT
TCCGGATTTGTTAAAACAGCTGCTAGTACTTCTTTGTATTCATATTTTTTGTATCTTGA
TTATAACTTAAAACAAGATCTCCTTTTTTAATATCTTTGAGAAATTTAGGCCCTTGTGAA
GTTTCAACAATTGTATCACCTGCTAAACAACAAAGATTTGTCATATATAGATTTTCTTTA
AAACTTGAATTAACGAAGTTATCCGCAAAAACAATATAAACTCTACCAGTAATCATTCTC
TCATTTATAATTAAAGATAATAAATCATAAGCATTAATTTTCTTTTTACTTTTATTAGGA
ACTTTAGCGCTATAATGTTTATATAATTCATCGAATCTTTTATAATCACCTAAGGCATCA
TATAAATCTAATTTGGGATCCTTATTACCTACAGCATTCATATGGAATAAAAATATATCC
TCTTTATTAAGAGCTTTTTCTAAGAACCATTTATTGATGATAAAAGTTTGATCAGTATGT
CTAGCCCTATTTTCTAAAGATCCTTTAGAATCACCTAGTTGTGAAAATAATTCTATTTCG
TAGTGAAAGAAAGGCATTGACAGATTGCTTGCACCGCCCCTGCCGTGCTGAATCAGCGCA
GACGTAGCAGATTCAATGGCTTTAACGATCGGCAGCATACCAGTATGATCTAATCTTGAA
GGTTTACCTACTGGAGCTCCTAAACCTCTGATGAAACTTGTATTGATACCTAAACCACTT
TTAGCACTGGTGCATTTTAAAACAGCTTCTAAACCCCTAGCAAAGCTTTCAACTGAATCA
CCAAAGTTTAATAAATTACAAGATATAAATTTCTTATAACTTGTTCTTGCTCCATTCATA
ATAGGAGTAGGTAAGAAATTTTACGCTGTGATAATAATTCATACCCAAGTTTAACATAT
TTTTTTCTATATTCTATATCGGTATTATAAAAAATAGCCATTGGTATCAATATAAAAACT
TCTTGAGGAACCTCAATGCATTTTTTATTATGTTTGATCAAGTACTTAGAATACATTTGA
TTTAATGCGCTGTAAGGTAGTTCGTTATCTAATTCATAATTAATTAAAGATCCAAAATAG
TCAAGCTCTTCATCACTATAAGCATTAAGATCTTCAGTATAGAAACCTTTTTTAATACGT
TCTTTAACTTGTGATTTAAAATCTAATGGTGTGTATTGTTTATAAACTTCTTTCTGAGT
TTTTGATTTAATAATCTACCAGCAACTAACTCATAATCTGGAGAATCTTCACTGATTTTT
```

FIG. 15AF. Continuation of (CJLB-13-1 [organism=Campylobacter phage CJLB-13] partial genome contig_1)

```
TCTTGTGCAGATTTAATTAAAGAATCTTGTATGTCTACACTTTTGGCACCATCAAATATT
TTTAATCTAGCATCTTTAATAATGCTAATAATATCTACATCGAGGTTTTGACAAGCAAAA
TGTAAGTGTTTATGTATTTTTTCAGCATCGAATATTTCACGTTCTCCGTTATTTTTAACA
ATATGTATAGTGTCTAAATTCAAATTGAGTCCTTTAATCGTTGGTTAAATATTTATGATT
CAATCATTTGTGTATTTAAAGCTTTGATATAATCGGGTATAAATTATATCAAAGCCTGTT
GTTTTAAAATCTATCCCTTAGTTCTGGATATTTTTCAAAAGACTTGAATGACTTTGTTAA
TATCTCACTTGATAATCTTTTAAAGATTCTAGCTAGTCTGAAATGTATCTCATTTTCTGA
TAGCTTAGATTTTTGAAGAGAACCGTAATTAATCTCTAAATCCAAGATATATTGTTTCAG
ATTCGAATCTTCTTCAATATTTCCATAGAAAATATGATACAAGTCTTCCGGTGTTATTTT
TGATTTGATAGTTTTGTTTTGTAAAGATCTTACTATTCCTGACATCTCTCTTAAATGTTT
TTTATTATTTAAATTATCATCATATCTAAGACTTTTAAAATATGATTAAAAATGTTGTC
TGAATTGTTAGTAAATTTAGAGATCATTACATCTTTACTAAAAGCTTGTTCATATAAGTA
TTCTCTAAAAGATGTTGAGGAAATGGTTTCTTTTATTATCATTTTAATTTCCTTAACTTT
TTAATTGAAGTTATTATAACTAAACACCGCTTAAAAGAAGCTTAAATTATGGCCTTTAAA
CGACAAATGTTAGCTCCAAAAATCGAAAATAAATATACAAAAAAGTAGGATAAATGGCAA
CTGTTACCTTAAATAAACTTGCTAGTGTTATTAATACTATCAAATGGAGTAAAACCTCTG
ATTTTATAGTTATTATGAAACCTATTAATGCTACTTTCCAAAATCTTATAAACTGGGGAA
ACCCTACCGAAACACAAAATAGTATAGATATTTGTTTAAAAAGTATTAATTTGCCACAAT
ATACCGGTAGATTTGAAGAATTATTAATTGGAGGGACTTGGGTTTTAGCACGTGGTGCAG
ACCCAGTATACCAAGTGGATATGACCTTCAGAGATTTTGATAATGCTAGTATGTATCGTA
GATTTGTCAATGCTTTTCAAATTTCAAAAGGTAACTACAATGATGTCTGTGCTTGGCTAA
TTCAGGTTTATTTAAGCAATGGTTCTAAAAACATCTTAGTAATGGAGACGCAGGATGCAT
TGTTGACAGATGTTTCACAAATACAATTATCTCAAGATAACAATGAAATTATAGAATTCA
ATGTTAGTTTTAAAATGAACCAACCAAATCACGATAATACAGATATTAAAAATATTCAAT
TAGCAAGCACTTCCAACACAACCGGGAATGATAGTGTACAATCTAAAGCAAGTTCATATT
TTAGTAATATGTTAAAAAATGGATTAAGCGCAGCGCAGAATGCAGTTCAAGATACTTTTG
AAAATTTAGTATCTAAATGGTAAAAAATATACAAGGAAAATTAAATGGCATTAGAAGCAT
CTAAAATAAAAATAATAGATTTCGTATACGAAACAACTAAAACATTAAGTCAAATTACAA
AAGAAGCTGTTGATGAAATGCAGGGATTAGTTGCTAAAAATGATGGTGCACCAGTATATG
TTAGAGTAACAGACGTAGATCAAGGTAGAGTTATTTTAATAAACTCTGATGGTAAGATCA
TAAATAACTACTAGTAATAATATCGTTCAGGATAAAAGAATACAGATAGACTTATAAATCTT
TAGTTTAAAGGTGAAAAATGCAATTTAAAAAAGTTGATGTTTTAATATCAGAAAATCTCA
CAAAAGAACAGTTAAAAGAAAAAGTTCTAACAGAACTTAATAAAATAAGCAAAGAATCAA
ATCCTAGTATTAGTTATATCGCTAATATTCACGATATAGTTAATGGTAAATATTGGATTT
GTATGGATTCTGAAACTAAGGAGACTATGGAAGCATCAGATGAATTAATAGATCTTCAAG
CAATTTTTAGACATACAACTGAAAATCCAGAAGAAGCTTCAAAAGATTTATTATACAGTT
CTAAATATATAGAAGATAAATTTCCTTCGAAAAATAATTTTTGAAACTTATAAGGAAGCTA
ATGATTCTAGGCTTACCAAATTAGAAACTACAGTAGGTACTAATGAAAAAGATATAGAAG
ATAAACATTATAAATTAGAAAGAAGAGTGACAACTGCTGAAAATACCATTGCTGCAAATA
AAGAATTAGAAGATACTAGGTATAGTGAGTATACCCAATTTAAAAAAAATATAGAAAATA
ACATTCTTAGCATCAATAATAATTTAAATACAAAAGCAAATCTGGGTGGTTCTGAAACGC
AAGTATTTAATGTTGCAGACCCAACAAGTGATTGGCACGCTATTAATTTAGCTTACGCCA
AAAAGAATTTTAATGTAGATTTAATTAATACTCATAAGACAGACTTTAATAACCCACATA
AAACAAGTATTGCTAACTTAATTGATGCAAGTATTGTTGACCCGACAAACAATCATATTT
TACAATATGATTCAAATACTAAAAAATGGAAAAATGCAGTTCTAAGTGTAGATTTATCTA
ATTATTATAATAAATCTGAAGTAGATTCTAAATTAGATACTAAAGCCAACACAAGTAATG
TTTATAATAAATCTGAAATTAATACTAAATTTAATTCATATTATAATAAATCTACTATAG
ATTCTTTTATGGAACTTAAAGCAAGTGCCGAATCTGTTTATGATAAATCTGAAATCGATA
CTAAATTGCAAGATGTGTTGACACAAGCGGATAACAGATACTCTACATTATTAACACAAA
AATTAGAATGGACTGTCGGAGAGGGAGGTAATTTTGAAAATATAGATGATGCAATTAATG
AAATATATAAAATGGTAAGTCTATATATGATATAACATTAAAATAAAGAATGGATATA
CTATTACTAAACCTACTACATTTTATAACTTACCTTTAGGCGTCAATATAGTTGGTGAAA
ATGGAAGAAGTGATGAACTTATAATAGATTTAAATAATACAGCTTGGGCGCAATTTGGGT
TATATATCGTGATGTGCGAGGTTCATATACACGATATTACAATAAGAGCATCTTCTAACA
ATTGCTCATCAATACATATCTACTGGTACAAATGGAAGTATATATAATGTTGATTTAA
TAGGAATGTCACTCACTAATTTAGTGATAGCTTCCTCAGGAAATATAGAAGTGAGTAACA
TTAATATTCAAAATAATTATCAAGGAGCTGAAGAATGCTATGATTTATCAGTATTAAATG
CCAATCTTCAAATAGGTGCTAATGTTAAATTTTTATCAAATAATCCTGAAAAACTAGTAG
CTATTAGCGCAGCGACTAATTCAAAGATAAGTTCAGTATGGTGGCATACAGGTATAGATA
TAAGCGGTAATTATAAAGTTGGGTTACAGGTAGTTGGTGGAGGCGTAATAAATAATCCTA
GCATTGCTATGACTGGAAATATTGGAACTAAATTTTCACAAACACCTGGGCAATGGACAA
CATCAGGTTACATTTCAACAAATATATAGGAGTAAAAATGATAGTAGCAAAAAAACTTT
AAGTGACCAAGGTGTATTAAATTCAGATGTAATTAAATGGGCTATTGAAGCTAATACTGA
ATTGTGTGTATTAAACAGACCTTTAACCACGGATACAAGTTTATCTGATAAGTATATCAT
AAAGCATATAGATGACATTACACCTGAAGAAATTCAAGCGGGTACACAAGCAGTCAAAGA
ATACTGCTTAGCTAATAATCTTATGGATTTGTATTATGAATATGTACTAAATACTGCAAG
```

FIG. 15AG. Continuation of (CJLB-13-1 [organism=Campylobacter phage CJLB-13] partial genome contig_1)

```
TGAATCTGAAAAACTTAATATAATTAAAGAAAAGAAGAAGTTTGAAATACAAACAAAAAG
GGACGTAGCTTTAGAATCTGGTTTTGTATTCAAAGACCATACATTCCAAACTAGGGAAAA
GGATAAACTTAATATTAACGGAATGGCCGCTAATATATTGTTAGATATACAAAGTGGTAC
TAATTCAATAACTGAGATTACTTGGATTGACTTGAATGATGAAAAGGTTAATTTTACACC
TCAAGAATTTTTAACATTTGTTTCAAAAGTAACCGAATATACTCAGGAAGTAATATTTAA
AGCGAATACATTAAAAGAAAAAATTAATTCATCTGAAACTGTTAAATCTGTCGATAAAAT
TAAATGGGAATAATTAAGTTTATTAGTAAATGTGGGTCATATAAAGCTATACGTCTTATA
AGGTTTATGTCTACTTATAAGGTTTGAGCTACAAGGAAGCTCTTAGGTCTGTAATACCAC
AACGATCATATTTACCGTTACCTTAACTATCAATTCCCTTAAACGTAGATTAATTCCCAC
ATAAAGGACAATGGAGCCTAATGAGAGACTCGAACTCTCAACCTTTCGCTTACAAGGCGA
ATGCTCTACCAGTTGAGCTAATCAGGCATTATATTCAGTCATTGTATAGAGTTTAATTCT
ATACGATGACTCTTTAACTTTATTAAAATGATAAATTATGTTTAAAAACATAATTCAAAG
GGCTTACACCAGCTTTTTTTGCATTTCTTGTTACTAAGTTATTAGCAACTCTGCTTATT
TTTTTAAGCTCGTCTAGTAAGATTCTCGTTTTTTATAAAGAGGTTCTAACTTTTTCTCA
ATATTCTCAATTTCACTGTCGTATTGTTCTAAACCTTTGTTGAGTTTTTCATTATCAACG
TTATCGGGTGCAATCTGTGCAGCTAAGCCACCTAGTTTAAAGTAAGCTGTAGTCTGTGCA
GCTTCTAGTTTACTTATTTCGGCTTGCAATTCCATCTTTTTTTTGGCTACTTCTTGATAT
CTATTTCTGAGTTCCTCTATAGCAGACACATCCGTTTTCAACGCTTCATTTAAAGCAATA
TTGTTTAAATAATCTTTAAATGTCATTTTAATCCTCCAAAATATATTTAAATATATTTAT
TGGTTATATAAACATATAGTATCACAATTTAATAAACATGGGTAAAACTTACAAATGATT
TTTAATTGTGTTTACAATCATCAGTTTTAGTTATATAATATAACGCTGACATCATAAACA
CATTTAAAACTTCTACTGAAATCTTAAATGTGTTTACAGTCTAGTGGGTTACCAATTACC
CGAATGCTTACTAATGTTAGAATGGTCGGGGTGAAAGGATTCGAACCTTCGGCCCCTTGG
TCCCAAACCAAGTGCGCTAACCAGACTGCGCTACACCCCGAAAATTATAAATTTTCAATC
ATATTTATAATTAAAGTTTAATTAATTTAAAAAGGATTTCAAACTGCAACTTTTACATTAA
CAGTTTGAAAATCCTGATTAGAATCTAACCGTTTAAAAAAAAACTTTTTAAACAATATAA
TTATATAATATAAACTTAAAGTTTAATTAAATTTAAAACATTTAACACTATAGTGTCA
ATCTTTATGAGACTAATTAAAGTTCCAATCAGTTTTAGGTTTTTGTATTTCTAATTGTGG
AACGTTTTAATATCAGCATTACTTAACATTTGTATATCATTTGAAACTATATCTTCTAT
ACGCATATTATTATAATTAATATGCATATCAAAACTTGAAGTTCTACCATTATAACGATT
CTTAGTTATTTTAAATCTAATAGTATTTTTCTTTTTAAGATCTTCAGTTTGTAATAAGAA
ACAAATCCAATCAGCAGTCATAGCAGTACCCATAGAATCTGAAATAGCTTCATTGTTAGA
ATCTGTATTATTTACAGCTGATCTATTTAATTGAGAACAAGAAAATATCGGAATATTTC
TGTGACTGCAATAGCACGAACTTCTTCACCAATGGCCTTAATATAACTATATAAACCTGC
ACTTGCAGAAACTCTATCAGATTTCATCAAGCCTAAGTAATCCAAGAATATTGCATCGAA
TTTTATATTATTAGCTTTATACATTTCTAATAAAGATTTTAAATCATTTGAACTAAAAGA
ACCAGCTGGGAAGTTTTGAACATATAAGCTACCAATACCAGATCTTTTTAGTTCTTCAAA
CTTAGTTCTGATAACACTAGGGTCTACGTCTTTTAAAGCATTAATTTGTATATCTAATAA
GTCAGCATCTATTCTTTTTAAGAACTCAAAATTAGATAATTCTAAGCTGACTAATAATAC
ATTTAAACCTTGTTTAAGAAAATCACCAATGCTGGTACTCATTAATAAACTTTTACCAAT
ACCTGCAGGAGCCATAAAAATATTCAAAGTTCCGTTAAGAAAGCCTTCTCCGATATACTC
ATTTAAAGTATTGAATCTTAAATATTTGATACCTTTTCTTGGATTTTGATAATAATCAAT
GCGTTCTTCTATATTATTATATTCATTACCAAGATCTTTATGAATATTCACAAGTTGTGA
AGCATCTATAAGATCTTTGGCTTTTTGTTTATAAGTTTCATCTTTTTTTATCAATGAACTC
AGCACCTAACATTAATGCTTTTGTGAACATTTGGTCCTTAATGAATTTAACAGTTAAATC
ATCTAAGAATTCTTTATTGATATTTCTGAGTTTCTAGCATCATTAAGTTTAGTAGCAAT
CTGGGTTCTTGCTTCTTTATTGGGAATATCTTTAATTTGAAGTGCTATTTCTTGAATGCT
AGGAGTTGTATTATAATTAGAATAAAAATTATCTATTAATTCATAGATTTTTTGGTTACC
AAAATCTGTGAAAATACTAGGTTTTAAGATTGGCCTTACTTTATTAAAAAAATCTTTAGA
TTCTATAATATTTTTAGAAGAACCGATTCAAAATTATCCAAATTAAACTCCTTTGATTT
AGACTTTTAAAATTAAATTTAAATTTTTAATATGATTATATATAAAGAACGATTAAA
ATTTAATTAAATTTTTTACTAAAGATCTAGCAAATTACACTAAAGTGTTAAATGCTAAGA
TCTATAGTGTATTAACATTAAACTCGGATTTGAACCTGTTTTCTTAATTCAGGATCACCA
AAAGCACCCCGTAGAATTCTGAAGTAAATCCCCCCTCAGTGTTTCTTGCACCTCTAATC
CATTCACAAGTATGTTTAATATTACATAACTTAACATAAACATCTTCAGTTTGTGCTGCT
TCTTTAATTTTATTGTAGATTTCTTTAGTCAAATCTTCTTGCAACCAATAACGCCTCGAG
ACGAAATCTGCTAATCTTTGTAACTTAGAAATACCCAGACAATAATCTTTAGGTATATAA
CTAACTATTGCATAGGAATCTTCCGCAAAATCTGTATTAAATGGTAATAAATGATGACTA
CAATTGCTTGCTATGTTAATCCTTTTAGTAATTGGAATCTTAGCTGCGTCTTTATTTGGA
AAAGTTGCTATTCTAACAGGTTTCATAAATCTACCAGAGCCACACTCAGTATCATCATCA
GTGTTGGCACCAGCCATTAGCTTAATGACTCTGCCTGGTGTTCCTAAATTACCATTTTCA
AAATCTGCTTTAACATTTGGGTCTTCTAAATCAATTTTAAGTATTTCAAAAACTTCTTGT
AATTTTTAGTAGCTAATGCTCTCATAATAAAATGAGCTTCGTTTGAAATACTTTGATTG
GTTTCAAATATATTTCACTAGCTTTAAATGGTTTGATATTTAAATATTCTTCTACAAAA
TCTTCATAAGCTTCTCTTGAAACTTCTGGAAATTTTTCTGAAATAAACTCCAAATAAAT
TTATCTTCTTTTAACATTATACCTCCTTAACTTTGCATAGATTCGAGCATCCAAATATAT
```

FIG. 15AH. Continuation of (CJLB-13-1 [organism=Campylobacter phage CJLB-13] partial genome contig_1)

```
TTTTGGAGACGAATTCTAAATGTTCTTAAGATGTCTTCTGTAACAGTATCTTCAATTTTA
ATAGCTTCTGAATAAGAACTGCTACTGAATTGTCAACTAATTTAAAATCATTTATTAAT
GTGCTAGCTATGGTATCCAAATCAAGTTTTGTAGCTTGTAGATCTAAAATATATGGATTT
TTCAGATCGTGGATTTCTTGTATATTAACACAGGGTGTTAAACTCAATTGAACCAATCTT
TCATTGAATGTATCAAACGACTCTTGAAAAAATTCATAATATTCTTGTGTTATTTCGTGA
AGTCTGTGAAATTGATTGCCTTTGGCTAAGTAATGCATTCCATTTAATTTAATAAAGATT
TGCATACACGTAGCTGAAAGTTGTTTTAAATTATCCATTTATTGTTCCTTGGTGTAAAAT
CTTTAATCTGCAATTTTTGAGATCAAAATCTTAGAAAACTCAGATTCAAAGAGAATTCTA
AATGCGTTTTTACTCTCATTATATTTAATCTTTAAAGTATAATTTGTTACCGGCAGTTTA
ACAAAATTTTCAATATTGATTTTCAGTTTAAAATCCATAGTTGAATGATTTAAAAACTCT
TTGCTAAATGTATTATTAGAAGAATTAAATCTATTATGTGCATCTAAATACAAATATAAA
TCATTTGATTTACCTTCTATACTTAAAACATTTAATTCGTTGTAAATACTTGAAGCTTGT
TTAATTTGTTTTATGACTTCAATACTAATGTCAACTCTGGCAACTTCTGGAAAATTATCT
AAACTTTCAATAATTGAAGCTTTTTGATCAAAGTTTTCCATTACAGACAAATCTGAAATT
GTATAAACACTTTTTGTACCCGGTGTTTCAAATTCTATTGCATTGTTTGTTCTTGTAATT
TCTGGATTATCAAATAATGCGAACATATGAACAAACTTATTTAATTCATATATACCAGTA
TCTGGGAATTCTTGGCATCCTAATTTAGACGCATCTATATTTACAAGCATATCTATAGCT
TCAGAATTTAATGTTGTTATTGGATACTTAAGAATAACTTTATCAGTTATACTCGACATT
TTTGAAAGTTCTTTAATGAAATCTTTTGTGATCATTTAATCTCCTTTGGATTTTGTTTGA
TTCTTGGTTGTAATTCTACTCGGTTTCCTGCAAGTTGTATATTTAAATTATCCGCACCTA
AAACAATGTTTTCACTTTGTATGATTAAAGATTTATTGAATTTTATATGAACTGCAGAAT
CTGAAATCTTGACAGAATCTATCATACCTAATAATGTATCTAATATGAGGTCTTTAGAAA
CTTCTTTTGTTTCTGAAATACAATATCTTGGCATTCTTTAATACAAGTTTCTTGTGATT
TATTAAGAATTTCTGATTTTGGTACAAAACTTAATTCATTCATAGTTCTCCTTTCTATTG
AAATCTAACAATATTATAACATATTAGCACTTAAAATGTACTTAATTATTAGACAATCAT
ATCGGTTCAAAATCGTTATTTAAACCCACTTTAATTTCAGCATTAAGAGTTTAGTTCATT
AAATTTTGACATTGTTTTATTCACGTAATTTGCTTGGTATTTTCCATAGTATCTTGAAGC
CGCTGATTCATACTTATTTTTGTATTAGATACCTTGGTAAAGATTTCAAATAACTAAG
TATATATGCAGTTCCTTCTATATTCTTTTTCCAATTTTTAAGATCTTTTTTAGATTTTAA
ACTTGTATTAGATTTGAGTTTATCTCCCCAGAAATCCCAAACAATAGCACCCATACCTTG
GGCTTGTATTTCTTTTTTAAGTGTTCTAACATAAGTAGGTTTATGGATAACGTCGTTTCT
AAATCTTGATTCTTTCCACAGTATTGCGTATAAGAATGCTGGATTTATTTTGTATTTTTT
AGATTGTTTCCATATTTCATCAAGTATTAGAGATTGTTGTTTATCACTTAAGTGATACAT
TGACGACATATCTTTCATTAAAGATATTTTAAATCTTGAACTTTAGAACTTAAATGATT
TAAATTAATTTTGGTATCATTTAATTCTTTTTGGTTTATTAAGTTCTGTTTGGAGATC
TTGAATTTTAAATTCTAAATTTTTAACTTTTGTATTATTAATATCAAGCATAAAATAAAC
AACTGATAAAATAATAATCAAAATTATTCCAATTTTATTTAGTTTATCATAATTCATTAA
AATCTCCTGTTAATGAAGCTTTATATTCGTCAATAGTTTTTAGCATAGGATAAGCTTCTT
TTATAATTTCTAAAGCAGTATCAGTAAGTTTTGTTCTAAGTATTAAAACATAATCATATC
TAAGATTTAATTCAGGATCTTTGAGTTTTTTAACATCGATAATTGCATTATCTTTTAAGA
AGCGTTCTCCAAACTCGTTAAATTCTTCTAAATCTATTTTAGATTGTGGGTATTTGTAAT
TTGTTAAAACTAAGTTGTATTCTGAGTCTTTTAAGGAACTCAACATTTTGTATTTAGAAA
CTCTCATATTATCTCCTTTTGATAATTATAATATAAAATATCTTAAGAGTTCCTTAAATA
TAAAATTATTTAGCCAACGATAAATACAGCAGGTTCTGTAAATTTATTGGAAAGTTCCTC
GTTTAATCTTTGTATTTCATCTTGGGCTAATTGTCTAATATCACTATAATTAACTTGCGA
ACCATTAATTAAAGGTGCTGAATATTTTCCTAAGACTACACTTTGCATCAATCTGGCTTG
AGCCACAGACATTGCTTTGACCCATTCTTGGTCATATATTTTATCGTGTTCATCTGGTAT
GTATTTACATTTAGCTTCAATTAACAAAGGCCCGTGGTAATTTGATATATTGATAATAA
TCCCTTATGAGAGTTAAACTCGAAATTAATACGTTGACCAAAGTATTTGTCGACTAAGGA
TCTTGTAGAACTTAAAGTAACTAAGTAACTTAAAGCAACACCAGAAGTAGATAGTATATA
ATTAGATAGATTTTGATCTATTAATCCATTTAAATCAGAACCTACAAAAATACCACTTTG
GCATATTTGTAATATTTCTTCAACTTCAGGATCTACAAAATAATTGCCTTGGCCCTGACA
TTCAAATTTTATATATCTTGTTAATTCTCCATCATATGCAACATTACAAAACATTTGAAC
TGTTTTTTCAATACAGTGGTCTAATTGATTATCTGTAAGTTCAACTTGTAATTGTGGATA
TCCGAGTTCTTCCTGATATATTGCCTAAGATCTGATAAGGTTAAGATTCTTTTCATCAA
GCTTCTCCATAAACTTCTTTGATGTTATTAAGTATAAGTTGAATATTAGGATCTTGTGAA
TTTAATGTAAAATCATTGGATTCTTTAAATCCTTTAGTATTAATGAATATGATTTCATCT
GGGTTAATCACATATTTTTCTGATTTTATATCGTCTGTAAATTTAAGATCTTTATAATAA
AAAGTTCCTAAAAGATTCTTTTTAATAGAAGTTGTAATGTCTTCTATAAAATATTTGAGA
GATAAACTCGAAATCACAGAAACTCTGATACTTGGTTTATTTAAATGTCCAGTTATTGGA
TTCCAAAAATCTATACTTTCAACGTGAAATTCTTTAGTAGCTTTGTTAATTTTCTGAATT
TGTTTAGCGTTTTTTGTAGTGTAATTAAATCTTATCATATAGCCATCAGCACTGGCAAAT
CTAATACCTATTAATTTTGAACCATTTGAAGTACAATGTTCAACCTCATTAACTAAATAG
AATTTTGCATTCAAGATTCTTGTGAATACTTTATTGTATTGTTTAACGATGGTTTTAATG
TCATTTCTACTAAATTCTTCAGCTTCTTTTAATCTATAATATTCTAAGAATCTCATTATA
AACCTTTTAACTTATTTATTTTTGGTATTAATCGAGCATTTTAGATATAACTATATCGTT
```

FIG. 15AI. Continuation of (CJLB-13-1 [organism=Campylobacter phage CJLB-13] partial genome contig_1)

```
GTATATAGATCTCTTATCAAAATCATATCTATCTTCGAATCTATAATATGAATTATCATT
TTTTGTGAATTTAGAACCTTCAGAAATATATTCACAATCAATGCCTTGGTAAGCACATTC
TGTAAATTGTCTTGGGTGTCTATCATAAGTTCTACCAGTTTTAACATATATGTACTTATT
AAAATACTTGTAAATATCCGGTATAAAATTCTTAGTCATTGTGTAATGTTGAAAATTATT
TTTAGGATCTTTGATAATTGCTTTCGGATACATTTTAAGAATATTTAAATAACTCTTGCA
GCAATTATCCATACAATTAACATATACATTATCTAAATGATTAAATATTCTGTGAATCTG
ATAATATATTTTATTAATATAATTTTTATTTAAAAAATATTCATCAAATATTCAGTATT
TTCTTTGAACCCTATGGTGCTGTTAGCGATTACATATAACTTATTTAATTTAAGGGATTT
TGGGTGATTTATATTATAGAAATCGTGAGTATCGAATAATAAAACTTTGTTAAATTCTAA
ATCATATGGATCTTTATATATAAAATTATCAAAACATTTTGACTACGTTGTATTTAAT
GCTTAAAAAATCTTTATTGATATGACTGTACAATGAAACAAATTTAGTATCAGGATCTAA
TTCCCAAAGTCTATAAAAATATTCAAAAGCATCGAACATAGAGCCATTATATTTGAAACA
CCTAGTTATAACAGCCCTATTAATCATTATTTTTAAAATTAATGTCGTCTATTGCAGAA
TCAAGATATGCAAATAAAACAAACGAACCTATTAAAAAGAAAACAATAAAAATTACAGCA
AATAATAAATTATAAGCTAACCAAATAGTGCCAAATAATAATATCATTATAGTAATAAAA
GAATAATTACTTTTTAAATAATTGTATCCTTTTAAAATATAAGATTTAATATAATTGTAA
ACACCGAGTATATCCATTACCATTCCTCCAAAGTTTCAGTTTCTTTATGTAAATTATAAT
TAAGTGGGTCTGTCATTATTTCAAGTGGTTTTAAAAAGAACTTATTAAAATTAGTATCCC
AATCTATATAATCTTTAAATACATTTGCAAATTTTTCATTATTAAAAGCAAAAATGTTAG
ATTTTAATGGGTTAGGTTCTCTAAGATATAGCATACGAACCTTTTCGCCTAATTCTAATG
GTTGAAACTCACCTGTATTTAGACTATTTATATAATGATTTGATACCAAGAAAGCTCTTG
AATTAATCGGTATGGATTTATCCACACCAAGTTTATATTTGCTAGAACTGACCGAAGATA
TCTTAGCAATATCCATTAGATTTTGACCCAGGTATAATGATCTAATATTTTTAACCATT
CTTTAAGTTCTTCTTCTGTACTTTCTAATATAATATTGACGGATTTTTTAAGATATTTTT
TAGAAAATGCTGGTGTACTGGATCTGACAATATCGATACCCATTGTTTTAAGATAAGGTT
CACTGAACCTAACACCTTCAGAATCTATAACTTTCATAAAATATCTTTTCTTTGCTACAA
ACACAGCAGAGCTTGCAATCGCTTCACGCTTTGCAGAAATTCTTGAAGCATCTAAAGCAT
TAAAAATAGACCCTAATTCTTGTGAGCTTGTGTTAATTACCGGTTGTATTTAGTTTCTA
TAAATTTATCAATTATATCTGTTGCTAATTGTGGGTCTTTTGGTAATTTTTCGTTTATAA
TATTAGGTACTTGAACATAACAACTGTTATGAACTAATATATCATTAGCAAAAAAATTAT
GATTAGAATCTACTTCAATATCATAGACATCTAATTCTTGGATACCTAAAGATTCTACTT
GGAAATTTTCAGTTACTATCAAATAAACTCCTTTAAATCTAATAAATTATTCGATTTTAT
ATATTCTATAATAATATTACTTAAATTTGTATTAATTCTAAGTTCGTTTCCCAAATTAT
TATAATTTTATAGCCATTATCTAAAGCGTGATTAATTTTTCTATTATCTGCTTCTCATAT
TTCCTCAGTAGTCAATGTCTTGTCAAATGGATTGGGATTGTCGTGGCTATTAAATATTTT
AGGATTTGCGTGAAATACATCACCATTAAATTCTATTATTAATTTTAATTCTTTGATATA
ACAATCATAAAAATACGGAGTTCCGTTAGAATTTAATACTATTTCTCTTGTTTTGGTTC
ATAATAAAAAGTATAATTATTTCCTAATTTGGATTCCAATTCTTCAAATAATTTTGTAGC
CATTTTTGAATAACCTATACACTTTTTGTTATTTAAAAAATTAAGCCACTTTTCATTACC
TAGGTATTCACCATATTTTTTAATAAGATTTTCACGAGTGATTGCTTTACTTGCGTTGAT
GTTATAATATTTCTGTTCGCCTACAATTTCACCATATTTTTCAACAAAGTATTCTTTTGT
ATTTGTGTATGCCTGTCTATGTCTATAATCCTCCCATTTTTTATTACCTAGGTCTTCACC
GTAACGCATTATTAAATTTTTCTTAGTCACCGCTCTGGATTGATTATAACAATCTACTTC
ATAATCACTCATACCCAGCACATTCATTTTATATTCTTTTGTATTTGTATATGCTTGTCT
ATTACAATAACTTGTCCATTTTTTTAGCGCTCCGGTTTTACCGTATAGCAGCAAACATT
TATATTTCGTTATAACACCCTTAGTGTATTTGCGTAAACGTCGGTATCGCGCGTATAAAT
TTTTAGGTCTGTATTCGCTAAACGTGAGTAAATATTTGTACATAGTTGTATAAGGCAATT
TACCATTTTTAACTTCAGATTTAAAAATTGTTTGAAATCGTTAAAATATGATTCAGTCA
TTTAATATTATTAAGTCTCCTGTTTTAATATCTCTTGGTTTAACCTCAATTAATTCAGAA
TTTCTTAAAACCATAATGCTATGATCTTCGGTTACGACCACTTCTTTATTATTGACTTTT
ATTTTAAAAAATTCCTTCTTAACTTTATGTTTCATTATATAATTAATTTTTTAGTTTCA
ATTTGTAAGTTTTTATTTACAGAATCTGTAAAACAATTATCTACTAATTTTACATTATTA
CCAGATTTTGTAACAATAGGATCAACTTTTATAGAATCATAAAAATCTTCTATTTTAATA
TTTTTACCATTTACTTTAATAATTGAATCCCCAACAACGGAGTCAGTATCATTATAAATT
ATATAATTTCCAGAACCACATAAATCGCACAAAAATTATTGATATTTTACTCATAAGA
TTTATATAAAATCTTGAATTTCCTGTGATAGCTTTAGCGATTTCTTTATTATATAGAATA
AAATGTTTATTTCCACAAGCTCCATATAATGAGTTAATTAAAATCTTAAATGTCAATTGA
TTGACATCCAATTCAGTTGCTAATGCTTGGTATTTTGTATTAATTCAGGTTCTTTAGCA
TCTTCAGCCATTTGCTCATATTTTAACATTTCTTTTTTAGCTGCTTTTCTAAGATTGAAA
ACTAATTCTGTTAATATTGGTAGAATACCTTTTTTAGATTTATCATACACAGATCCAGTT
AATGATCCGCAATAATTATACTTTATAAGTAAATCCGTGTATTTTTTATAAGCTTCGGGA
TTTTTATAATAATTATTAATATGATATTGTTCATCTTCATTAAGATCTAATTCATTTATA
GCTTCTTGTAAATCATTTGGCAATTTATAAAAATGGTATAAATGTTTCAGAACTTAAATTA
AATGCCATAATTTGACTAGGATACATACTGGTAACGTCCGCTGAAAAACCCAATCATAT
CTACCAATTAATGGTTCAGCTACAAAGCCCCCTTTAAATTCTACATCACCACTAAATTCA
CTTGGATTTGGTAATACTATTTTATCTTGCATTGCATAATTTCGGATAAATGTACTCCAA
```

FIG. 15AJ. Continuation of (CJLB-13-1 [organism=Campylobacter phage CJLB-13] partial genome contig_1)

```
GGAGTTGTTGTTCCAAGTGTTTGAGGTAATTGAATACCCATAATAGAAGCAATACTAATC
ATAATATCAGATAATTTAATTGCATTATCTATTCTATATAATAAGTATGTATCTATAATA
CTATAATGAATAAAATATTCTTTAGAAATTCTTTTTATTTCTTCAGAATCTTTAGCATTA
TAAAGTTTATATTCTAAAATAGATTCTTTGCTAGGTCAACTTCTGGTCTAATAAATCCT
TCACCGGTTCTAAAACCATCAAAAGTTTTAAAACAATCGTGATTAACTTTTCTTTCACCT
AATTCAACTTCTGCAATATAATCTAATGAATAAGATTCTCTCGGTTTAAGTCTAAACTTC
TTATAGATATCTATAGTATCCATATAGAAAACACCGGGCGCTTTTATACTGTATTTTTA
GTTCCATTATCTAATTCATTTATTTGAAATTCAGATTTTCCAAATGGACTAAATCCTTCA
GTTAAACCTAACTTTTCAGTTCTTCTCCAAAGATAAGCAAAGTCAAAACCTTCACCATTG
TGAGCTAATACTAATAAAGGTTTTAAAGCTTCTATAAGTTTAAATAAAGCAATTAATAAA
TTATGTTCACCTTCTACTTGATAGTATTTAAGTTTAAAATCATAAGTCCTATCATCGAAA
ATATATTTAGAATCTTTAGTATGAGCTTCGGTGTCAAAGAACTCATTTGTAAAATATAA
TTTGTATTCGTTAAGTTATGATATACTTGAATTGAAACTATTCTTTCTCTACAAGCTTCG
GTGTCAATAGGTGAGTGTGCCGTAGTTTCTATATCCAGATAAAAAATACTTATATTTTA
TTATATTTTGAATCATTGAGTTTCCAATAGTTCTGCCTAATATGTTCAGCAGCAATATTA
GTCTTACCATAAGTTTCTAAATCTTTAGCTTGATTAGCTTGAACTTTTGTTAGTTTAATA
TTTGGATCTAATAAAAATGTATATTCTCCTTTAGGATCCTCAATAAAAACTTGATTCTTA
AGAAAGACTTTTTGAATTTCAGACTTATTAGTTTCTGTATTATAGAATCTTTCATAAGTT
TCAAAATTACCTAAATTGAAGCAAGCTTCGAATAGTTTCATATTTCTCCTTTGGTTCTAA
TTTTAGTGACTTACACTAAAGTTCTAAAATTAACACTAAAGTGTTGTTGCTTTACACTTT
AGTGTAAACGATTAGAATATTATAATATATTAAAACTTAATAGTCTATAAATTAAGAACT
AAAATGTTTTAGAACTGTTGCGGCTTCTTGAACTGCTTGTTACGATCAACACAAGCAGA
ACATTCATTACAAGGTTTATTACCACCTTTATAGCAGCTGTAAGTCCAATCGGGTTTAA
ACCATTAGATATACCACGGATTGTCAAATCAGTTTTTGTAATATTTGTATACGGTGCGAA
TACCTGAACTCTGTCTTCGGTTCCTGAACCAATGGCTTTAAACATAGCATCGATAAAATC
ATATCTACAATCTGGAAATACGTTAGAATCACCACTGTGGTTTGCTATAGCAATAAATCT
ACAATCTTCTGATTCTGCTATACCCGTTAAGATACTTAAGAATATACCATTTCTAAACGG
AACAATTACATTTGAAACTTCAGTTGAACCAGCTTCGGGAACTGCTTTAGAACCGCTTAA
TAAAGCACTTTTAAAAGTTCCAAAAGCTTCTGTTAAATCGATTATTCTATGTTCGATTTC
AGCACCTAATTTATTTACTTCATCCAAGACTTTTTTAGCAGCTGCTAGTTCTTTTTCTTG
ATGATTTGAACCGTATTTAAAACTTACAGCAATCTTAATACGATCTTTAAACTCAAATAG
TAAAGCACTTGAGTCTAAACCACCACTTAGGCTTAAAACTGTATCTTTCATATAAATCCT
TTTGATTTGAAATATTGTTATTATATAAAATTAAAACTTAAAATGTTATTAATTTTTAGT
GAGTTTTTAGTATTATAGTATATACTAAAAAGCCAAGCATTTTTTATACTTTTTAATATT
GCTTTAAGTTTTAGATATAATACTATAGTATATACTACTAAAAAGCCAAGCATTTTTTAT ACTTTTTAATATT
```

```
>CJLB-13-4 [organism=Campylobacter phage CJLB-13] partial genome contig_4
TAGAGATTACATACCCCATCCCTTAAGCTCATTTTTAGTCTTTTCATTATGACAAACTAT
GCATAAACTTTGCAAATTTTCTTCACTCAGTTTCTCGCCACCTTGTTTAATTGGCACAAT
ATGATCTATAATTTTTGCAAACTTTCCACACTTCGCACAAAATGGATTTTTATTTATAAA
AGCATTTCTTAATTTTCTCCAAGCTGTGCTGTATTAAAAATCTGAACTTGCTTGTCTCT
TTTAAAACAATCATATCTTTTGTTTGCTATTTTCTTAAAAGTTTTATCACATTCTTCACA
AGTTCTTAAATGAGTTTGTATTTTCTTACCACACTTGCAAAGTTTATAAATTGTCATTTT
TGTAAAATCCTATTTCAGTTTTTTTAGAAAGTTCAACTTTAAATTCATATTTAAAATCAT
CATAAGGCTTAATCACATAACAATCATATCCTATCTCTAGCAATTTTATAAACCAATCAG
GAAGCAAAACAAAAAATTATTTCCTACTTGTTTGATTTAAAACCACTTTTAAGCTCAT
TTACATTTCTATAAAATTATCATACAAACCTAAATTACTTGCAAAAAGCTTAACGGGAA
CTGCATTAACAATAATATCTTTTTTATTAAACATAAGAAGTCTTTAAGTAATTAACAAAC
GAAGCTTTAAGGAATGATATTTTTATTTAAAAATTATAATATATAAAAAATAATAAAACT
ATTAATCAAAGATTAAATTAGCAATTATGGAATACTTATTGCTCTTTACTAAGAAAGCAA
AAAAACAAAACCATTTTTTATATTTTTATACAAACACTATTATATTAAAAAGCACTGGC
AAAGATTATCGTATTGTTTTAATCGGATTTAATAAAAGCACATATCATTTTTAATCGG
ATTTTAAGAAATATGTTTATAGGCATTTTAATCGGATTTTAATATTAAAAAATCATATTA
GAAAACTGGGTTATTTAATGGGTTACTATAAAATATAAAATATCTATTTTATAGGTATTT
AGATACTTTTTTTAATATTCTGCTAAATCCACCATTACTCTTTTTTATCAAATCCCTATT
TGCTTTAATATATTAATCAAATGCCTATAATAAAATGTTTTAAAGCTTGTTCTATATCG
TTCTTTTATATTCCAAAATGTGCTATAATGTTCTTAAAAAAGTGGGTCACTTTTCCAAAA
ATGGGTTACAAAATGGGCTACTTTTTACACCAAAATAGACACTAAAAAAGAGAGAAAAAT
TAATGGCAAAAATTAACAAACTTACCGATAGTTTTTTAAAAAGCATTAAATGCGAAAGTG
ATAAAAAATTTATAAAATTTGCTGATCCGAGTTTAAAAGGCTTATATGTTTTATTTATC
CTAGTGGTAAAAATTATTTAAAATAAGACAAGCAAATGATACTTATATAAAAATAGGAG
AGTATCCGTTACTTTCCTTAGCAGAGCTTAGAGAAACTCGCTTTAAATGCTTTTAAGCTAA
AAGCAAAAGGACAAAACATAAAAAACGCTAAAAGACTTAAATTTGGCGATATATATGATG
AAGTTTTAGAAAAATGTAAGGCTGATGGATTAAGTCTAAAAGAAATACAAAGAGGATTAA
AATACAAAAATGGCGTTTTTAAGAATTTCAAAGATGTAGATATAGAAAGCATCAAGCGTT
```

FIG. 15AK. Continuation of (CJLB-13-1 [organism=Campylobacter phage CJLB-13] partial genome contig_1)

```
CACATGTCATCGAAACACTTAAAACCATAGAGCATCAAATCCCTACACTTATAAAAGCTA
AAGGCTGGATTAACAAATCTTTAAATATGCTTTGCAACTTGAAATCGTAGAAAATAACC
CTGTGACAAGTATTGATAATTCCATAGTTTTTAAAAAAGCTTCAAAAGTAATTCATCAGC
CAACTCTACTAGAAAACGATAAAATTAAAGAATATATATTAGCCTTAAAAAATTCAGATC
TTAAAAAAACACATAAAAATCTAATGCTTTTTAATCTTTTGACTGCACAACGCCCCGGTA
ATGTTATAAAAGCAACTTGGGATGAAATTGATTTAAAAAATGCTATATGGACTATTAAAG
CTGAAAAAATGAAAATGAGAAAAGAACATATTATCACTTTAAATTCTCAAGCGCTTAAAA
TTTTAAAAGAACAAAAGAAAATGAAAGTCAATGATTATATATTTGCTGGAAGTTCAAAAA
ATGGGTGTAATAGCGAGAATATCACCTGTAATATCAATAAACGACTAGGATATAAAGGTA
TTCAAAGTGCACATGGCTTTCGTGCTATGTTTAGAAGTTTAGCCAACGAACATCAATTAG
ATCATGGTGTGAGTATGGATATAGCCGAGCAGTGTTTAGCACACGAGCAAAAAAACGCCA
TTTTAAAAGCTTATAATCGTAGTGAAAATATAGAATTAAAAAGAAAGTTAATGCAGTGGT
GGGGAGATTATATCGAAAAACTTGCAGGGGATTTTTAAATCACCTTGCAAGTTTGCAACC
ATTTATCAATTTCGGCTTTTTCATATTTAAAAGTAGAACCTATTTTAATCCCTTTAGGAA
AATTAAATTTATTTTGATTTACTCGCATTCTCATTTGCGAATTTTTAGCGGAGTAAATC
CCAGATACTCCGCTACTTCTTTTGTTGATAATAATTTTTCTATCTTACCAAATTTTGCCA
TTTCATACTCCTTTCTCTAAATCAAAGCCTAATTTTGCAATAATTGCTTTTTGCTCTTCA
TAGCTTAAAAAATTGCTGATTAAAATCAAAACATCACCCAAAACAAAAGCGATTATAGCTC
GTGCTTTGTTCTAGCACTTTAATTTCTAATGTATCACTTAAACTCTCAAGCGAAGCTGTT
ATTTTCCAATTTTTATTAATAGCTTTTAACATCTCATCGTTTGCATTTTGATTAAAAGCA
TTGTCGTTTCTTAAAAGCAACATTTCTTTTATCGTTTGCTTTAACATTTCTTGCGTATTT
TCTAGCTCTTTTTCTAATGCTATTTTAGCTTTTATGTATTCTTTGAATTCTTTCATTTTT
TATCCTTTCTAACTTAAGCAAATAAGCTTCTTTCTATGTGTTTAAACATAATTTCATTAG
CACTTTTAAAAAAGTCTTTTTTAATCTCAAAGCCATAAGCTTTGCGGTTTAAATTTGTAG
CTGCTAAAAGAGTGCTACCACTTCCAGCACATGGATCTATAACAACATCACCTGCATCTG
TAAAAATAGTGATTAATCTTTCTAGTAATTTAACAGGCTTTTGTGTGGGATGTACTTTAG
GAATACCTTCATCTTTTTGCCAATCCATGCAGTTATAAATCATCTTTCCATCATTGTTAA
ATTTTGGAAGTTTTTCACGATATAAGATTAAAGCATATTCACAATTTCCAACTATTTTCA
TATTTGCTTTTAAAACTTGAGATGAGCTTTGTTTTCTAAAAACCAAATTTATATAATGAT
TAAAGCCATATTTTTTAGCTACTTCAATTAACATTGTTTGTTGTTCAAAAGAGCAAAAAA
CAATCATGCAAGGACTTTTACCGCATTCTTTAGGTTCTTTTATAAGCATTTTTGAGCAAA
AGTGCATAAATTCGCTAACTCTAAAATCATTATCTGTATCAAAAAACGCCTTGTTTGCTT
TTTTGCTTTCTCCATTTTTATTATCCCCATTTATATACCATTCAGGAGATGAAGCATAAG
CATTGTTGCCTAAATTATAAGGAATATCAGCTATTACAAGCTGTGCTTTTGGTATATTAT
ATCTTTTAAAATTTGAAAGTGGTCGTTATAAAGCGTGTGGGTGAAACATCATCACTTCCT
TTTTGATTAAATAAATTAGGCTCTTTTAAAAAGGCTATTTTTTCCATTATTTCATTAAAT
TCGCTCTGATAGTCTTTGATATTCTGATTTAATATGCTTCTTTCATCTTTAACTCTTTGT
ATAGATCTATGAATTGCTAAAGCTCTTTTGGTTAAAACTTCTATCTCTTGGTTTAACTCA
CCTTGATTTAATTCCTTTAACTGCTCTAATTGCTGATTAGTATTTTTTTTCATTTTTTAT
CCTTTTAATTATATTTTCAAGTTTTAAAAGTCCGCGTTCTAAAACTTCTTGTTCTTCTTT
ACTTCTTGCTTTTAGCTCATTTATTCCTTTTGCTGCAATAGAATAAAACACCAAATCAAT
TCGTTTGTAAAACTCTAATTTCTTTTTGTATTCTTCTCTTAGTCTTTGTAAAATGTTTTC
TTTTTCTTTTTCAAATAAAGCTAAAACAAAAGAATCTGAAAAATAAAAACAAAGTCTTCT
TTCTTTATTTTCCCCTACAATCTTTGCATCTTTAAAAAAGTATTTAAGATCATTATTTAA
AACAAGTTTTGCTAAATCATAAGCTTCTAATTCTCTTGTAATATTCATTTAACACCTCAT
TGTATAAGTTTTGCTAAGCTCCCTTGTGATCTTTTCTACTTCAAAAGTAGCTTTTAATTT
ATTATCACATTCAGGGCAAAAGCCATCTAAACTCACGCTTTTTACATCGCCTATAATTTC
ATCAAGACCTTTAAAAAATTTAGAATTTGGCACAAATTCTAAGTTGCATTTTGAACATTT
TATTGTCCCTTTAAAAATAAAATTTACTTTCATATTCTCTCCTAACTTGCCAAAGCGTAA
GGCTAAATGTCTTAGCCCAACGTGGATTGTTTAAATACTTTGTTTGCTCAAGTATCACT
CTCATATTAAAATGCCAAATTCCTATCATTCTTAAATAATCTTGCATAAGATCCAATGCA
TCATTGATATCATTTTCTATTCTATCTAAGAACTTATCCTTTATCTTCAATGTAAGCTCT
AATCTTTCCATCGCACAAATTCCCTTTTAATGTTTTCTTTGTGATAGTGCTTTTGTTTT
TCGTATTTATCATAAAGTAAAATGCGTTCTAATTTATAGTATTTACTTTGAGGATTGTTG
ATATACATACTTGTTTTATAAGTATGAAAATCGCCAAAGATTTTAAGTTTGCTAAACCTT
TCTTGGTGTTTAAATTCTCTTGGTTTAGATACTGCTAGATCATCATCAAAATCACAAGCA
ATATCCACACTATAAGCTTTAAACCTTTTTATCATTTTGCTTAAAATTTTCCACACTTCA
GCTTCTATTTGTTTACTAGGCTGATAAAGCCCATTAAATTGCACCTCTATGTAGTAATCT
TTTGCTTTTTATTCTTTTTAGAAAGCTCAAAGCAAGCCTTAGAATTATCTAATATAATG
ATAGTATTTGAAAGGCTTTTATTTCTAGGTTTTATATTGATATAACGCATTTTAAAAGGA
TAAAATTTATCATTGGTTTTTATGCCTTTGAATTTGTCTTTTGCAAATTCATCAATGCTT
TTATTTCTTGTTGTGCTTCGCATTTTTTCAAAAAGCCCCCATCTTTTAAGGTATTTGTAA
AAGGTTTTTTGTTGATAACGAAACGGAAGCTGTCGTATCCTGTGCTATGATTTGTTTGC
ATAAAATATCCTTTCAAAACCTTTTTTCATTAAAAAGCCATTGCTACTTATCTTTACAA
GTGCATAGCCACGCATTGCTAAACTTTCTATTACCTTTGCTCTTTGTGCTTTTTTAAATG
CATCATTATCTTTTTGTATGGGTTTAAAAACTCATTTTTTTCCTTTTTTAGACATTAAATG
```

FIG. 15AL. Continuation of (CJLB-13-1 [organism=Campylobacter phage CJLB-13] partial genome contig_1)

```
AGTGTTTAGGGTTTATTAAAATGTCCTAAACACTGTTAAACTGGTGATTTATTTAATAGT
TGAAATTTTTCTTCGTTTTTCTAATTTAAATACTAATATATCACAAGCTTTTTTACTTA
GCTCATCATTAGTGCATAAAATTTTAGTTTTAAGTTCTCGCATTAAACTTTCCACCCAAA
GAAAAAGCTCATCATCTCTAAAAACAAAAAGCTGATTTTTGGCAAATTCTGCTTTTAGTT
TCTCGTATTTTTCCCCTTGTATATTTTTAAGCTTAAAAACCTTTCTTTAGTCTTTTTGT
GCTTTTGTTTTTCGATTAAAAGCTGATATTTTAAAGCTTTTATTTCGTTTTCTAGGTATG
GTTTGTTACTCATTTTTAAGCTCCTTAAGTTCTTTTTCAAGCCTATAAACTTTTGCCGAT
AAAACACATAATAAAGTCGCTAATACTAAAACTATAATTTCTAAAATCATTTTTAACTCC
TTTTTTGATATAATAGAAAAGGTAAAGATGATAAGGGCTTTCGCCCTTTGCCTTAATGC
TTTCTTGCGTTGATAATGGCTGTTATCAAGCAGATTAAAGCAGTGATTAACTCGAGCACA
TCACTAGCGTTCATCTTTTACTCCTTTCTTTTATTTCAAAAGTAATTTATCTTTACTTTT
GATAACACAATTATAACATAATAATTACTAATTGTCAAGGTTATAATAATTTATTTTTAT
TTTTTGTAGATAAAGAAGTAATTTAAATTTACTTTGTGGATTAATTTTCGTTAATCCACG
CTTTAAAGTCTTTTTTGATAGCTTCTGCTTTTCTAATTTTGCTTCTAGTTCAAAAATTT
TTTTAAGCATATTAATAGCGTGTGCCATTTGAAAACTTATTTTTTCAGTAGAAATGGCAT
TTTTTACTGCACCTTCACCAAAACCTATTAACTCGGCTAACTCTTTATAAGTTAAGCCTT
GCTCTTTACAAAATTGTTTTAATTCTTCACTTGTCATTTTTCCCTTTCTTTTATTCTAAA
GATATTTTATCTTTTATGTTAAAAATTCTATATAAAATGATTTTATTTTTATCGTTTTTA
TAATACTCTAAATCTACTAAAAAATTAAATCCATAAGGATTTTTCAAAACTTCTTCGGCT
ATTTTCTCATCACTAAAACTAACATCAACCGCATAAGGACTTAAAGCATCGCACTTTGCC
TTATGTTTTGTTTATTGTCTATTTTATTTGTAGTTTTATACATCGTTATCAAAGCATTT
TCATGTATCTTTTGATATTCAATTTCCTTTTTTTCGCAAATGTAATTAGCATTTTCATAA
ATAAGCTCAGCTTCATCACTATTTATTCTCAAAAGTTCTTCACCTTTATGATTGATAAAA
AAAGTATTTTGATTTATAGTAACGGGTGCAAATATATTTTTTAAATTATTGGCATTATAC
TTAGTAAAATGCGGATTTTCTTCTATTTCTTCTATACTTTTTGATTTGATATTTTTAAAA
GATATGATAAGTTCTATAAATTCATTTAATGCTTGAATAGGTGCAATAATAGGCAAAACT
TCTCCTGCTATTTCAAAAACCAAAGAATATATATCACTACCAGTTTCAACTTTTTCTAAA
AAAATTTTACTTTGTGTTATACCGTGCTCTTTTGATATAAAACTATCCATTAATTTTTGA
AAACTTAACAAAGAATTAGCCATTATCCCAAGTTCTATGTTTTCTTCATGGATAATTTTT
ATTTTAAAATTAACAATATTTTCTTTCTCTTCTGTCATTAATTCTCCTTTTAAATTAAAA
AATCTTATTAGCCAAAGAAAAAACAAAACCTACGCTTTGCTTTATAGCTTCTTTATCAGC
TAAATCTATGCTATCTTTTAGCTTTTCGCCTAAAGTCTTATTGCTTTGCATTATATTACC
TCTTTCTTTTTCCTCACAAACAAAATAAACTTTTACATTCTTATTTTTATTGATTAAAA
GAATTTGTTCGTGTAAATTTTCAAAAGGACTTTCTAAATTGTCATAAAATTTCAATCCAC
ACACAGGACAATTTTTAATACTATTGTGAGTATCTATAATGATTTGCGTTTCACAATTTT
TGCACTCTAGTTTAAACTTTTTTATCTTGGCGATTTCTTGTTCCATCACATTCCTTTTA
CAAACAAAATAAATTCTGCATTTTTATTTTTGCTAACACTTTTGAACAATTCAGTTAAA
ATTTCAAAGAGATTATATCCTAAATTTTCATCTATAAACTTTATTCCACATTGCGGACAA
GTTTTAATAACATTACCTATTTTTGTAATGATTTTTGTATCGCAATTTTTACATTTTATT
TTTAATTCTGTAATTTTTTTTAAATTCTTATCCATATTTAAACCTTATTTTATTAGTTCA
AAAAGCAAAACCACCTATGCCACTAAATAAATCAAGATGGTTTATTTTCATTTAATAATT
CCGCATTTTCGTGGATATTGCCCACAATTTCTAGTTCTTCTAAACAAAATTCACTTAGTA
AATCTTCATCCCATTCTTCACCATCATCACCACATTCAACTAAATAGAAAGCTCCTTCTT
TAAAAACAACTTTATATTTAAAAGCTTCATCTTCAGAAACAACCTTCAAAAGAATATAAAA
TATCTCCTTCATAAATCTTATTTCCTTTTTTATCGTAAAATCCTGTAAATAGTTCTATTT
CAACTCTATCGCTTGGCATTTGAATTTCATCTTTAAAAGTTTCATTGTCTCCATATTCGC
TTAAATCTATATCAACTTGCTTTCAAAATCGCTTTTAAAATGGCTATTTGCCCTTTACCT
GTTATTTTTGTCGTGCTTACAAGTCTATCGCCATTAATGGTGCTAACAGTCGTTTCACTT
ACCTTAAAAAGTCCTTGTTCGATGTATTTTTGATAAGGTTTATTATCACTCATTAAAAAT
CCTTTTTCACGCAAGATCTTAAAAAGTCTTTTCTCGCCAATTTCAAGATTATTTTTTCG
TGTAAGATTTTTGCGTAATCTCTTATCAAAATAGCATCATTTGTGTTTTGAATGCGATTT
GCAAAATGAATTAAAGGTGCATTTTGTTCGGCTTCGTTTTTTAGGCTTTGATTTTCTACT
TGAAGTTTTCATTTTTTTCTAAAAGCTCTAATTGCATTTGCAAACTTTCTTTTAATGAA
AGCGGTTTATAACTTTGTTTTTTAAGCTCATTTTCTAAGTATTCTAATCTATCGATTATC
TTTGCTCTTAGTTCTACGCTATACCCACTCACTAAAATCAATACTTCTCTTTTTGGTAAG
CGATAATACTTGTAAGATTGCTTATTTTGTGTGTTTTGGTAGGTGTCTCCAAATTTGGAT
ATACCCCTTCAACCACTTTTTCTAAGTAAGTTTCTATATCTCTTATAACATGAAAATGC
TCCTTGCCTGTAAGCTCTGCTATTTCCAAAGAAGTTAAGCTTATTTCTTTATTTTCATCT
TTTTTAAAAAGTTCTAAATTCATTTATTCTCCTTAAAATTTTTTAGTGTTTAAATGAAGA
CTTAAGAGCCATCTTAAAAGATGGCTTAATTTAAGAAGAAATAAATAAATTTGAGGACTT
TAAAAGAATTCTCATTAGTCCTCATTTAAACACTAACCAAAACATAGGACCTGCATTCAA
AGTCTAAAAGACTTTTGGTATTTGGTAAATTAACAAAGCTTTAAAAAAGCCCACTTTCC
ACACCGTCGCCTGTGAGTGCAATGAATATAAGAACACACTAGCCATAAAGGCTAGTGAA
GCAATCTAAAAAATATCAAACCTTTAAAGTTCGCAATTGTAGGCGTTTATCCACTTAACG
CAACTTTTGCAAAAACCCTTTAAGCACACTTTTGCTATCACTTTAAAAAATGCGATTTT
AAAGTGCTTAGATAAATGTGCTTAATGAGGCTTTTAAGCCGCCTCTATCTCTTCTAATAA
```

FIG. 15AM. Continuation of (CJLB-13-1 [organism=Campylobacter phage CJLB-13] partial genome contig_1)

```
AACTTTAATTTCTCTCATATATTTTTCATAGGCTTGCTTACGGATTTCGTTCTTTTTATA
CTCGCTTTTTAGCTTTTCTATGCGTTTTATTAGTCTTTCATCCTCTCTTAAACCCAGTTT
TAAAAGGGCTATTTCAACCTTTGCATTTGTAAGATTATTTGAAAGCCAACTATTTAAGAC
ATTGTGAGCTAAATTTAGTTTTAACCCTGCTTCTGTTATGCTACTAACACCTAATTTTTG
CTTTATCGCTTGTTTCATTTTGAAACCTTTATGCTGATAATCGTTTTTTCAAAAAGTCCA
TCACTCACAGCTTCTATGCTTATCTCATCATTTGTATGTAAAAAATTAAGTCCTTTTTCA
AAAACCTCATCACTAAAATTAAAACACTTTCTAAGCTCTTCCTTTTCTTCAGTTTTTCTA
AAACTTAAAACATCTAAAATTGATCTTGCTTCTATCATTTTTTACCCCTAAAAACTTTAT
AAGTTAAAACTTGGCATACTTTATGCTTTGGTTAAATAATTATTTTATTTTGTAAAATTA
ATTATGTGTAGAATTATATATTAATTTTAAATATATGTCAATATATATTTTTAATTTTTA
TATTAATTATAAATATATTAAGTTTTTAATATAATTATAAAAATACTATGCAAGGAATTA
AAATGTCAGAAAATAAAGAAAATATTTCATTTGAGAACTATGAAAAGAATTTAAAGCTAC
AACTTGAAAGTAAAAGAAAAGATTTAGATATTCAATTGACAAGTATAATCCCTGGACAAT
TTCAAACTATAAAATTATACATGTGGCTTTGCACTTTTATAATAGCAGGTGACATCACTA
TACTTAATAACTATATAAAAACAACCCATACAGATCTATTTACTATTATTCTTTTTAGTG
TTTCAATTATATTTCTAGGATATTGCGCTTCTTTTCCTTGCTTGCCTTAAAAATAAATA
ATACAATAGCTTTTCCACAAGATCAATACGGTGAGATGTCTAAATTAAATTCAGATAATT
TAGAACATACAAATGGAATTAATGCCATGATATCTTCTATATTAGATGCTTTCGATAAAA
ATAACAAAATTATTAATAATATGAGTAAAGATATTGGTAAAATTTATGTTTTTCTTGTTA
TTGGAGCTAGTATATCTTTTTTTGCTATAATAACAAGTGGTGCACAAATCGTAAAAGGAG
AAATAATTATGTCGGACAATAAAGAAAAAGTAATAAAACCAACTCCACAAACTGGAACTA
CTACACCCATAATCCCAAAACTAGAGGAGATAAACCCGAGCAAGAAAAAAATAATTTT
TAAGGCGTAATACGCCTTAATCAAACAAAATATAATACCCGAAAAAGAAAAATACAAATA
TGAGCCAATACTCCATTTTCAAATCCTTAAAATAACATAATACAATTTTAATTTAAAACT
TGGCATACTTATTGCTTAGTTAAATAATTATTTTGTTTTTAAAAAATTAATTATGTATAGA
ATTATATATTAATTTTAAATATATGTCAATATATTTTCAAGGTTATATTTATGGAAAATT
ATTATGAATTAGTAGAAGAATTAAAAACTTTTTTTAATGTAAAAAGTTTAGAAGAAGTAG
CAGAGAGATTAGGATATAAAAAAATAATGCAAATAATTGGCGGAACAATAAACAACTTT
CAGCTCAAGCATTGAAAAAATACTATGAGTTAAAAAAGGCTAATAATTCAGTCTCTATTC
ATCACCACAAAGATACTATAACCATTCGTTATTTTCCAGACATTTGTGCAAGTGCAGGTT
TTGGCAATGCAAATGAAAATGAAAATTTTCAGCTTATAAACATAGATAAAGCTTTTCTAA
CTGATGTTTTAGGAGTGCCTTATAAAACACAATATGATATGATTAAAATTTATGGTGAAA
GCATGGAACCTTTTATACAAAATGGCTCTTTTATCATCATAGATACTACTAAAAATTCAC
TAGAAAAGATAAGAAATGCTGATGTAGTAATTTTTCGCGATAATGATAACGAGCTTTTTT
GCAAACGTATTTTAAAAAATGCTTTCGATGATGATATAGTTATTAGCAGTGATAATTTTA
ATTTTGGAGATAAAAAAATAAAAAAAAGTGCTTTAAAAAATTATGTATTTATAGGTGTAG
TGGTTTGCTCTTGTAATGCAAAGATATTTTAAATCAAATTGAAAGGGTATGAAACAAAT
GAAAAAACTTATAATCTTATCTTTATTATCCACTCTAGCTTTTGCTGATTATACACAATA
CAAACCAAGCGAAGATTTGCCAAGTATTTTACTAAACAAAACTGCTCACAAGTTTTGGA
TAAATTTTATTATATTAATTGTTATGATTATTCTTTAAAAGGCACTAAAGCCGTAGCTTA
TAGATTAGAAGCGGATAATTTAAAAGGCGAACAAATCAAAAAACGCCCACGCTTTGAAGA
TGATACAAATATTCCTAAAAAATACCGCACCACATGGAGTGATTATAAAAACAGCGGTTA
CGACAGGGGACACACTCTTTCTAATGCTTCAATGAGAAAACAACTCAAGCTCAAAGAAG
CACTTTTTTAATGAGCAACATTACTCCACAAAATCCACAAATCAAAGAGTTTGGAA
TAAAATTGAAAAAAGAGAAAGACAAGTAGCTTTAAAGCTTGGAAGTTTAGAAGTTTTAAA
TTTGGTTAATTATGACAATAATCCACAAAGAATAAAAAACAATATTGCTATTCCAAGCTC
TTACACTAAGATTTTAAAAGGTGATAATTTTAAAGAATGTTACCAAGTGCCTAATCACGA
TGTAGAAAATGAGAATTTAAGAATATATAAAGTAAAATGTGACAATTTTTAATTAAAAAG
GAGTAAAAATGGAAATTGCAGGACTTGTGTATTTATCTTTGCTGTTGTATGTGCTTTTG
AACTTTCTTATGATGCTAAACAAAGAAATATGAGCAGCTTATGTGGGGTATAGTTGGGT
TTTTCTTTGGCATTTTTGGATGTATTTTGTATTTAGCGGTTAAAAAACCTTATAGACGAG
AACAAAAAATATCTAAAATGAGAGATTTAGAATTTTTAAGAGGATTGAAAGAAAAAAGGT
GTATCAGTGAAGCCGAGTATGAAAAATACAAAGCAGAAGTTCTAGAATAGATGTAAATGA
GGATCATTCCTCATTTAACTCCTTAATCTTTCTAATCTGTATCTCACACTGTTTGTATTT
GTAAAAAAGCATAGAATAAGCATTTAAAATATCTAGTTCATTTTTGCTATTGGCTTTTC
AAGAGGACTTAATGTTAGTAGTTCTTGCGGAATTTTTACTTTTTGAATTTCTATTTTGGT
TACTACTTGTTGAGTTTGCATCCCACAACCTATCAACGACATCGTTAAAAAGCTTGGTAA
TATTATTTTCATTGCTTTTATAAATGTATTCTTTAACATATTGCACCCTTTCTTGTACTT
GATTTTTTTGATTGTTTGCTTCATTTAAAGCCTTTAATTCTGTTTTATGAATTTGATTTA
ATTCTTTTAATTTTCTTGATTATTTTCATTTATTTTTAAAGCCAAAGCTAAATCACTTT
GACTTTTTCTAATTTTGCTTGAGTGCTATCAAGTCTTAGATAAAAATACCCTGTTAAGA
TTGCCATTAAAGCTAAGGCTATATAAAGCTTTGCATTTCCAAATAAAGATTTATCATAT
TTGTTTTAGAAGTTTAAGTAAGGTTTTTATATAATACCCCTAAGGGTTAGCCGTAGGTCT
GACCCCCTATGGCTAAATTCCACCCGCGAAAGGTGGTGATATAAATGTCATACCAGAAGT
TTATAATTATAATTATACTACTTTGTGTAATTATAGTCAAGGCTTATTAGCCTTGCCCCG
CAAAAGCGGGGTGTAAACTTTAACCTACTTAAACTTTTATCTCCTTTCATGCTAATTCAT
```

FIG. 15AN. Continuation of (CJLB-13-1 [organism=Campylobacter phage CJLB-13] partial genome contig_1)

```
TTGTTATTTCTAATTTAATGTCTTCAAGATTTTTACCATGCATTAAGTCGTAAAATTCTT
TGCAAGCCTGCCTGCTTTGACCGACACTTTCATTATTATTATCCTTGGTAAGCCCAAGCA
AGATACAACCTTGTGTGTCTTTATCAGTGTTTCCCCAGTGTATTAAAATTGCACGACTTG
ATGGCACATCATCATTATAAACATTTATCATTGTATCATCATCTTTTTTTGTAATACTTC
TTAAAGTATTTTCAAATCGTGAAGGACTATGTCTTTTTAAATTATAATTTCCTTCAGGTA
TTCTTAAATCTTTGCCACTTTCTAAACCTTCTTTGTCTTCTTCCAAAGAAAAACATTCAA
AAAGAATTTTATCATCATCATCTAAAACCTTAAATTTACCAATAACGCAAGTTTTCCTG
TGTATCTTCTATTAATTGTTATTTTCATTATAATTCCTTCTTTTTATTTTTTGTATTTT
ATTTTTAGATTTAAACTCATTTTTCTTCTTCAAATTCAAATAAAAAAGCATTATCACCAT
AGGTAGTTTTATCAATTCTTTTTTTATTCCTATAAAGCTTCTCTCGACTATAATTTCAT
TTTGAACTCTAAGGGCTTTTTGCATTTTTATATTTGAAAGATTGACATTTCCATAATATC
CAGCTTGCCTATAAAAAGACTCATAGGAATTTCATTTGTAAAAAGCTCTATACTTACAC
TATTTTTTATATTAGAAGCCCAAAGACAGCATTCATTTGCATTGCCATCATATTTTTTA
AAGCATTGGTAATATTATGCCAAGCAGGATCATTATAAATTCCGCTCGTTTTGATATTTC
CTTCTATTTGATTTTTACTTGGTTTTGAAAGAACGCTAACTTCAGTATAATTTTTAGATT
TTAAACCCATTCCATCTTTAGTGATTAAAAAACTGCCTTCATTAAGTCCTTTTATAATTT
GCGTAGTGCTTGCTAAAGAATTTTCAAAACCAAAACGCAAATCACTTAAACATCCGCCAT
ATTGACCACTATTTAAATTTGTATCAAAACTAATAATAATCAACTCTTGTGCTGTAATAT
TTTCATTTCCAAGCAAATTAATCCAACTTGTGTATTTATCATCACTTGCCACACAAAGCC
AAAGTTGTTTTACATTTTCATTATAAGTTATAATTAAATCATTAACATTAGCTTTTGTTT
TTGGAGTGGGAATAGAATTAGATACTTTTATTCCATTAATGCCTAAATTTAATTTCATAT
CTTCGAGCATCTCTTCTATAATAGGTTTAATTTCTTCTTTTGTTGGTGTTGAGCCTTTA
AACTTTCTAAAAATTCATCTTGACTTTTTCCCGTGTTTTCTTCATTTTCAAGCCAAAGTT
CATAAGCACTTTTACCATCAGCTCCTTTAGCTCCATCTTGCCCTTTTAAATTTTTAAGCT
GTTCTTCTGTAAAATCTTCATAAGTAAAAGGATCTCCTTTATCACCTTTTAAACTTTCTT
GATTTTCTAAAACAACTTTTAATACAACTTCTTTTAAACTCTCTTCATTGATATTTGCAT
TGATGCCAAGCTCTTCTAGCAAGGCTTCTAGTTTTTCTTTTAATTCACTTTGTTTTATAA
AGTTAAAACTTGTTAAAACTTCATTTATAGCATTTTTAATACTTTCATCGCTTGGTTTTA
CTCCATTTTTAAAAGTTCTTTTAAAATTTCTAAAGCTTCACTAAAATCTTTATTGATTT
CTTCTGTTTTTATGGCAATTTCTCTTAAATCCACGCTCATCTTATCCCCTTTATTAAACA
TTTGATCTGATGAAATAAATTACAAGAGCAATAAAAAACAAAAATCTTAAATTTATTTAT
TTCTAAAGCTTGCATTGCTTCTTTTAAAACAAGATCAGCAAGTTTGTAATCTTTTCTTGA
TTTTGCTTTTTCACATAAAAAATCATGCACTACACAAGCACTAAAATACTCACTTTTAAA
AGGTGGAAACAAGACCAAAAAGGCGTGGAATACTCGCTCCATCAGTTTTAAAACCTTG
TGGTACAATGCCTTTGTAATTTGGCAAAATAAACTCATAATCTTGTATCACTTCAAACCT
GTCCTTATCGTATGGCTTTACACAAACCCTTTTTAATTCTGTTTTAGTCATTGTTTCCT
TTTTTTTAAAAATACTTCTTAATTCATCATTTCTTATTTGAGTAAGCTTAACAAGCCTTT
CATCCATTCTCATAAGATCTGTTTCTATAGCTTCTAGCTTGTCATTGGTTTTGAGCAAT
GTGTTTCTATAAATTTAACCAAACTATCGCTACTTGCTCTGGATACTGCAATTTGTTCTC
TAATAAGAACATTAGTATTTTGGTTTCACTTATAAGTTCTTTTGTTCTTTCCCCAGCTT
CTTTATGTAAAGTTTTATATAAATGCCATGCAATCCAGCTAAGACAAAAACCATCAATC
CTAATAATGCAGATCCACTTAAAGAACCGAGTATAGCACCTTCTTTTATTATATTTTCAG
TACTCATTTTTCACTCTCCCATGCAATTAAATTTAATTCTTCTAAAGATGTGGCATTTTT
CACTTTATTTCTTAGTTCATCATTTTTAAAAATAATACTTTCAGTATATTTAGCGATACC
AACCCCAAATTCTAAAAATTCTTCTTTGTTAAATGTAATGATTTTATTATCTTTATCAAT
CCAAGCAATATTTTCCAAAGGAGTATTATTGAGATTGCTAACATTATCTCGCTAACTTT
TCCGCTAATATTAATTTTTGCTTCCGTGTCAATTTGAAATATAGTATTTTTAAAAGGCAT
AAACAAAAGCTTTTCTTCTTTTATAGCTTTTAGTTCTTCTAATTTTAATTCTTTTAACTC
TTCTAATGCTTTTTCTTTAATCTCATAAGAAATAATATAAAGATTATTTTCTTCATCATA
AGTTTGAATTTGGCGAAGTTCTTCAATTTTTTCATTAAAACTTGGAATTTCTTCTTCTTT
AACTTTAGCAAAACCAAGCTCTTTTAAAAGCTTATCATCGCAACGACCTTAAAAAATAAGT
ATCTTGTGCATCAATTTCACCTTCTTCGTTTTGTATTTTTACATCTTTTAAAAAAATATC
ATCATATTTTAAACTTTTATTTTTAAATCATAAAACATATTTACCCTTTCTTAATTCCA
GTATAATGTTAAATTTGCTCTTGGGTTAATCTATCCCCATCATTTAAGTTCCAACCAGC
ACTTGCATTTGCACTACCGCTTTGCCAAGAACTTAGCATTATTTGCAAGTTGTTTATATT
TCCAAAATTGAATTTTTCTCTACTTTGATTTTTGCATTGGCAGTGTAATATTTACTTAA
AGCATGCAATTCTACACTAGAGTTAAAATTGTTCCATGTGATATGCAAAGTATTTGCAGA
AGTTTTATTAGACATATTTCCAGTCGTCCAAACTTCGCCTAACATAACCACTTCTTTATT
ATTAATATTTGATGGCAATACCACTGCTTGTTTATAAATCATGTCTAGCTTTAACATATA
ATTATAATTTGCAACCGAGCCTCCTAAAGATGGAGGTAAATTTAGTGCTATGCCATTATT
AGAAAGAAGGAGGCAGTTCATTTTAAGTCCTTACTAATCTTACATTATTCGAAGCTATGC
AAAAATAAGCAAAGTTTCAGTGCCACTAAATCCACTTTGAGCTATTCTAAATTTAAAAG
GGGCATTAAAAGCTACTACATTTTGACAATTATTTATGGTTATTGTTCCGCTTTTTCCTA
CTCCTCCAAAATTAGCTATTCCTATGCTTGTTCCTGCATTTGCTGTTAAATAAATGTT
GAGCTTGTCTTAAAATCTAGATTTATACTGCCAGTTGTGCCAAGATTTTTAATTCCACCAC
CATAATCTACATACCATTTTCTAGTTAAGTGATTATCATTTGTTGGATCGGCCCGAGAAG
```

FIG. 15AO. Continuation of (CJLB-13-1 [organism=Campylobacter phage CJLB-13] partial genome contig_1)

```
TTAATGCCTGATTAAAAGTATTTGTGCCATTAAATATATTATCTCCATTTAAAGTCTTAT
TTCCATTTAAAGTCTCATCACCTTTTAATCCTACTTTTTCTTTAAGGGCATCACTAAGCA
TTTTTTGACTAACCAAACTTTTATCTTTTTGTATTTGTTCTAATTCATTTTGTTTATGAT
TTAAATCTTCTTGCATCTTTGTGATTTCTTGCTCTAATTGCGTCTTTTCTCATTGAGGT
TATCTACATTTTGTGGTGGGTCTTTTGCTAATGCTTCTTCGATTTGCTTTTTAATATTTT
CTAATTCTTCCTGTTTATTGCTTAAATTTTGTTCCAGATCCTTTATTTCATTTTTGCTTG
TTTCTTCTTTTTCATCTTCTTTTTTCAAATCCCCTATAAGTGAAAGTATAAAGTTTATAT
TTTCTTTTTCTTCATTAAACCAAATAAAAGCATCAAGCCCTAGATCAGACTTTAAAATCC
AAGCTGTATCGTTAGTCACTCTTGCATAGATTAAATACTCATTTCCTTTTTTCCAAATTT
CGCCAAGTTTTGCCTCACTTGGTTCTTCTTCGCTTTCATAAGTAGGTGTATATTCGCTTG
GGTTTTCAGGGCTAGTCCAAGAATTGCCACTTGTGGTTTTAATATAAACAAGATATTCAT
CCCCTTTTTTCCAAATATCGCCAAGCGTTGCATTTTGTGGAGCTTCTTCTTGATTAAATG
CAGGTTCTAAATTCTCAGGCAAGGATGGGTTTATCCAAGCTTCATTCTTCAACACTTTTT
CACAAAGATAAAATTCGCCTACTTGTAAATTAACATCATCCATAGGCTTAAACCAAATAT
CATTAATTTTTCTTTCTTTAGGTCTTTCTTTTTGTAAGAAAGTGATTTGTGGATTTTTAA
TAAATTTAAAGATTTTAGCCTCATCAGTTTTAAACCAAGTTTCATTCACATTGGGCATTG
TAGGTTCTTCATCACTTACATAATCAAAAGGATAAACCACTTTTTTATAAAGTTCTTTTA
GCATATTAAGTTTTTCATCGCTTAAGTTTTCATAGTTTTGTAAAGCTTCTTTTACTTTTT
CATCAAAAGCATTTAAATTTTCTAAAATGTGCTCATCAATCCTATCTTTTGAAGCATAAA
GCCACTCTCTTATGGCTGTAACATCCTTAGTAGCTTGACTTAGCGTAGCATAAAGCTCTG
TGCTTCTTATTTTTGAGTTATCAAGCATTGTTTTCTCCTTTTAAAGTTAAATTAATTTCG
TTTTGTGAAGAGAGTATGTTTGTGATATTTTCTAAAGCTTTTTGGGCAAGGTTTATATCT
CTTCTTTGTTCTTCTAAACTCAAATTCACATCATCTAAATTTAGGGCTTCTTCTTTTCTT
AGTTTAATAAAACCTCTTTCCATAATAAAGGCGTTCTAAGCTTAAGCTATGAGTTAGAGAT
TGAGAAATAGCGATATAATCAGCTCCAACGCCATTGTCATTTAATCTTTCTATCATCTCA
TAGCCTTTGTTTTCAACTATGGTTAGGCATTCATCGGTAAATTCTTTTAATCTTTCTTTA
GCTTTTTGCTCTAAAACATTTTGAAAATCTTTGCAAAAATTTTCTATTTTTAAGATATTT
ATATTTGTTTTACTGTCAATTTGCTCTAAAGCCAAATTAGTATAAGAGATCATATTAGAG
TTTAGCTCTATCAAGGAAGCACTTAATATATTTATATCTTTAATAAAATCATTAAGTTCT
TTTGAAAAAGGAACAAGCGCATTAACAAAGTTATTAGCATCCTTGTCAAAATCAACAGGA
TTAGCCATATCAGGTGCTTTAGGTAAAGTATTAATGAAAGATATTTTATTCATTGAAATT
TCCTTGCTTTTATTTTTAAAAATTTCTTGTTTTGGCTTTCATCTTCCAAGCTTACAATCT
CATATTTTTCATCTCTAAAAACTAGAAAATAAGAAAAATCAAGCTCTAAAAATCTAAGCT
CAAATTCATGCGTAGCGACTAAAGATAAGCCACTATTTAACTCTTTAACATCCGCACTTA
GATTTTTACAACTTGCATAAACTTCTTTAAAAAGTAAATCTTGCGTAAAATCGCTTTCTA
AAAACTCATTTTTGCTTTGTTCTTTTTTGTAAATTTTAACTCTATGCTTAAATCCATTTG
CTTTCATTGCCATTGCCTTTTAAAAATAAGCTATTTTGTAGCGAGTGATTAAAGCACTTG
AAATTTTAGGCATACTCACACCATCAAAAGCCATTAAAACATAATTTTTAAGCCACAATT
TTATGTCTTGTGGCAATTCTTCAAAACCTAAATTTACAATCATATTCCCACAACCTATTG
CATAAAGCACACCACCATTTGTTTTAAACTCGGCTTTAAAATTTGCATTTTTTAAAGCAT
TAAAAGGAGCTAAAATCACCCTTTCATTAAAAAATTCAACTTCATAATCATTTAAAGCTA
AAATGCGATTGGTTCTTGTTTCAAATTCATTCATTCCAGCTTTTAAAAATTGTTTTAAAT
TTGCATCAAAAACATCGCTATCAATTCTTAAAAAGTCTCTTAATTCTTGAATGTCTATGA
GTTCTTTTTTGCTATCTTTTAATGCCTTTAATCTCATTTTTTACCTTTTTATCTTCTTT
TTCGTTTTGTTTTTGTGGTTTTTCTTGCATTTCTTGATCTTCTTGTGGCTTTTTATCTGT
ATTTGATTTTTCATCAGTATTTTGTTTTTGTTCTTCTTGTTCCACGATTTCCACAATGCC
TTTTTCTAAGAGCCTTAAGGCTTCACTATCTTCAAGTAAAACCTCATCACCTTTTTTATA
AAAAATATTACCGCTTAAACAACACTTGAAAACTACTTTTTTCATCTTCCATCCTTTAAG
CAGGGCATACAATTTTACAAACTGCCGAATTATCCATAAGCTTTGCATCAAGTCTTAAAC
GCACTTTAATACCTATTAAATCATTTTGAGAGTAAAGCTCATTAAGTCTTGTAAAACTCA
TACTTGATCTATCCCAAATTTCATAAAAACTAAAATCTCCAAAAAATGCAGGGACTTTGC
TTGCACCAAAACCATCAACACCAGAACAATAAACTACCTTTTTACCTAAAATTGTGTCAT
AGCCATTAGCACTTAAAGCAGGTAGCCACAATGGGCGATTATCATTATCTGTAAGTTTAT
AAATAGCTTTCATAAACTCATCTCCTACAAGCCAAGTGGCATTTTACGATAAGCACTGT
CTAAACTGAAAAAGCATCTATGATATCATTGCTTGTAATACCTTGATTTGAAGCAAGTG
TAAACGCTTTTTTAGCATTTTTAAGTCCTGTTGGTTTTTATTTCCATCTCCATTAATAA
AACTTAATTCTTCTGTTTTTGAAATCTTTTCAGCGGCTTTTCGCACTATAAAACTTTCAA
GATTTGCAATGTTGTCACTCAAGAGTTCTTCGCTGATTTTAATAATACCGCCAAGCTTAT
GTGCGCCTATACTTAAAGAACTAAATTTAGCACTAACTTCAGTAAAGCTTTCCTGTTCGC
CAAGCCAAGAAAATTCCCCCATCTCATCAAAAACAGGTATAATTTGATTGCTAGAGCTTT
TTTGCACTGTAGCAATCTTTCTAATAACACTAAGATCATTTAATTTTTCTCTTATTTTAC
TTTGCAAAGTTGTAGGGACTAAAATCCCACCTTGCTCTGCTGTGCTTTCATTTAAAACAT
TTCTTTTTAAAATATTGTCAATACTTCCATTTCTTAAATAATTCACAAAAGAACGCATAT
GATTTTCTTCATTTAAATCTTCATCCTCTCCTTTAGGATTTTGTCCTAAAACAGGGCTTA
CAACCTCATTTAAATATTTTTCTCTTTCTAGCTCTGCTTCAGCTCTTGAGAGTTCTTTTC
TTTTACTTTCAAAATCTTGCATTAAAGCTTCGTATTTTGTGTTTTCTTCAGCACTAAAGC
```

FIG. 15AP. Continuation of (CJLB-13-1 [organism=Campylobacter phage CJLB-13] partial genome contig_1)

```
TTCTTTGCTCGTTTTTAGCCTTATTTGATAAAGCCACCATTTGTTCGTGTAAATTTCCTA
TTTCTTGTCTTAATTTTTGCATTGTTTTTTCTCCTTGTTTAAATTGATATTTCTAAAAGT
TTAAGTTCTCGCTCTCTAGCTTCACTTAAGGCTTTGATTTTCTTTTTTTCTTCATCTTCT
TCAAAGCGTTTTTTAGCGTTTTTATCCGCACCTTTCCAAACAGCGCTGAGTTCAAAAATT
TCAAACTCTGTAACTAGAACCCTTTTAGGCGAACTTTTTTTATCTACAACTTGCTTTAAA
ACTCTATAACCAATTGACACATCGCTTAAAATTCCATCTTGATATTTTTAAAGATATCT
AAGCTTTTTCGTCTTTGGCAAAGATACAATCACAAACTAACTCATTATTTTCAATTCTT
ATATTTTCAATTCTTGCGATAGCATTATCTACGCTTGGTTTATGATCTTTAAAAAGAGTT
TTAAGATTTTCAAATCTCGCACCTTTTACATCAAGCTCTTCTATATAGTCCCCAAGCTCC
CAATCAAAACGCAAACAAGCATTAGAATTTGAAACCATGACAAGCTTAAAGACATATTT
TCTTCGCTAACGCTTCTAAGTCTTGCGGTATCTGCTCTTATGTTTTTAAAACTCATTTTA
AAATCCTTTTTTGAAGTTTTATAAGGATTTTAGAAAATTTTTAAGGCGTTAAAGTGCGTG
TTAGAAGATATTTTTTATTTTTTAAATCAAACCTTGAATATTTAGTTTATATTGCATATA
ATCTTGATCCTCTAAAGGTGCAGAATAATCTTTTAAAATTCCAAAAGTAGTTAATTTTTT
AAAGCCCAATTCGCTTTCATCTCCTATAAATAAGGCTTTAGTATTATAAAGTCCTGCTAT
TAAATCATCATAATAATCAAAGTCTTTTTTTTCTACAGCAACTATAAATTCTAAGTATTT
TGCTTTCTTACCAGTTACTACATTTGTTACTCCCCATTCATTTGTTGAAGTTTTTGAGTA
ATTTATATAAGTGCTATTTGCAGGATAGATTGTAACACCTGCAAATTCTTTTTTCCTAT
TAAAATATGTCCTACATTACACCCTATTTTAGCAGGCTCAAAACTTATTAAAATTTCTGA
GTTAATAGGATAAGGTAAAAACACAAAATCTTCTTTATTGACTTTAAATTTGCTAAAAAA
ATATTCCCACCAAGTGCGAGATTTTTTATAATACATTGATTTTTCATAAATGATTTTGCC
ATCTAATGTTTCTATCTTTATTTTTGAAACATCTAAATTTAAAAATGCTAAAGTATCAAA
TACCCCATCTACTTTCAATTTTACACTCCAAGCTTTATCGCATTTTGTTTGAGTATTTAA
TTCATCATCAAAAAAAGCATTTTCATTGATGGGTGCAAATTTAACCCATTTATCAAAATA
CACATCAGGTTCTTCATGCGTATCTTCATCACTTGCACTTACCCAAACAAAACCTTTAAA
TTGCACTTTTTCATTATTTTTATAACTTACTTCCTTATCCCATAAAGGCGTTTCATCTTT
TTTAGCTAAATTTTGTAAAACTTCAAATTCTAAAGGTTTAATTATAGTCATCTTCTTTCC
TTATTAAATATTTTCTGCAATTTCTCTAGTTTGTTTAGTTAAAATACTTAAATCCATATT
TGCTCTTTTTACACTTTTATCTACATTGTCAATTTTTGAAGCGATTAAGTCTAGTTTTTC
TTCAAAAGAATTAAAACCTTTATTAATAGCTTTTTCAAAAGCGATGCCTATTTTTTCAAA
AACTCCACTTGCATCGATTTTTAAACCTTTGCCATTTTTTAAAGGAATTACAGCCTCAGG
ATAACCATTCTCTCCAATTAAAGCATTTGTAGGGCGTGTAACTATCCCGCCATCTGCAAA
AGCTTTCATTTTTTTGTAAGGATTTTTAATCTCATTATTTAAATCTTTATCTATATTTAC
CTGATTATTTTGATATTGCAAAAGTGCATATTCTAAATTTTTAAGCGTTGTTTCTGTAAG
AGAGGCGCCATCTTTTATAGATTTAATCGTTTCTTGTAAATATTTAGCCATAGGGCTTTC
TTCGCCTAAATACTCGATCATTTTTGCAATTTCTGCTTCACTTTGTGCAATAAGAGTTTT
TTTATACTCTTTTAACTCTTCTAAAGTCATATTAGAAGTGTCTTTTAAAGTTTGATCTAA
CTTTTCTTGTAATTTTTTATTTTCTTCTGTAATGGCTTCTATTTTATCTTGTATTGAATT
TAAATCTGCCTCACCACCTAAATCTTTCATTTCATTTGCCATTTTAAGCATTTGTAGTTG
ATACTCTGCAAAGCTTGAAGCTTGATTTTTGATCTCGTTTGCTTTTTGCGTTGCAGCGTT
TTGCAAGGCACTAAAGCTTGAACTTGTAAGATTGCCATTTTTAAAATCATTTTTAGCTTG
TTTTAAAATTTTATCGTAGTTTAGCGCCACGCTCTCGCTTGTAGCTATGCTTTGATTGAT
TAAATTAGTGCTAAAAGAACCCAAAGAACTTAAAATACCAAGTTCGCTATTTAATTTACT
TAAAAGTTTATTATTTTCATTTAACCTTACTTGATCTGCTTCTTTGCTTTCATCTTTGTT
CTCATACGCATTAATAAGCTTTTCTACCTCAGCGAGTTTGTTTAAAATGTTCGCTTGAAAA
GATTAAACCGCCTTGTTTGTCGCTTATTTGTTTAAATTGTGTAATGATATCTACAAGCTG
TTTTCTAAGTTCAGTATTACCCGTGCTTAAAAATTCATTTAAACCCTCATAACCTAAACT
TAAAAGCTTATCATTAGCACTAAAAATATCCTTTAGCATTTCTTTTTCGCTATCATTTAA
ATCATCTTTTAAACCGCTCATTAAGGTTGCGTAAGAATTCATTAGATGATTAACTTCAAA
AATACTACTTGAAATACCATTAGCACTTAAAAAGCTTTGATTGATTTGCATAAGTTCTTG
TGTTTTTTGTATGATAGAATTTAAAAGATTTTTAACTTGTTCTTGCTTGCGTATAAGC
TTGTGTTAATTGTTGCCAAATTTCTAAATTCTCAGGGCTAAAATCTTGCCTTAAGCTCTC
ATTGAAAGCTTTATTAAGTGCTTCGGCACTAAGTTGTCCTAAATCTTTAAAGCTTTCTTC
ACTTAATCCAAAAGACTAAATCCACCTGTGGAATTTCTCATCGCAGTTTTTAAAGCATA
CATGGTATCATCATAAGCTATTTTTGCTTGTTTTGTTGGATCATTTTTATAAATTTGATT
TAAAATGCTAGTTTGCATTTGCATAAAAGTACCAAATTGATTAGAAAGTTGCTGGGCATA
GCTTATATTATTTGCTTTTGCCTTTCTTGTATTGCTACAATTTGTGCATCGATTTCGCT
TTTATCATCGATATTTAAAAAGCTTTTTAAAAGTGCAGTAGGCAAAGCCGTATCAAATAA
AGAATTATTAGCGTATTTTCCAGCTACTAATTCAAACTTATCTAAATTGGCATTTAATTT
TACAAGTGTTGCGTATTGGTTTTCTAAAACACGATTGATTTCTTTGATTTTTTTATCACT
TAAATTATTATACTCTGTCCAGCTTTTTTTACTAAACCATCCTTTCTTTTGATAGTCTAC
ATAACCTTGCAAATTAGAATTTGTAAAAAAATCACTAAAATTTATATTTTCCCAAAGTTG
TAAGCCGCTTCCTGTTACTTTGGTTTTTCCAAAAATACCGCCAATGACTGATCCTAAAAG
CCCACCTACTATAGTTCCAATGCCAGGCATTATAATACTACCTAATGCACCACCTATCGC
ACCACCTGTTCCTGCGTGAGTATCAGCCTTAAAAAGCCAATCACCTAAGCTTCCTATGCC
ATAACCTAGAAGTCCGCCCATTGCTGCATTAGCTAAAGTGCCACCTATATAGCCCAAGCC
```

FIG. 15AQ. Continuation of (CJLB-13-1 [organism=Campylobacter phage CJLB-13] partial genome contig_1)

```
CCCACCAAAACCAAGAGATAAAGCATTACTTGCACCACTTAATCCCATACCCGCCAAAGA
AGCACCGTTTGTAAAGCTTGCACCAAGTCCTAAAAAATTTGCCAAATAAGCTGAACCATT
AGCTAAAAGATTACTGCCAAAAGTGCCTATTGAATTGATATAACCTTGTAAATTATCAAA
TAAAGAATTAAAGCCATTGCCTATACTATCTATAATATTTGTGCTTGAATTTTCAATAGT
AGTGCTAATATCAGAACTTGAACTTAAAAAATCACTAAAACCATCCGCATTTAAAGCATC
ACTAAAACTTATTTCACTTCCTGCATTTTGACTACTGCCAAACCAATTCATAACTTTATC
ATAAGTGGCGCCCGCTTTATCTATCCATTCGCCACTCATAATGCCATCTAATTTACTTGC
ACCCTCTATAATATTACTCACATTATTAAAAGCATTATTTCCTTTTTCTATGGTGCCTGT
TTTATCCATGACTACCTCAACACCATTAACCACACCTTGATATTTGCCATCACTATTTAA
ATTTAAACCTTGATTTTTAGCAAATTCAACAACTGAGCTAAAAGCATTTGTTTGCGAGTG
TGAATTCACATTACCAAAAGCAAAATTAGGCATTAAACCGCTCAATACTCCAGCTCCTGC
CTTAGATAAAAAGCCACTAAGTGATGAAATATAAGGACTTAAAAAATCTTGTAAAATGGT
TTTTCCTAAATCTTTAAACAAATCTTTTAAGGTTTTTATTTTCCCATTTATAACATCAAA
AAAGCTACTTTCTATCGTTTTTTGCATATTTGCTATCATTTGATTATAGTTTTTTTCTAC
TTCGCTCATGGCTTTTTTACTGTCTTTGCCCATTTGAAAATAAGCGTCTTTATTGGCTTT
TATCATCTTTTTAAAATCTTCTTCTTTGATGAGATTTTCACTTAATAATTTGCTGTATTT
GTCTCTTAGCTCAATTTCTTTTAATGCCCAAGCTTCCTGCTTATTTTCTATACTTTCATA
AAATTCAATCATTAAATTTTTAGTATCTTCAAAGTCTTTATTTGCACTTTCTAGATCAAG
ATTAATTTTAAGGCTTTCTTCTGCTTGTTTTAATTTGTTTTTATCAATGCCTAACTTTTT
CCATACTTTTAATTTTTCATTAATTTGGCTTAATTTTTATCGTATTCACTCATGCCTAT
TTGTGAAATTTCTTTTAAGGCTTCATTTTGTTCTTTGATGCGTTCTGCCAGTTTTTGATT
GGCGATTTCTTTTTCTTTTTTTAATCTTTGCTCTTCTTGTTTATTTATATATTCTTCATA
ATGCGTTCTTTGAGCTACTAAAGCGTTATATTGCTCTAATTTTGCTAAGTCTTTATTCCA
ATTTGCATTATTCGTGATTGTTGTATGGTTTCGCTGATAAGCTCATATTGTTTTCTTAA
ATTTTCGGCTTGTTCTTCTGTGCTTTGCGGTATCCTTAAAGCTTTCAAACTTTCCATGGC
TTTGCTAACACTAGCAGGGAGATTATCAATAGCTTCTAGTTTAAATTCTTGCTCCTTTGC
TTTTTTGGCGGCTTCTTCGGCTAGTTTTAAATTTGCCTGTATTTGTTCGTAAGCTTTTCT
AGCTTCTTTATTCATTTTTAGCTGTTTTCCGGTAACACTTTCAAACATATAATCAGTGCC
TTTTAAAACACTTTCTACACCTTCTTTTATATACCAAAAATCTAATTTTGATGTGATTTG
AGCTCCCAAAACACTTCCATTTGCTTCTAAGGCATCCATTTGACTTTTAAGATTTTTAAC
ATACTCATCTAATTCTTTTGAACTTTTGTTTTCTAGCTTTCTTTTTGATTGTTTTTCTAA
AGCTTTGTCAAAATTATCCCAATTCGTATAAAGCTTTTCTATAAAAGTCATCAAAGCTAT
AAGCCCAGCAGTTGGAGCTAAAGCCTTTGTAAAATTTAAAGCAGAATTTGCTAAATTACT
CATAGTGCCTTTTATGGTGCTTAACAAAGGATTTCTTTTTAAGATACTTTCATTAATTAA
AGTTTCATTTTTCTTAATCTCTTCTTCTAAATTTCTTATATTTTTAAGGGCTTCTTGTTG
GAGTAGCATTTTTTCAGCACTTATCATTGTTTTTTGGCTTGTAGAATAAAAAGGAGCTAA
ATTGCTAACCTCTTTTGCTTTTTGTGGCATAAGGCTTTGCAATCTTTCTAAATCTTTGAT
AGCATCTTTAAAGCTTTGTGCTTGAAATTTTAAATTCCTTTGATTTATAACAAGTTCTTT
CATTTCTTTTTGTTTTATTATTAAATCATCATAATCTTTTTTAACATTCTTAATACCATT
ACTAAGACTTGTAAAAAAGATGAATTCTTAAAAGAATTAAAACTTTTAAAAGCTACATA
AGCAAGTCCTGCACCAATAGCCAAATCTTTAAAAGAAGTAGCAAATTCGGTAATAGCTTT
AATGCCCGCTTTAATTTCTTTTTCATTATCTTTAATATAAGTGTTTATATCTATAAGCGA
GCTTTTAAGAGTATCAAAAATAGGTTTTGAAATTTCAGCTTGTAACATTTGCATATTAGC
TTCAAATTTTTGCATTTGCTTTTCATAGGTTTGCGTTGTGTAGTCTGTATATTTTGTTAA
CTCTTTGGTTTTTTCTATAAATAAATCAAAAAGCTTACCATTTTTCTTTGCTTCGCTCAT
AGCATCATTTGTAATACCTAAACTTTCAGCAAATCTTCTTAAATCTCCACTTGCGCTAAA
TGCCCCAGCTCCTAAACTATCCATAGTAATTGAAAGTTGATTAGCACTCATGGAAGTATT
TGAGGTTGCTATCATAATACTTTCAAAAGCTTTTTTAGCTTCATCAAAGCTCATATTATT
TAAAGCTGTGGAGGCAAAAGATTGAAACATACTTGATAAATCCTGCAAAGAATAGCCTGT
TTTAGTATGCAAATCATTAAAATCTTTAAAGGTTTTTTCACTGCTTTTTGTAGCGGCTTT
CCATTTTTCAAGTTGTGATATGGCTTTTCCTGTGGTATCAATATTTGAATGCGTGGTGGC
TGTTATAAAAGCAAGTTGAGTTTTTGCAGTCTCAAAACTTTTACTTGCTTCTATAAAAGA
GCTACCAAAATTTTTTATATCAAGTGCTAAAGTTTTATAACCCTGATAAGCTTGTGTTAA
ATGGGCGTTCATGTCAATTACGCTTTTTGAAAGTCCTAAAAAGCTTTTTCTATATCTTT
TATGTATTTATTTGTTGTTTGTGTAGCATTTCCTAATTGATTAAAACTTTTATTTAAACC
TCCAATACTCGCTACACCGCTATTTGTATCTACGCTAACGCCGATTTTAACATTTTTAGC
CATTTATGTTCCTTTTAGTTTTTTTGAGTAGAATTTAAGATAAAAAATGGAGTTTTTAAA
TTATGTTTTTTCCATATATAGAGCTTAATTTTTTTGCTTTTGTTTTTATTTGTTTTGTCT
TTTTTCTGATGTGGAGCAAAAGCCAAAAAATATTTAAAAATGAAAAATTTCTTAATGATT
ATAAAAGTTGCGAAAAGAGCTTATCGCCTTTAAAGAAGCTCATGAAAATTTCATAAAAA
CAAAGCAAGGTAAAGTGTGCTTATGAGTGCTTTGCTTTGGAATTTGCTATCAAAAATA
ATGCTTTTGGCGATGATTATACGAAAGAATTTAAGCAAATTTTGCAAAATTATCCAAACG
AAAAAGAATTCAATATAGAAATAAATCATCATCTATCCTAAAAGACTTAAAAAGTCATCT
TGTAATTTTTAATATCGATTTTTTGATTTTCGTTAGTATTTTGCTTAGTATGTTTTAAA
TGAGAGCATAATAAAAAGTCTTCATTAGTCGATTTTACACCCATAAAAGAAGCTAACATA
TTAAGTAAAATACTCATTTGCATTTCGTTTCTATCACTTGCTAAAGGCTCGGTGCTTAAG
```

FIG. 15AR. Continuation of (CJLB-13-1 [organism=Campylobacter phage CJLB-13] partial genome contig_1)

```
AAATACATCCACTCGTTAAACTCACTTTGTGTTATACTTTGTTCTAACTCGCCTATGGTT
TTTCCTAATGCAAGGGCAAGGCGATAAATTAATCGCCCTTGCTCTCTTGCTTTGGGACTT
CATTTGTAAATTTTAAAATTTCGTCTGCGACTTTTGCGATAATGTTTAAACCCTCTTGAT
TGAGATTATCAAAGGTTTTTTCATCGATTTTTGGAGCTACTAAACACTTTAAGATGATTT
CTTTTCTAAAATTTGAATTCTTCTTAATAAAATCGATGCTGATTTTATCATCTTTATTTT
CTTGTATTTCTATGCCATTTTTTTCCATAATCTCTAATTGTTCGAGCATAGAAAGTTGGC
GAATTGTGAATTTTTCATCAATACCTTCGATTAAAATTTCTTTTTCTCTTAAAGAATGTT
GTTTTAAAAAGTCATTGAATTTCATTTTTTACCTCCTTTCTTAAAGCATCGCTAAATTT
TCCATTTAAAAAAGTTTGCATTGTGGCTTCACTTGCTATGCCTGAGCTTTGATCTATGGT
GTATTTTTGCGAATATCTTCATTTGCAGGATAAAGAAGTGTTAAGGCGTTTGGATAAAA
ATATAATGTTTTCCTTTTAATTCCTCATAAGTCTGCCCTTGTTCTGGTTCGGTTTTGCT
TTCATGAATAATATTTTCATCATTTTCTTTTTCCCAAACTTTATCAGCTTCTTTTGTGGT
TATAAATTCATTGTTTTCGTTAAAAGTTTGTGTACTAGGATTTGGTACAACACCTCGCAC
CTCATCAAAACATAAACCATTCTTTCATCGTTTAATTCTGGTTTTTCAAGTGTGCTTTC
TTTTGGGTAAAAATAAATAATTTTACCTTTTTTATCACTCATCACATCGCCCACATTTAA
AGCTTTTGTACTGTGTTCTATATTTTGACTTTCTTCAAATCTAAAAGGTGTGATGTCTTT
AGCTTCGCCTATTTTTTCTGCTGTGATATTTGCACTGAATTTATTATTTGCTTCGCTTTG
AAGCTCAAAGCCTGTTAATTTCATTTTGATTTTAAGCATGGTTTTTCTCTCATCATTAAT
CTCTACGATGATAAAAACTTCTTCATTTTCTTCAAAAGCTTTTTCTAAATAATTTACCCC
CTCATAGCTTTCTAAATTACCATCTTTAACAAATTTATAAAGTAAATTCATATTTACAGT
AGCTGAAGTTTTTTGCCCACTGCGTTGATTTCTTCATAATCTCTATCGTTGATTGGGCT
TAGTTTTTGACTTTCTCTAGTTCCACCTTTAAGACCTGAAATACTTGTTAAAAATCCTGC
TTGAATAGCTTCTTTTCCTAAACTTTCCATAGCACGAGATAAAACTAAAACTCTAAGCCC
TTGCACATCAGGGGCATCTGTAATTATTTTGTCTTTTGACATCTTTTCTCCTTATATAAG
TAATGTAAGGAGATTTTATAAAAAGTTTAAGGCGTTAAAATGCGTATTAAGAGATATTTT
TCATAAAACTATATTTTTGTATTTTATTTCTAATTTTTTGTTGATGAAAAATTAACTAT
TCTTTGTCTTGAAGTAGGACATAGAAAAGAAATTTATAAACGATAAGTGATAAAAATCTC
ACTCGTAAAAAATCCACTCTCTTCATCTTTATCTTCTCCATGTATTAAAATTTCAATAGG
TTTTTTATAAAATTTTAAAATAAAACTTTCAATTTTGCTTTTTAACTCTCTTAAATCTTT
GTATTTTGGAGTATAAAGGCTCAAATTAATTTCTAATTCTTTGCTTAAGATTTTATCATC
TATACTTAAATTTAATTCTTCGCTTGTGATTTCATAAATTAAAAATGCTTTTTCTAGCTT
TGTTTTTTGCCTTGAAAGTGGGTAAATTTCTATATTTAATTCCTTGCTTAGTCCCATTAA
AAAATCGCTTAAAAATTCCTTCATTTAAAATCCTAATTTGTCTAACTCAGCATTTAGTTT
TGTTGTAACCAAGCTTTGCATTTTTGGGTCTATTTTCTCTTTTGCTTTTTGCATGGTATA
AGTGCCTTTTACAAAAGTGTTTTTTCCGCTTATATTGGTTTTCCTTTTGCACTTTTTTT
CACTCCGCCTTTATGAAAAAATCCATACTCTATAAAATGAGCATAATACGCACTCGCAAA
ATAATCCATTCTTTGTTTTCTCTCATTTTTCTTTGCTTGTGTCCATTTTTTAGCATTTTT
TAATTTTTCAAATCTTTTTATACCTACTTTTTTCATTCTAAAAACAACCGAAGCAGCACG
ATAAACACCTTTTTCTAAAGTATAACTAGAAACTGCCTTAACACTTTGCTTTAAAAGTCC
ACTTTGTTTAGGAATATTCTTTTTATAATCATTTGTGATTTCTTTTGCTACTTCTAAAGC
TCCTTTTTTAGCCGCATTTGGCAAAGCTTTTTTACTTATGCTTTGCAAATCTTTCATTAA
TTCGTTCAAGCCTTTTACTTCTATCATTGATTGCCTTTTTGTGTGTCTTTTTCATCTATT
TTGGCGAGATTAAGCGGTATTAAATGATCGTTTCCATTATCAATTGGGTTCATTTCTTCC
AAGGCTCTTACTTCGTTTATACTCATCACGCCCATTACTTAAAGCTTTTACATAGCTTCC
CACCTTGAAGAACTATCAGCTCTTAAAATAGCGTTGATATTGAATTTAAAATAAAATTCT
TTTCTTTCATTTTGGTTTAATAAAAAGCGATTTAGGGCTTGTTCGATTTAGTTGTTAGA
GGTGTTATGGTTTGCACCATATAATTTGTCTCTTGTTGTTCGATATTTGAAAAAGTCGCA
CGACTTAAATCTCCAAGTTTGTGCGGTGGGATATTAAAAAGTCTTGCGATTTCTATCACT
TGAAATTGTTTGCTTTCTAAAAACTGGCTATTTTTATTCGCACTTGTAGTTTGTGCATAA
CTTGCTCCACCCTCTAAAATAGAAATATTATAAGCTTTTTTTTGGCTATAATTTTCTTTA
AAGGATTGTTTTAATCTCGAATATGCCTCTTCGCTTAATTCATTTGGTACAGATATAACG
CCACTTGTAAAACTTCCATTTTTAAAAAAGCTAAGTCCGTGCTGTTCTATAGCTGTTGCA
AGTTCTGTGGTATTTTGCTTTTTCTAAGCGGTGCGATACCTTTTACTCCATCTTTAGTA
TGATAAGGCACATTTAAAACCTCATCATAATTTAAAACAATACTGCCATTTTTTGAGTAA
GCTTGATAAAAATACTTTCCATTCATTTTAAAGATATTAATGTCTTTATTTTCTATGAGT
TCTATAGAATTAATCACCCCGTTTCTTTTTTTAACAGGATATAAAAACCATGCCATAA
ATTAACATTTGTACCATAAAAGCCTCAAAGAGTGTAAAAGGTGTCATTGTTTCATTTGGT
GCGATTTTGATGAGTTCATATAAGGGGTGATTAGAGGCTAGTTTTGATCCATCAGTTGTT
CTTTGATATAAATTAATGGCAAAGATGCTATGGTCTCGCTAATATTTGAGATTGCGGCA
ATTACTGCTGAAAGTTCCTCAGCTTTTATTTTATCTTCTAATAAAATTTCTAAGCTATTA
ACAAATTCATTATTTCGTGCTTTTTTTGTAAATAATGATCTTATTTTATTGAACATGCAA
AACCTTTATTTTTACTTATTTTAAAAAAAGTTTGAGGCGTTAAAGTGCGTTTTATAAAA
AAAATGATATAATTTCTCAGTGATCATAAGAATTGTAAAACTTAAAAGTAGGTTTTAGA
CTTCTTCTGATAAGGAGAGTTGGCTCATTTACGAGTTACCCCGCCATGTGCGGGGATATT
ATTTTCTTTGTTATTTTTTCTCTAATTGTTTCTAAATCTTCTTTTTTGATTTTCCATTA
TAATAACTTATTATTCTTTTAGTATCAAAGGTTCTTACTTGTGATAATAGAGCTACTTGC
```

FIG. 15AS. Continuation of (CJLB-13-1 [organism=Campylobacter phage CJLB-13] partial genome contig_1)

```
TTTCTGTTTTACTATCTGTGAAGTGATGATAAAGAAAACCTGTTTTATTTTCTATTTTG
CTTGTTAATGGAACGCCAACAAAAAGATTAACATAATCCTCAATGTATATTTTGTTTAAA
ACTAAAACCGGTCTTTTGAAGTCATTATGTTTTCCATAAACTTCACTGCCTATATTTTGT
CCTATGCTAACCCAATAAATCTTACCTATGCTTATTATTTTATTTTCTTTTATTTGTAGT
TTTTTCTTTTCATTATTCCATTTATCAAATTTATCATTACAATTTATCAAAAAAACTCCT
TGAAAAATATAATTTTACTCATTTTTACTTCTAAATTTATTAAGCTATAAAAACCTTATA
CCTCTTTTTTCATAAACATTGATTTTTGGTTTTTCTATGCTGTTTTTAGTGGCGATTGCA
GTGACTAAAGCCGAAATTGCATCTATCCTTTCACTTGATTTTTCTTATCAGGCTTTATG
TTTCTCTTGCATCTTGATCAATAACTAAATTTGAATTACACCATCTAAAAATAGGATTG
TTATTGTGATTTAAAGTTTGTTTTAAAACTCTGATTGGTATTCTTTTAAAGGTTCGCTA
ATACTTGCAAAACCTTGTCTAATCTGAACGCACTCTATATTTTCATCGCTTAACTTTTG
GCTACTTCTAAACTATTCCATGGATCATAACCTATCATTTGATATTTAATTTTTTATTT
AGAGCTAAGATATCGTTAATTAAATAGTCATAATCAACACTATTACCTGGCGTTAGAGTT
AAAAAGCCAAGTTTTGCCCATTCTAAATAAGGCACTTTATCTCTTTTACTTCTCTCTCTT
GCACTAAGTTCTGGTGCATAAAATTTAAAATCCACATGTAAGATTTTATCCACTTCGCAA
ATTAAAGCTAAAGCAGTTAAATCAGTGGTAGCAGATAGATCAAGTCCAACATAAACATCG
CCTTTTAAATCAAGTTCTTTAAAACTGCATTTTAAAAAATCATCATCTTTTATAAAAGAA
GTAGCATTTGAAGTCCATATATTTAAATGTTTTGTTTAAAACTCACCTCATCATTTGCG
TTTGCTAAAGCTTTTTGATAATATTCTCTTAATTTTTCAAGCTTTACGCCATAACCCAAA
GCAGGATTAACTTTGATCCAAGTTTTTTCATCGTTCCAATCATCATCAGCATCAGGCTCA
TAAATCTTTGCATAAGTTGATGGGTCGTTTATAATGCCATTTTTAACTTGTTTGCAATAA
TCATATTGCTTTTTCATCTCTCCAAAATGATTATATCCTGCTGTTGAAATGACTATACAT
AAAGAATTTACACGACTTGCCGTTCCTTCTTCTAAAACCTTATATAAATCCCCATTTTTG
GCAGCGTGAAGCTCATCGTAAATAAAAACATAAGGTCTTAAGCCGTCTTTTGTCTCACTT
GTAGCTGTTAGAACCTTTATAAAATCTTCAAATTTAGCGTTTTTCTTACGGATTTCTCTA
TAGGTTTTATATTGATAGCACATTTTATTTAATTCTTCTTCTTGGCTTACCATAGATGAA
GCAGCATTAAAAACTAATTTTGCTTGTTCGGTTTCATTTGCGGCACAATATATTTTTTTA
CCCTTTTCTTTATCAATAAATAAAAAATAAAGCAAAATAGCTCCGATTAACTCTGTTTTA
CCATTTTTTCTTGGGATAAAAAGCAAAGCGTAAGAGTATCTTCTGGCGTTTTTTCCTTA
GAATAAGTGGCGATGATATCGATGATAAACTCGATTTGAAAATTTAAAAGCTGAAAGGGC
TTACCGGCTAATTCGCCATCGGTGTGCTTTAAAAGAGAAATAAATAAAACCGCTTTTTA
GCTATTTTCTCATCAATATAAAAGGGCGAGTTTTCAAATTCTTTGTTTTTTTGTTTAATA
TAAGCTAAAGCGTAATTTAATATATCTTCTCTTGCTCCTTAATTTATCCATAATTTAACTT
TCATCTTCTAAAAGCACATCAAAAGCTGATTTTTCTTTTTTATCTTTTAAATTTAGCCTT
GCACGATTTGGAGAGCCTATGCCTAAAACTTTTGCTAAGCCTATAATATTTTTAGTCAAA
GAATTAAAAGCTATAAGTTCAGGCGTTACAATAGGCGTTCCTTTATCTGTGCTTGTTGTA
AAACCTTTTTTCTCCATTTCCTTGCTTGTGCATTCTAAAAAAATGAGATTTTTAACATAA
GTTTTAATAATATCATTTTCTAAAGGATTATAAATGCCTAAATTTTCTAAATCTTTGATA
GTTTTTTGTGTGAGTTCTTGCTCTATGGTTTCTAAATTTAAAGGCTTAAAATCATCTTGC
GTTTGTATTTGTTCTGTTTTATTTGCCTTTGGCTTTTCTTTTATCGAATTTTCATCAATA TACAAAATAACTTCGTTTTGT
```

```
>CJLB-13-5 [organism=Campylobacter phage CJLB-13] partial genome contig_5
ATATTTCATAGTATATACTATAGTATTAATATTCGCTTAAAATTTTAAGTATATTTTAAG
TATTTTCATAATATAATACTATCAATAGAATAAACAAAGGTTAAAAACAATGAATAAAAC
CGATAAAATGATTGAAGCTATCGAGGATACACTATTAAGTCCGGAAAATTTAGGAACACA
TTTCTATGTTTTAGAAACTATAAAAGGATTTAATTTCAGTATTAAGTTCGATAAAATAAA
TAGCTCTATTAAATATTTTACTAAAAGTAAACCAATTAATTTTGAATCTAATAAAGTCC
AAAAATTAAAGCACTTAATGATACTATTGATGAAGTTAGTTTAATTAACAAATTGGTTGA
ATTGATTAATATTAAATACCCAGAAGATGACCTATTGAGTTCTTTTTGACATTGTATTTCC
TATTGGAGTAAGCAAGTCTAATGATTCTGATACCGCAGGATATGCAGTCATAATGTATGA
CATTTTAGTCGGTTCAAAACCACTAGAATCCAAATATGAAGATTTTGATAATGTTTTAGA
TTATTGCACTTTAGCTGGTATCAAAACGAATCCAATTATTAGAATTGCAACTGATTTAGA
TTCTGCTTTAAGTGTTCCTGTAAATGGTGATTCTATGATTCCATATCTTTTCAATAATAG
TTCGGAGTCGATACCTATGTATGGCATCACCATCAGACCTTATAAGGAATTGCAATACAA
ATTAAGATCTAAAACTCATAGACTTATTATTGATCGTGAGTCTAATATGCCAGTAGG
TTCTAAAACTGAAGATTCAGAATTTCTTAAATTTTTAAACATAGAATCATTAAATGTTGT
AAAATCTCAAAATCCAAAAAATTTAGAAACAGAGCTAATATATTTATATAATAGAAAAAT
AAATGAAATAAAACACTTAAGTGTAGAAGAAATTAAAAATCTAAATCAAGTACTCACA
AAGAGTTAAAGATTTCATCTCTGTGAACTAAAACACTAAAATGTTAAGTTTAAAGAACTA
AAATATAAATCGAAGAACGAAAGGTGTAAAAATTGTCTATGAAATTTTTTGTAACCGGAT
CCAGTGGTTTCCTAGGATCTAACTTTATTAAAATACTATATTCATTGGATTCAAATCCAA
GAGTAATTGGCTTAGATGTAAATCCAGGCGAATATACTGACAAGGTATTAAAA
ATGCTAAGAAATCTGGGTTGCTTAAAAACTTAATTAAAAATAGTGATATAGTTGTTCATT
TTGCAAGCCATTTAGGCGTTCAAAATATTGTAGACAACCCAAACTTACCTTTTAAATCTT
TTAAAAATGATAAAATTGTTGTAGACTTAGCCACTAAATACAATAAAAAGATTGTATATT
```

FIG. 15AT. Continuation of (CJLB-13-1 [organism=Campylobacter phage CJLB-13] partial genome contig_1)

```
TTTCTACTTCTGAAGTATATGGTGATTCTAAAGATTACTCAGAATCCAGTGATTTAATTA
TAAGTTCTAAATTAAGATCTAATTATGCTTTAGAAAAACTTTTTATGGAAAGATATATCC
AATCAAAAACAAATAATTATTTAATAATAAGACCTTTTAATGTTTACGGTCCTGGTCAAA
ATCCAAATAATGCATTCATTGCTAAAGTATTAGCAGCAGCTTTCAATCCTAAAGAAGTGA
TTAAAATCAGAGTCGATGCTGAGCCAAAAACAGGGACTGAAAGATGCTATTGTTATGTAG
ATGACTTTAATAAAATTCTTTATAAATTAATTAAACAAAATGTCAGCGGTGTGTTAACA
TAGGAAATCCTATGGCTAGAGCAAATCCATTAAATATCATAAAAATATTCAATGATTTTG
GGTATAATATAAAATATAAATTCGAAACTATTGAAAATGAAAATGATTATGAAATACAAA
GACGAGTTCCTAGTATTGTTAAATTAAGCGAAGTTGTTCATATCGATTTTACAAATTTAA
AAACTGGTATTAAAAATATTTTGTATTATATTGACCCACCATTTTGAGATAAAATTTAAA
ACCTAAAATCAACAAGGAGTAAATATGCTAAAACATTTAATAATTGCAGGTCATCCAGAT
GATGAGGTAATTGGTTGTAGTTCTATACTACTAGAAGATTCTGTTGGTGTTCTATACATC
ACAAATGATTATAGTACTGCTAACACAGAACGTAATAAAGTCAAAGATAAATTAGCTTTG
GATTATCAAAAATGTTTAAAATATTCATTTTTTAAAATGCCTGATATTAATGAATTAGCT
GATAATATTAAAGACGTTTTAGACTCCATTAAACCAGAAAATGTTTATGTTCACCATCCA
AAAGATTTGCATCAAGATCATAAACTATTACAAAAGCAACCCTAATAGCTGCTAGAATG
AATAGAAATGATTATATTAAATCTTTAAGTTATTATTATGTTGAAAATCCATTTGAATTA
AAAGCTTGTGAATTTAAAAAAATAGATAAAGATGAAAAACTTAAGTTTTTATCTAAATAT
AAAAAGTATATACCAGAAAATCATATCAAAACTATTTTAGCTTTTAATGAGTTCGTAGGG
ATTTATAGCAATTTAGGTTTTGCGGAGCCGTTTGAAGTTGTTTATAAGCGTTCTTAATTA
CATTAAATCTAAGAAAACCAAGGAAAATAATGAGTGAAATTATAATGATTCACGAAGTAA
ATGATAAAGTTCTCAAAGCTGTAGAATCTTTAGACCCAGACAGCATAATCACATTTGATG
ATGGTTTATATACACAATTTCATTATAGAAGTCATTTTGCGTTATTTAAACGTGTTATAT
TCTTTGTAAATCCGTCCATAATTTGCGAATCTTCCGAGAAACAATCTAAAGAGTATATAC
AGTGCTATAACGCCCATAAAAAGGCATTTAAAGGCGTGTTTTGAAAATTATATGACATTAG
ATCAAATTCAGCAAATTTCAAGGGAAAATATGTATAATTTGAAATAGGTTCACATTCTT
ATAATCATAAATATTTTAAAGATTCTAAATCTTTAATAAAAGATATTCAAGATTCTTTAG
ATTTTTTTGAGAATCATAATATACCTATTAAATCATTTGTTTTCCGTATAATCAAGATT
CGAGAAACCCACATTTTACCCAAGCAGTTAAACTAAAGTTTAAAGATTTGGATATTTTTG
GTAATAACAGAGTACCTATCGAATCTAAGTTCTAAATATTAAATATTAGACTAAAGTCTT
AGATTTTAGACTTTAACAATACAGCAAATTAAGGAGCTTAAGTGAAAAATATTAAAGTTA
AATTAATAGCAGATTCTGGTATCAATGTTTTTATTGACGCTGTCAGAACTTGCTGGGATA
GTCATAGTAAATGTGATACTAATGGTGATAATGTAGGAGAAAATGATAAAGCATTAATAG
ATAGAATAGTACACAAACATAAACACCATTCTACATTAGAACATTTGTTTTATAATTTTG
AAATCACAGGAATTTCAAGACTTTGTTTGCAAGAGTTGGCAAGACACAGAATGGCTTCAT
TCAGTGTTAAGAGTACAAGATATACACTAAAAGAACTTAGAGGTGCTGATATTTCTACAT
TAGAAGATGCAAGTAAGTTTATTGTTTTAACTGATAATGAATTAGTAGATGCTGCAAGCC
ACAAAACTTAAAAGAACTTCATAACATAGTCAATACAAACGGTATTACCCAAGACTACG
CCAAGTATTGTTTACCAGAATGTTACAGAACTTCATTAAGATTTTCTTTAAATGCTAGAA
GTTTAAGAAATCTATTAGAACTAAGATTATCTAAAGGTGCTCATTTCGAGATTCGGTATT
TGGCTAAATTGTTGTTTGATGCATTACCAGATCTACACAAAGAATTAATTTCAATGATT
TAGAATATTCAGAATAAACATAAGGAGTTAAAATGTATGTTACAAAAGAAGTAGACGTAG
AAGTTGAAGTTGAATTAGATGAATTTAAAGACAATGACGTCTTAAGATATGCTAGGGATT
TAATTGAAGTCGATAAATCTAAAATAGTATTTTTTGAGGGTCTTATAGAACCAGAATTTA
ATTTTGATTTTTTAAATGATTTATATAATATAGAATACAAAAAAAATTATTTTGAATCAT
TTCCTAAGCATAAAAAATTAATTGATTTCATAAAAGCTAATTATTGATTTTAAAGGCTTA
GAGCTAAGAACCAAGGATTTAATGAACGTTTTATATAATAATGAATATATTGATTTTAC
AAAAGAACCTTTATTTTTTGGAACAGGTAAAACTCACAAAGATATGATGTTATAAAATA
TCCTATCTTTGAAACTTTGTTTAAGAAAATGGCTGGTTTTGATTGGCAAGAAGATGAAGT
ACAGTGCACTAAAGATCAAGCAGATTTCAATATCTTAAATGAAGCAATGAAACATTCTTA
TACTAGAGTGTTAAACAAGTTAATTTTCTTAGATTCTATTCAAGGCAGGGGTTTATTACA
AACTATTGGATCTATTGTTACTAACCCAGAACTAGAAGTTTGTATGACAGAATGGCAAAG
ATTTGAAATTTCAAGACATTCAAGAAGTTACACTCATATTCTTAGATCTGTTTATGCTAA
CCCAAGTAAGATATTTGATGAATCTTTTGAAATACCAGAATTATTAGAACTTGCAGATAG
TATTTCAAAACCATATGAAGAAGCTTTTGAAGCTGTAACAAAGTATCATTTAGGATTAAT
AGATACTGAAGAAGTTAAAGTAAAAGTTCTTAATATGTTAGTCGAATTAATATATTAGA
AGGTGTTAGATTTATTCTGGTTTTGCGACAATTTGGAGTATGCATTATAGCCAAGGGTT
AATGGAAAGAACTGGCAAGATTTTACAATTAATTTGTAGAGATGAAAACCTACACTTAGC
AATAACTCAAAATCTAATTAAGATATTGTCAAGATCTCCTGAAGAAGGCTTTATAAATGC
TTGGAATTCTATTAAAGATAATATAACTGATAGATATTTAGAAGCTGCTGATCAAGAGTT
TAAGTGGATTGATTATTTGTTTAGTAAAGGTGCTTTCTTAGGTATGACACCAGAATTAGC
CAAGAATTATATTAAATATCTTATTAATAAAAGATTAAAAGCTATTGGATTCAAAGAAGT
TTTTGCTGGGTTTAATAAGAACCCTATACCTTGGGTGGAAACATATATTAATTATGATAA
AAATGAAGTTCTCCCGCAAGAATCTGAAATAACAAATTATAAAATGGATATTTTAGACAC
TGAAATTAAAGATTCTGCTTTTGAAAGACTTAAGAAGAAATTAAAAATCTAAATTTAATG
CTTTGATGATATTTACTAGATCTGTAGTATTAAACTTAGTTCGTTTGTACTTTAGATCTA
```

FIG. 15AU. Continuation of (CJLB-13-1 [organism=Campylobacter phage CJLB-13] partial genome contig_1)

```
AATTTAACACTAAGTGTAAACTTCTAAGCTTGATAAATGTATAAAATATTTAAAAAAATA
ATTTTATTTTAAGTTTATTATTATAAAATTATATAAAATTAAAAGGAGCAAAAATGAAAG
ATTTAACAACAAAGTTTATTAATATTATGTTGAATAACAGCTACGATGAAGCTCTACACA
ACAAAATACAAGAAAAATTATTTAGTTCCGATTTACAATGTTCAAATTGTGACACAGGTT
TTGAATCATTTAGACTTGAACTCAATTGTTCAATTGATGAACTCAAATCAAAATTATTAG
GTTGTGGATATCTTGACGACACTGACGAGGATTTGTGGGACTTTTTTAAGTTAAAAGATT
CTGATGGTGATTCACAATGGGATAATTACGTTTACAGTTTACCTTCATCTATAAGAGAGT
TAAGCAGCACTACATTTAGAATTAAAGACGGAAATACTATTGTTTTCTACGATATGGTTT
GGGGTAACGAACAAACTTGCCATTTGACTTTTAAGAACTAGTAAATATTACACTTTAGTG
TTAACGAACTTAAACGACACTAAAGTGTAAACTTCTAAGTTTGCTAGTACTATTGAATAT
CAGTATCCTTGAATCTTGATAAAATCAATTTTGTAATATAAAATTGTGAACTTTCTATTT
TATCTATAAACCCAGTTAAAATATACTCACCAGAAATTTTAGTGTCTCCTTCTTGTGTTT
CATTAGTATTTTCGTTAGATTTAAATAATACTTTGTATTTTGTGAATATTTCTGGTGCCT
TAACAACTCCAGGTACTACTAATTCTAACTTAGAATAATCTAAAAACGATTTATAAGTAT
CAGCAAAATATTATCATCGTACAAATATTCTTGAGCTTGATATTCAAAACCATCGTGAT
CTTGAGATTCTACTGGAACATCGAAATCTAAATCTTCAAGATTAATTTTCATAACTTTCA
TTGTTTTAGTAGCTTTATCAAATGCGATTATTTGTGATTTCGGTAATTTCAGAGCTTGGT
TTGTGTTTATAATCTTCCTAGATAAAATATCATAAGGGTTGTTAGGATCTTTTTTAAAAT
CATCATATTGTATATTTTGAAGTTTTAAATTATTTGGTTTGAGTTCTTTATAAGGTTTCA
TAATAATTTTTTGTTTATCTTGAAATAATATCAATCCTTGTCTATCACATTCTTCAAATA
TGAAATCCAATACAGATTTTCGTGAAGTTAAAACGAAGTTTTCAATTACGATGTTGCTAG
ATAATTCCAATTTAACAGAATCTGGATTATATTTTAATTTTGGTTTAATATAAGTATCAT
ATATATCTTTAAAAATATCTGAAAGTTTTTTATTTTTATATGTTTTAGCTATATATAATT
TACTAAACAAATAAGATATTAAATCTTGACCTTGTATTGTAAAACTGGATTTATCAGTTG
TTTGAGTTTTATTATTTTTAACAACTTGAAACTCTCTTCTATAGTAACCTTCACTAGCAT
CTAATATAAAAGGAATAAATCGCATATCGCCGGATTGATCTAAATAGTATTGTAAATCCG
TGGTACCATTGACTGTAAAATAAGACAAGATGATAAAACCATTGAATGAGATTTCACCAG
ATTTTGTTTCTCCAGTTTTTAATTCAAGTGATTTACTTGATTTATTATTAAGAATAGATA
AAGTAAAATCTTTGACATCACAAGCGTGAGAAAATAGACTTTGAGTTCCCGGATTCATTA
GAACCTACCAAATACATCATCAGAATTTGTATAAAAATCTTTTGTTTCTTGTTGTTGTTT
ATCTTTAATAGAACTCAATTCATCGAAATATTTTTCAAGCTCGTTATGCATATCTGTATT
AGGTGTTTGCTTGTCTAATAATTCGTCAGATCTAATAACAAAATCACTTTCAAGTTCATC
AGATTTTTTAAATACATAAGTTTTACATTTAAATTTATAAACATTTTTATATTGATTATA
AAGAAATACGTTATTTAACCCAAAACAATCTAACGTAATTTCGGTAATTTCAAGAATCTT
TCCACTTGGAACGATTATTAAAGATCCTATTAAATCGTGAATTCTGGAATCTGGTAAAGT
TACATCGTATTCATTCTTAGAATTCATTGAAGATTGAACTAAATTAAATGTGGAAATTTT
AGAAACATATAAACCTATACTTGTATCTAATGGGACACCAAATTGTGTTTGCAATCTTTC
ATATTGGTCAAACTCTTCTGAATTTTCTGGCATACCAAATATTTCAAAACAAGCTCTATT
GTCCGCTTTAAAATGACTAAAATCACCAAATGTTAAATCCCTGTTAATTTTTTTGGTAAT
GATTAATTTAAGTGGAGCACCATAAAGTCTAATGAGTTCTTCGGTAACAGATCCACTCAG
ATCATATTCATTAGTATGCTGGTTAAAATTCAATTTTAAAGCCTCATTTTTGATATATTT
ATTTTAAGTAATCAAAATAAATAAAATCAAAAGGTTCAAGATGGACAGCACAGATAATTC
TAAAGTTACAAGTATTGAAACAAATCAATATATAAAAAATCCAAAATATACTACAAAGGA
AGCTATTGATAAATTTGTTCACCTATTGATCCTGGGTAGATACACTGAAAAAGATTTATC
AGATGCTTTGAACTATTGCTTAATACGTAGTACAGAAAGTTTTGACAGCATAGATTCTAT
AAAAAAAGCTATAGAAGAACTTAAGAAAGATTCAGAAGCTTTTAAAATATTCATAGATAA
TACAAATAAACTTTTAGATGCTATCCAAGATATTAATAAAGAACAAACTGCTGAAATTGA
TAAAATTAATGAATTCTTAAAAACAGCAGTAACTTTAGATACTGAACAGACTATTGTAGG
AACTAAAACATTTAATAAGATTTATGTTCCAAATCCTACAGAATCTAAACAAGCTGCTAA
CGCTCAGTATGTTATAGATTATGTTAAAGATCAATTAAGTAAAACTATTGGAGATTTAAA
TAATTTAAAAACTGAATCTAAAGATTTAATTATTAACGAAGTTCTTGACAA
TTTAAATGCTTATAAAGAAACTATAAATGAAACTGCTATTAATCAAATGATTGATACTAA
GTTAAATCCATTAATAGAAAGAATCACGACAATTGAATCTACTGCGGATTACACCAAAGA
ATTAGCAGAAGCTAATAAGCAAGCTATTGAAGATTTAAATACAAAAGTAGTTGATAATAC
TAGTGATATAACGGATATCAATAGAAGACTTGAAGAAGCTGTTTTCTATAGTAAAATTGA
TGATACTCGCAAAACTATACAACTTAAAAATTATGATAGCATTTCCGGTGTTAGTACTAC
TGGTGAAGGTATCAATATTGCTATGGTTTCTAAATGGGATAAAGTAGATTTAGGATCTAC
CCAAATTCCTATTAACTTAAATGGGTCAGAAACCAGACCAACTTATAACGATTCTAAAGA
AATAGCTTTAATGGATGATGTTAAGTTGAAAGCAGATGCTAGCAATGTTTATAATAAATC
TGAAATTGATACTAAATTAGATACTAAAGCAGATTCAAATACAGTTTATAATAAAGAAGA
TTCTGACGCTAGATTTGTTAGTTTAACTGAGAATCAAAACATTCAAGGCAATAAAGTTAT
AGAAGGTATTTGGGAATTTAATGGAATATTGTCTAAACCAAAACAATTAGCAACTACCGA
ATATGTGGTAAATTATGCTAAAACATATGCTAACCAAAAAGTCGGAGATTTGGCAAGTCT
TAAAACAGAAGCTAAAGATACAGCAGTGTCTGCTATCAACGAATTATTTGATAAGATTGA
ATCTGGTAATACAGATGAGCCAGTTGATACTTATACAAAACAAGAAATAGATGCTAAATT
AGAAACTAAAGCAGATGTTGACAATGTTTATAATAAATCTGAAATTGATTCAAAACTTGA
```

FIG. 15AV. Continuation of (CJLB-13-1 [organism=Campylobacter phage CJLB-13] partial genome contig_1)

```
TCTTAAAGCAGACGCTGGCAGTGTCTATAACAAATCAGAGATTGATCATAAATTTGAAAA
CATAACTATTGATGATATTAATTATGCGAAGTTAGGTGAGGAAAATACTTTTATTCAAGA
ACAAAACATAAAACAAGTAAATATAAGTGATGAACCTACACTAGATACCCATGTAATTAC
TTTAAAATATTTTAAAGATAATTCTAGTGGTGGTATTTCTCCAGCTGATTATGTAACCAA
GACTGAATTTACAAGTGGTATTAATAACAAAGCTGATAAAAATCATACACACGTTGTAGC
TGATATAACAGATTTAAATTTAGATAGACTTGCTACAAAAGAAGAAACATATACTAAACA
AGAAATAGATAATAAAATAGATGCAATAGTACCACCTGAAATTGACTTAACTCATTATGC
AAAGAAAGATGCAGCTAATATTTTTACAAAAGCTAATACTTTTACAGAAGCACCTTCGGT
AGAAGTAGATGCAACACTAGATAATCACGTTATTAGAAAAAAACAATTTGACAATAGCAT
AAAAGAAATAAATGATAAAGTTAAATCTGTTGTTGGTGATTTAAATTCATTAAATAATGA
AGTTTCTAAAGATAATTTAGTTAATGCTATAAATAGTGTGGATGATAAGTTCAAAACAAC
GGCTAAAACTAATGAATCAAATACATTTACAGGGGATCAAACTTATTTAGACAATATTTT
ACTAGAATCTGTTCCTTCTGAAAGAAATCACGCAGTTAATTTGGGATATATTTTAGACAA
TCCTGGAGGTATAAAACTCCCTGATCATACAGCACTTACACAGAATTCTGTTACAGAAAT
AACTTTTGGATATGCAAATCCAGTATCATATTCTGCACAAACATTAAAAAATGTATTCTT
AAAAGACATTATAGGTAATGATTATAAAGCTATTATGGCAGATAATAAGTCTTTTACAGT
AAGCCCTTCAGAAGAAACAGTTGTAATATTATCTAGAGTAGATTATTTAAACAATATAGA
TTTTAAGTTTGATATTACTAAAACTTCAGAGCAACTTAAAGAGTATGAGCTTAAAGAAGG
TGAAGTAAGAGTTATATTATCTTATGATACTGTTTCTGTTTATAGTAACGGTTACGGATA
TGGAGCTATGTTTCTAGAAACGCTAATAAAAAGACGGAGATTTAATATATGATTATTA
TTTTGGAAGTCAAAATGATATAACAAATAATAGAAAAGTATCTATAAAAATAGATAAACT
TGGCATTAATACTCCGGATATTGTAAGTATATCTATGACCACAAATGGTTCAGAAAAACT
TACAGTTAAAACTGATGAACTAAATCCTATAGAAACATTTATGATTCTGCAGATATGAC
TTATATTCATACTCCTGTAAGCAAAACTGTAGGAGATGTTCTGTATAGTAATATATCTCA
AGCAATCAAATCAATACATTTATTAGAAAATAATATATGTTCTTTAAAGCCTGCAGATAT
GGAATTACAACTTGTAAGACTTAAAGAATTTAAACAAACAATAAATAATATATTGCAATC
TATGTTTGATGAGAGCCCTGTAACTCTAAAAAATGGAGATTACATAGATGTTTCATTTAG
TGGTAGTGCAAGCTATGGAACAGGATATTGTGGGTATGTTAATATAAAAGATACTATAAG
AGATATTACATATAAAGCTTATAAAGTATCTTCAAATGCTTTTAATACAACTAGTGGAAC
TAAAGTTATTGCAGTTCTCACTTCTGATAATAGTAAAACAAATGTAACTTATTCTGATAG
TGTATCAACATTAGAATCTTATGAAGTAGCAGAAAATGAGATATTATTAGAAATATCATT
TTCAACTGCTAAGCAATATTCTGCTGAATACGGGTATGGAGCTATGTTAGAATATTGGGG
TTCTGTATCTGATTTATGTTATGATTATTATATGGGTTCAAACCTAGATATGAACTGTCC
ATTTAAAATAACACTACTAAAGATAGGAAGCTCTGTTAAAGCAGATACTATACAAATAGG
AGCACCTTCGTATTGGGCTAGTTCGTTAGTAATACACTTAAGAAAAAATACAGGAAAAAT
TATAGACTTTCTAGTTTCAACTGGTAGAAAAGTAATAGGTAGAGACGGAACTGAGAGTGG
TTCTGTATATGATATAGTAGATAAAGCTTTAAAACCTTTAAAAGTATTAACATCTGATGC
TCATCAAGAAATAAATGGTGTAACTAGATTTAATAACAAAGCTTATTTAAACATAGATAG
TAATAAAATTACAGATGATAAGCAGATTATAAATAAAGAATATCTTGATGGAAGTATAAA
GACTACAACTAAAGATATCATAAATGAAACTCCTATAATACCTTTTACAAATATTGAAGG
TAAGAATACTAAAAATATAAGACTTAAAATATATGCAAAAACTGATAGCTCTAGTTACTC
CACTGGAGATACAGTTGTAGTAAGTAATCTTAAAGTTAAGCTTAAAGGAGATACTGAGTT
TCTTAAACCTGTTGGAGTTGAAGTTACTGACAGAAGTAATCAAAAGTAGGATTAAACTT
AACAGGAGATGACACTGTATATAAAGATGATATTGCTATTACAGAAACAAAACCTTCAGG
ATTTAATATCTCAAGTATTGATTTATCTAGTGGTAGTAATGCTGTAGCTACAGTAAAAAC
AAATGGTGTATACGATTATAGTGGAGTATATGAGATTTGTAATCCTTTCAGAGAGTATAA
TAAAAAATATTGCGTATTTTTAAGTTCTGATGGATTAAAAAATCCTTACTATCAAGTAAC
TTTAGAAAGCTCTAAAGAAGTAGAAAATATACAATTACAATTATATGGAACAAGTGCTAC
CAATCCTTTATTATACTCTAAAGAATGTATAATAGAAATATACACTGATGATACACTTAT
AAGGTCGTTTAATATAAAAAATAAAAACGATAATACAAATAAACCTATTAATATTAAACT
AGATTTTAAAGATGGAGTTTCTTTAATTCCTATAGAAGAGGCTGTATATAATTTAAAAAA
TATTATAGATAATAACTCATCTATTTTATCTGGAAATGGAAAACCTTCATTTTCACTAAA
CCCTAATAAAATAGGCTCTCTATACTCTGATACAACAAATAAAGCTGTATATATGTGTAT
AGACAATACTTTTGGTGCTAATAAATGGGTGAATATAGTAACAGGTGATGAAATTAAACC
AAACCTTAGAAAAATAGAAATCACTTGTAATGTAAACTTAAGAAGTGGATATTATGCCGG
TTGTATGAGCGGTGTTAAAATAGGATTTGATAACGGGTATGCTTCTACAAAACAAATAGT
TAAAGGATTAAATAATGGTCAGATATTATGGTCATTAGACGGTTTAGGTAATCTAGCTAG
TTATTCTGAAGTAGGTTCTTTATCTCCTAGTGGTAATGCTCAAAGGTGATGTTACTAC
TACTGGAATATATAACGACCCTTCATATCATTGTGTTACTAATATATTCAAAGAGTATCT
TGGAAATGCTGACCAGTGTTCATTATGGTCTGACGCTAGCACTAAACAATTAAAAATAAC
ATTAATATCTGAAAAGTCCCTAATAAAATTACTTATGTAGGTAACGGACATTATGGTCA
GACTTCTGTATCTGATGTAAAAGCTATATGGTATTATGTAAATGATGACGGTATGAAAGT
AGAAGAGTCTGTAGATAATGAACTTGAAGTTAGTGTTAATAGTTCAGAAACAAACGATAG
TTCTTATATATGCGTTCAATATAAATTAGATATGTAAGGCTGTATTAATGATAGTGCC
AACTAAAGACTTTTAAAAGATATTATTTGGAAACATCATTATTATTTTTTGATTCATTT
TATTAAAGAAAACAGAGATATTTATATTGTCTTTATAATTATAAATAAAGTTCGATAAAT
```

FIG. 15AW. Continuation of (CJLB-13-1 [organism=Campylobacter phage CJLB-13] partial genome contig_1)

```
ATAATTGTAATTTTATATTTATAGGATTGTACAATGATAGAACCAAAAAGAGAGCCTACA
CAAGAATTTTTTGTATGTTTATTAAAAGAACCTAGATGGGCTAGTATTGAAGCCGAGGAT
TCTTAATGGCTTTCTTTCATTTTAATACCCTAAGAAAATATACTGGAGCTTTGATACATT
TATTTTCTAATTTAGAAATACAAACTATTCAAAGTAATGGTAAACCATTGTATTCTATAG
TTCCTATTCAGTATGCTAACAGGGAAAGATTTGATATTTATAGTCAATTATCTTATAATC
AAATGTTTAATGGTAATACTCAAGTTTTACCCAGAGGTATACTTTTGTTTACTGGTATGA
ATGCTAATATCAACAGAGCAAAAATAAATTTGCTAAGATATATAGAAAATCACAAATAA
TTAAAGGTGAAACTAAAAAATTAAATTATCAATTCAATTCAGTTCCTTATGATTTTACTT
ATCAAGTAATTATACAATGTCGTGGAATGAATGAAGCTAGTATGATATTAGAACAAGTCG
CTAGTTATTTTAATCCTAGTTATTGTTTAAGAATTAAAGAAGTAGATTTACCAGATTTTG
GAGATACCTCTTGTATATTAGAATTAAACTCGACTAGTGTAGATCAAGAATCTATGGATG
AATTAAGTACTAATATTGTAACTTGCACTTTTGATTTAACCTTAAGAGGTAATATATACC
CAGCAATAAAAGAACAACATTTAATAGAATTAGTTCAATTGTTTATGAGTACTGATTTAC
CAGAATCTACTGAAGCTAATCCAGTAGTCACGAGAGTTTATTCCGAAGGTTCTAAAGAAA
CAGAATCTGGTATTCAAACTTTTATAAATCAATACAAAGCGGTTATTAAGGATATAGAAT
TCAACCAAGATTATTTACTCTGTAAAATAGATTCTGAATGTGAGAAACTTATTAAATTTA
AATTTAATTGGTGGGTCAATGGCATCAAACAAGACAGCGAAATTGAAAAATTACATTATG
CACCACGAGATGGTGATATTGTAAAAGTTCAAGCATTTACTGATATTGTTGAGAGTGATA
TCTTTGAAAAAGAATTCTATTCTGATGAACCAAGATATGATTTAATTATTAATGATTTAA
TTAGGGATGAAAAATTCTTAGAATGTGATTTTACTGACAGTAATCCATCAAATATTAAAT
ATACATTTGAATGGTTTATAAACGGTGAAAAATTAGATTTAACACAACGAATTATTAAAT
ATAAATCTAAAGTTAGCTTTGATTGTGAATGTATTATTAGAAGCTCTGATGGTAGAGAAG
CTAAATATTTTAAACATTTTCATAATAATGAAATAATTTTTAAAGATTCTTTTAAAATAA
AAGATTCTATGAAACTCGAGCTCAAAACAGAGTTGAAATCTATAGCCATTGCTACAACG
ATTCAATGGGTTTCGATACTAATAATGATTCAAATGATAATTAAGGTTTAGAATGGGTAC
TTTTTCATTTTCATTATCGGATATAAAGAAACAATTAGGTCCTGGTTTAGGAGTTAGATC
AAATGCTTACTTACTAGAAGTTGCTGTAGTAGGTGCTGTTTCTAAAAAATTAGCAGTTCT
TTGCCAAAGCACAGCATTACCTGAAAGAAATATTGGAACCACTGACATATTCTACAAAGG
TAGAAAATATAAAATGCGTGGTGAAACAGACTTAAGTGGTACTTACACTATTAATATAAC
TGATGATTCTGAAATGAAACTTAGAAGAATGTTCGATAGCTGGATGAGAGAAGTAGATAA
TACCACACCTAAAGGGACTAATGCTTTAGCAGGCTTATTTGGTGGTGCTATGGGTGACTT
AATGGAGGTAGCTAATGGAACTTTGAAAGCGGTTAATGAAATTAAATCTGCTTGGGAGTT
TGATGGTGGTGTTTCTTGGCTTAAAAATATGATTATGGGCAAGCCACTACCAGCAAATTA
TCAAACAACCGTAAACATTTGGCAATTAACCAAAGTCAAAGAAAAACTATATGGGTATGC
TTTGACTAATGCTTTTCCTATTGAAGTAGGTGCAGTAGAAGTTTCTGATGAAAATGAAAA
TCAGTTATCTATGTTTAGTGTAACTTTTGCATATTCAGATTTTGAACCTATTGAAGATAA
AGGTGTAATTGGACAAATAGTTGATACTGTAATAGGCCAAGAAGGTCAAGAAATTGTACA
AGGTGTTGAAAATCTATTGGATTAAATATTCTTTAGATTTAAAAATTTTTAAGTTTTAAT
ATTATATAATATGTGAAAAATTTAAATTTAAAAGATTTAACACTGTAGTGTAAATTATTA
AAAATAACACTGTAGTGTTAATTATTGAATATACTAAAACTGCTAAAATCACTAAAAATT
TAAGAATATTTTAAGGATTAATACATTATAATAACATTGTAAAGGAGATCAAATGGATAT
TTCAATTAAAGAAATACAACCAAGTCCTGAACAATTGAAGCAATACAAAGCTCAAAGAAT
AACACAAAGAAAACGCATCGTAAAAGGTGGGTTTGAGCACGTTCTCGTAACTTCGGATTC
TGACTTAGATGGTATTCATATAGGCGCTTTATTGATGGGGTTTATAGAAAGATTTAGGCC
GGAATACAAAGGTAGATTTGGTCGGTTTAACACGCCTGTTAAAATGGTTTTAAAAGGCGA
AACTCCTATTAAATGGACTTATGACATCACGAAGAGTTACCGGTTAAATCCGGTGAAAA
TGCGAAGTATTTCAAAGGTTTAGGATCTTGGCAAAAAGAATTATTAGATTTTGTTATTAA
GAAGGATGGATTAGAAAATATGATCGATGTCTATGATTTCGATAATATTAATATAATTAA
TGACTTCTTAGGCTCTGAAGAGAGTGATAAAAGAAAGAATTATATTAGAAATCATTCTTT
TAGTATAGCAAGTCTGTAATTATTTGATTGTTTTACATTTTGGTGATTTAATTTGATTCT
AAGTTTTAAACTTTAGTTTATAATTTAAAGTTTATAATATAATAGAATCAATATTAAATT
AAGTTTTTTAATTTTTTATAATTGGTTTTAATATAATAGATTAAAACTGATTAATTTTTT
TAAAGGATATTTATGGACATTAATTTTGATTGGAATTCAATGAATGCGGGAGCTAACCCA
TTCGAATCTAAAAGTTATGAAAGTGATACTCGTTTTTATACCCTAGCAAAAGATGAAAAT
GGTAATGGTGCAGCTTTAATTAGATTCTTACCTAGTGAAGTTCACGAAAATGGCTCAATG
AGTACCATTATGAAAGTATTCAAATACAATGTTAGATCTAAAACTTCTAAAAGATTTATA
GCTGAGTGGAGTCCAAGTACAATTGGTTTACCTGACCCAATTCAAGAAAAGTGGGCGTCT
CTTTGGAATGCTGGCAAACAAGATGAAGCAAGAAGATATGCAAGGTCTACAAGATACATT
GCTAATATTAAAGTTATTAAAGATCCAAAAAACCCAGCAAATGAAGGTAAAATTTTCTTA
CTTGATATGTCACAAACACTTGGTGAGAAAATTAAATCTATTTTAACACCAAATGAACAA
GAATTAGCACTAGGTGCTGTTGCTAAAAATCTTTTTGATCCTATAAAAGGATTTAACTTT
AAATTGATTGCAACTAAAGGTGCCAATGGGTTTATAGAATATTCAAAAGTGATGCTGAA
GCAAATCCAAGTGCAATTTATAATAGTGTAGAAGAAGCAGTAGCAGATATTAAAAATAAT
GCTTATAAATTGTCAGATTGGCAAAAACCAGAAAGCTACAAATCTTACGAAGCATTAAAA
GAATTGCTAGATGGTTTGGATACACCAGTAGAATCTAACAATTTAGATTCAATGGTTCAA
GCAGCGCCAGTAACAAGTTTTGCTGAACCGGAAGCACCAACAGTACGCATTAAAACAGCA
```

FIG. 15AX. Continuation of (CJLB-13-1 [organism=Campylobacter phage CJLB-13] partial genome contig_1)

```
CCAGTACGCATTAAAACAGCACCAGATGCACCAGAAGCTAAAGCGCCAAGTGCTAACCAA
GCAGATAATCTTGATGATTTGATGGCTGACTTATTAAAGTAACTTATAGAAGCTCTGATG
GGCTTCTTCTCAAGGAAGAATTATGATCGATATCGAAAACTTTAAACCACTTCAAGATTT
TGTTCTAATAAAAACAGAACCTGTTAAATTTGAAACTGAATCTGGCATCATTACAAAAAT
ACAAAAATCAAATCTTTATGACCGACCAACCAAAGGTGTTGTAATTAAACAAGGGCCTAA
ATGTCAATATGATTTGGTTAATAAAACAGTTCAATGGGATATCACAAAAGGTCAAGATAT
TGAAGAAATTATATTCTTTTGACTGAGGATTCAATACTAGGAATTATAGAGTAAATGAG
AGCTCAGCTTTTTGAATTGCACCAAGAACTCAATATCAAGGATAATATAATCTTGTTACA
TTGTGATATGTTTCCTTATGCAGGAAAGAACATCATAAATTTACGTATACAAGAACAAAC
TATGATTAATGTAGCAGCTGGTATTGCATATACTGGCAAACCAGTTATAATCTATGGAGT
TCTTGGATTTGTTTTTCTTAAAGCTCTGGAGCAAATTAAGTTTAGTATATTAGATTTTAG
TGCGAAATATGCTCCAATAATTATGTATAATGCTGGATATACTGGGTGTTATGAAATGTA
TGGCAAAGGCCACATTTTCAAAGAAGAATTAGATCTTTGTAAAGTTTATAATATTGAATA
TTTCAAACCTAATAAAGAAAATTTTAAAGGTTTGATAAAAGATTGTTTAAAAACAAATGG
TTTCAAATATATTTTGATATATTAAATCATTAAGCTTTTAAGCTTAGCTTATAGTTATT
AAACATTTTAAGCTTTAGCTTTATTTTTTAAAACTTTTATAGCTTTAAATTAAAAATAAA
TAATTTAAAACTCAGGAATTTTAATGAAAGAATTAGTAGCATCGTGGCTAGCACGCAGAT
TTACAGATAATGACTTTAGAAGTGTTCTCAAAAATGTCGTTCTAAAAGATGTGTATAGGTA
AAGGCACCAAACGCCCAGATAATGCTACCAATTTTGTGAATACAAAAACTGGTGAATTAA
TAGAACCTACTAAAATTCGTGAATTTATCAAAGCTATGAATGTGGAGGTTCAAACTCGCA
ATAATTTCTATAAAGGTAATACCGATTATCAAATGTTTCACAAGTTCCACAAAATGGTG
TTTTGCAGGGTTCTGTAGTTTTAAGCACACCTTATACTGCTATGCAGGTTGTTTTAGAAT
CATTTGTAGGTGATGGAATTATAAATTTTGGAACCGCAGTCCAAGCAGATTTTAATCAAG
TTAAATTAAATCAAAAATCTTTATTTTTAGCACACGGTAATTATTTTGCAAGATTAGAAT
TTACAGCAAGTGCGATTGCTAATATTTCTGGTGGTGTAAGATTAACTTATAATCAGTCTC
AACTTTGGTATGATCAAGGTAGATCAGAAGTTAATATTAATTATGATGCTTTAACAAAAA
TATTAGCTCTTGAAGATTTTACTGACGTAGAAATTGGTATAGCAGATTTTAGTTCTAAGA
AAATTAAATGGTTTAATAACGTTAAACTTAAAGCAAGTACATTAAAATTCACAGTTTCTC
AAAATACAGAAAACGCTAATAAAACAGTTCAAAAACGTATAGTTTCTGGGTATTTAGATT
TTACAATTGATCAAACTATTGAAGATACAATATCTGAGAAATTAAAAGGTGCTTTGATCA
CAGCTGCTAGATTCAATAAATTCAAACAATTATTAAATAAAGCTGAAGTTGCTTGTTTAT
GTGATTGTAATTATTGTACTTGTGATTGTAATTATTGTACTTGTGATTGTAATTATTGTA
CTTGTAATTGCAATTATTGTACTTGTGATTGTAATTATTGTACTTGTGATTGTAATTATT
GTACTTGTAATAATAATAAAGAATACACTGATAGGGTTAATTATTGGCATGGTGTTGTTT
GTACTTGTAATGCGAATATTACTTGCCAAACTCAAGGTCCTGGATATACACCAGTTTATG
AAAACAAATATATGACTGAGTGTTCTTGCCAAGGGGATAGAAGTGTTCCGCAATACAACC
AATACGGTCAAATATATGGTTATGCGTGTAGATGTAATGCTAACTGGATTAATTCTGTTA
GACAACACGCTACCGTAACTCAAGTATGTTCTTGTAACGTTGATAAACAATGGACTAAAA
ATATTACAGGTAAACCAATTTGGGATAAAAAATCTACAGGTCAAATCGATAATATTGTCA
ACAACAATACTTCAAATTCACAAACAAGTACTACTGTAAGAGTTTGTGTTTGTGATACAA
ACGTCACAATAGCTGCACAATGTGCTACAAATAGAACAATGGCTTATGTTGATGGGTCAA
CTGGAAGTCAAGGCGGTTACAGATGTGTTTGCGATATCAACACAAATAGACAAATTGCTT
GTTCTGCTAATAGAGAATATAAATATGTCACTGACTATACTCAATTTCAAAACAAACAAT
ACAATTAAAACTCAATTAACATATAATCAGCTTGAAGTTCTTAAAAAGAGCTTCAATGCT
TTTTAAAAATTTAAGATCAGAGATTTAAAACTAAAGTTTAAATTTTAAAATATTAAAGCA
TTTTTATATAAAATTATACAAATAGATATAATTTTATATCAAATATTATATATTCTGGAC
TTAAAAGTATATTAAACTAAATAAATATAGAAATTATTTTAGAATTTTCAAAAATTGAAA
GTTTTGAAATTTAAATATAATAAAACGAGAAATAAAGAAACTACCAATTTCTTTATTTCT
CTAATTTTAAACATAGGATTGATATGTCTAAAACTAAAAGTATTTATAATGAAGAGATAC
AAAATATTATAACAATCAAGCTAGACTATAAGTCTTCTGATACAGAAAGAATACTTGATT
GTATCAAAAACTACAACTCTCTTTTTAGATCAACATATTCATTTTATCAGCAAGTTCCTG
ACTTAAAACAAGCAGAAACAACAAGACTTCAATCTAGATTGAATAATATTTTTCTTGATA
AGTGGTTTTTAACTCAGCTGTTTTGATGTTAAAAGTTTTAAGAACAAGAAAAAGAAAG
ATGAAAAGTTATATTTGGTGGTAAAAAGAATTTCTTTGATAGATTAAAAGGAAAAATTT
CAAGAAGAATACCAACTAAAAAGACTGCTTCCTCTATATAGTGTAGGTGAAGCATCTA
AGAATGGAAATAGAAATCCCAAATAGAAGATGAAAATACAATAATTTTTAAAGTCTCAA
GAAAAGAACATATCACTCTAAAATTAAATGGAACTTCTAAGAGATATAGAGATTATTTGA
ATCAGCTGATTACTTTACAAATAAACAAATCTATACCGATAACCTACAAGCTAGATACCA
AATATGTTTATATCAGCTTCGACTTGAATAAACTCAAACACAATTTAAAAGTACAAGATA
AGATTAAAGACAGAGTATTTGGTATTGATCTAAATCCCAACTACATTGGATATTCAGTAG
TAGATTGGAAAAACGATGGATCTTATAAAATCATAAAAACGGGTTCTATTTCTTTAAAAG
CTCTAAATGATTATGATGATTCTTTAAAAGGACAAGGGTATTCTGGACAAAGTAAAGAAA
GAAAATACATTTCAAATAAAGAAATCACGAAATCATACAAATAGTCCATCAGCTATCTA
AGTTAGCAATCATTTTGGGTGTGAGATTTTTAGCTTAGAATACCTTAATACGAAGCAAG
GAGATAAAGAAAAAGGAACTAAGGTTCAACAAACTCTGTAATAATCAGTGGTGTAGAAGTC
TTTTAGTTTCACAAATAAAGAAAATGAATTGTCTATACAAGATTAGAACTCTAGAGGTTC
```

FIG. 15AY. Continuation of (CJLB-13-1 [organism=Campylobacter phage CJLB-13] partial genome contig_1)

```
AACCTCAATATAGTTCATTTATTGGAAATCTTGTATATAGAGTTCATCAGCTTCCTGATT
ATGTTCTAGCAAGTATAGAAATAGGAAGAAGGGGATATGAATTCTACCATCAATATATCT
TAAAAGATAAAAAGATGGAGAAGAATATCATCTTTGGAAACTATGAAAAGATAAAAATC
TTTATTATCTATCATTGGAAGAAATCGGTATTAAAGAGTCTTTTAATAGTTTTATGGAGA
TGTATTCTTTTGTAAAAAATTCTAAATTGAGATATAGAGTTTCTCTAGATGATATAGATT
CATCTAGAGTTTTCAGGAAACTTTTTATAAAATCTTATACGGAATTTTATAATTTTTTAT
AAGTTTTATATGAAGTTTATATCTTTTTAAGTCAAAATATATTATAATTATTTTATCAAA
GCTGTATATAAAGGAGATATAATGAATTATTTAGAACTTAAAAATATGGCGGAGAATTTA
AAAGATTCTAATTATAGGTCAACAAAATTAAACGATTTTAAATTCTATACTTATATATTG
TCAGATTATAAAAACTTCAAAGAAAATAATACTTTTTTCATAAGAGGTTTAATGATAGAT
TCTAAATCTATATTAAACAAAGATACTTTAGCACCTGGTATATCGATACCAATACCAAAA
TTCTTTAATATTAATGAAAATGAAGATTGGATATTACCAGATTCTACAAATCTTGAAGAT
TTCACTATAGTGACAAAATACGATGGTTCTTTAATGATACCTTATGAATATGATGGTATA
AAATTTAGAACTAAATGTCTATTGACAACGATCAAACTAAATTAGCTAATAAGTATATC
AAAAATAATCCAGATATATTAGATCTAATAAAAAATAATCCAGGTACCCAGTACTTTTTC
GAGTTGATATCACCTTTAAATAGAATAGTGGTAGACTATAATAAAACTGAATTAAAATTA
ATAGCTGAATTAAATCTTAGAACATTAGAATTTAAAATTCACGAAACTAACGAGTTTAAT
TTTAAAGATTTAAATATTAGGACTCTAAAAGATCTTAAAGATTATATAAACACCATATCT
AATTACGAAGGTGTTATATTGCAGCATAAAGTAACTAAAAAAGTCTACAAGTTAAAAACA
CAAGAATATTTAGACTTACATAATACTGTAACTAATTTAGATTTAAAAGTGATATACAAA
ATGATATTAGAAGAAACTATAGATGATGTGTTACCAAAATTATCGCCAGAAGCTGTGGCT
TATGTTGATTCTGTATCTAATTCAGTAAAAGTTAAGTTAAATGAAATATTAGATTCTATA
GATTCTAATTATATTAAAGCTAAAGATCTTGAAGCTCCAGCTTTATATATAAAAGATTTG
AATATAGATCCTATAGCCAAAGATTGTTTATTTAAATTATGTAGAAATAAACTTAATTTA
GACAACGTCTTAGATCAAGTTAAAAAATCTATGTTAAAATATAACAAATTGCGAGATATT
AAGGTTTTTTAAAGCTATAAATTATATAATATTAAATCAAGTCTTAAATCAATCTTTA
AAAGGTTTTTCTTAAATGAATTCATTTATATATTATATTGCAGTTTACGGCGGGATAAGT
GCGATTTTGAGTGTTTTTGCAGTATATATTTCTCATAAGTTTTAAAGGTATAAAATGAAC
ACAATTAAACTAACTTGGAATGATGTTCACCAAGCTTTGCATAATCTTACAAATGAAGTA
GATCTTAAAAATTTTGATTGTATAATAACTCCCAATAGAGGCGGATTAATAATAACTAGT
ATGTTGCAATACACCCAGGGTGTTAAATTACCTGTTTATGTAATTAATAATTCTGATGTA
ATCAATATTCAAAATTATAAAAAAGTTTTATTTTTAGATGATATTAACGATACAAGTAAA
ACAATATTTAAAATCCAAAAAGTTTTCAATGGTCTCATAACATTTAAAACATTATTTGAA
AGATATAATAGTCCATTTAAAACTGAGACTATCAATATCATCTTGAATGATGTTTGGTTA
ATTTTTCCTTGGGATATTAACCCAGAAGTTTTAAATCTAAGAAAGTGAGTAATTAATATG
CTAGTACCAAAAATAATCAGAAATTCAAAAGTTTATAGATTTATAAAAAATATCATTAAA
TTCAGAAATGAATTAATAATTTGGAGACCTTATGAGCCAATATTTGATTTAAAATTGATT
TATAAAATGCTTAAAATCAAAAGAGAATATTGGCTTGATGATTGTGGTGGGGCAGCTTAT
GAAGGTATGGAAAAAGAATTAGATACTTTAAATAGACTCTTAAATGAGTTAGACTTAGTA
TTTAAATATTCATATGATGGTGATGGCCAAACTGCTATGATCCATTTTGACATTTTTATG
GAAATATATAAGAAAATGCTTTTAAATTTTGGTGTTGATATGACAATGCGTGTTAGAAT
CTAAAAATACTAAAATATTTAAATTGCATTTAATCATAAATACTATATAATATATCTAAA
GGAGAATTATGGAATATTTACCAAAATCTCAAGGACCTAAAAAACTTTATAATTTTGATA
TTAATATGACTCAAGCGTGTACACTAAGATGTACATACTGTATTCAAGATTTTAATAAAC
AAAAATTTGAAAAATTATCACCAGAACTTACTAAAAAAATGATAGAAAAGTTTGATTTTC
TATTGAATTCAGTAGAATTCAATAAACATTATGATGGTATTAGAATTTCATTCTGGGGTG
GGGAACCCACAACTAACCTAGAAGGTGTTAAAGAGTTTGTAGAATACTATAGACACAACC
CAAAAGTTTGTTTCTTTATGTATTCAAATGGTTATAAATACAACCACGTTTTTGATTACT
TAGAAACATTTAAGTATATGCCAAATGTCGGGTCAGAACCAAAATTCTTGACTCAAATAT
CTTATGATGGAATGGCAAGTCACGATTCAGATAGACTTAATTTACAAGGTAAGGGCTCAG
CACACAAGTTAAAGAAACTGTTTTTGAACTAGCAAAAAGAAATATACCTTTTATTGTAC
ATCCTACGATTGCAGCTAAGAATTTCGATAAGATTGCTATTAATTATTTCGAATTTAAAA
GAATGTCCGATGTCTTAGGTATTGAACTTAATTATAACCCTACGATAGACTATATGTCTA
AATATGATTTTACAAAAGAACAATTAGAAGCATTGACAAATACTTTAAAAGAAGAATTCT
TAAAAATACGTGATGCTGAAGTTGAGTTCTTTAAAGAAAAGGATATTTAATTTTGGTT
GGATGAATCCAAATAGAAGTATTTGTACAGCAGGTGATGGCTATTCTGGTATTGAATTGG
ATGGTAAAATGTATGCTTGTCACGGTGTTTTTAGTGAAGAATATAAACCAAATAATGTTT
TAAATGATATTAATTTTGAGAATGTAAAATTTACTGAAACATTGATTAAGAGCTCACAAG
ATCATAGAAAAATATTAAATGAAAATATGCCCAAAGCTTGCCAAGAATGTTTTACACATT
ATTGTTTAAAATGTAATTCTACAAAATTTGGTATTTCTAATAAAGAAACCTACGCAGAAA
GATGGACTGATTATAGTTGCCAACCTGGTTTATGTTATATGTTTAAATTCATAGGTAAAT
ATAGAATAGCTTTGATGAAATATATTCAAGCTTCTTAGAATTCTAAAATAGTTCTAAATT
GACACTATAGTGTTCTATTTTAGAACTATACTGACATATACCAGAATCCAAAAATAAATA
TACAAAAAGTAGGATTTATTTTGAGTATAATAAAATCAACTGCTAGGGGTATTAGAGGTA
CTTATAGAGCAGGCAAAAATGCAGTTAATAGTGTTAATTCTGCTTATAATAGTGCTGTTA
GTGGTATAAACAAAGTAAATTCTGCTTTAGATCCTATGAATACAGTTAGAAGTGCTACTC
```

FIG. 15AZ. Continuation of (CJLB-13-1 [organism=Campylobacter phage CJLB-13] partial genome contig_1)

```
AAAGACTCAATAACTGGATGGATTCGGATTCTAAAGTATCTAAGACAACTCAAAAAAATA
ATGATTCAATTGTTAGTGAATTAAACAACGTAGCCAATGAAGTTGTTAGTGCAGCCAAAG
CTTTAGATCCTATGAATGCTAGAAAATTAACAGAAATTTCAGAATCTCTTAAAAATATTT
CAAAACAAATCTCGGATATTAAAAAAGGATTAATAGATAATCAAGATACAGAAATAAGAC
ACCAAGGTTTTGATAAAAACGTTCAAAATGTTTCAGAATCTAAAGTAAATGTACCTCAGA
ATAAAAGTTTTTTTGATAAACTTTTAGGTTGGTTAGGAGGTTTATTAGGTATATCGGCAG
GTGCTTTATTACCATTATTGGGATCATTAGGAAGTTTTTTAACAAAGCCTTTAGATTTCA
TTTTAGATCTATTAAAAGGTGGTATTAATAAATTATGGACTTTATTTGAGCCATTATTAG
GCCCTATTATAGACCCTTTAAAAAATGGATTTGAATTCTTAAAAAATAAATGGAACTCAT
TAGTAGATTTTATTAATAAAAAAATTAATATTGGTGATAAATGGAAAATCTCAGATAATG
ATAATCCAAAAAATCCAAAATCACCAAAAGTAAGTTCATCTAATCCAGCTAAAGAACAAT
CTTGGATGTCTAAGAAATGGGATTCTTTTAAAGGTGCTATGCAAAATGGATATGATTGGG
CTTCACAAAAAGTAGATGATTTAAAATCATATGCTAGTAAGAAATATCAAGATATTAAAA
ATTCTAAAGTAGGTAAATTATATCTGCAGGATATGATAAATTAAAAGCAGCACAAAAAT
ATATTGTAGAAAAGCTATTGAAGGATTTGATGCTGTTAAAAATATGGTAAGCTCTGCTT
GGGATTCAGCAGTTAAAGCAGCACAAAAGGCTTTAATATGCTTAAAAAGTTTGCTTTAG
CTCCTATGGAGAAATTTGTTAGTTCAGTAGGTAAGAAACTATTTGGAAGTTCTAAGTTAT
TTTCAGTTCTACCTAGTATACTTGGAAATCTTGAAAAAATAGGAGCAAGATTAGCTGCTA
GTGGTGCTAAAATAGCTTCAAAAGCTTTACCAGGTGTTGGGTTTGCTGTAGGTATATACC
AAGCTTGGGATTTCTTTACTCGTGGTAGATGGGTATTGGGTTCAATAGCAGCACTTAGTG
CTTGTATTTCATTATTACCAGGTATTGGTGGGATCATATCTATGTGTTTAGACTTAGGTT
TATTTGCTACTGATATTATAACAAGTCCAGATGATGTAGATAATCTTAATAAAGAACAAA
ATGATTTAGTAAATACAGCAAATAAAATGGTTCAAAATAATGATACTGGAGGTATTTTAG
AACCAAGTCAAGTAGAAAAAGATAAAGCACAATCTGGAGTTCAAGATTCAAGTTCTAATT
CAAGTTCAAGTAATAAAGGATTAAATGCTAAAGTACTTGATGGTAAATCTGCTAACGATT
TTGCTGCTTCGTATACACCACATAAAGTGGATTCTAACGGAACCGTTATAGCTGCTAAAA
CAGGTTCTATATATAAAGGTTTGACCTGGGTAGAATCTGAAAAATATGATGCTGAAAAGC
AAGCTTATTTTAAGAAACGTGAAGAAAAAGAAGCACAATTAGATGCGCTTTTTGAACAAG
GTCAAAAAGCTATGAATTCTGGAGATACTGAAACCTTTAATAAATTAGTTACACAAAGAA
ATAAATTATCTGATGAATTATCTAAAATGAGCTTAGATTCTATCGATTCTAAATATCAAG
CTATTGGACAAGCAAGAATTAAAAAATTGCAAAGCCAAGGAGCTAATGCAGATTTATCGG
TATTTAGAACTAATGGAGATTCAAGTACTAGTTCAGGGGGAACTGATACAAAACCAGATT
CTACAAATGCTAGTGCTAGTGTAGCTTCGCAAGCTTCTGGTTCAATCTCTCCGGCGCAAG
TTCAAGGAGCTCAATCCACAGAAGCCCAAGGCTCGAGTTCAGGAGGATCTCCAGGAGCAA
GAGCTGCAGCAGAATTCAGTAAAAAATATAACTTAGGAACTAGAGCAACAGGCGCTTGCG
CCAAGTATGTTAGATCTTATTTGATGGCAGCAGGATATCCATTATCTGGTTGGCCAGTAG
CAGCTGCAGATTATATAAATTTCTTACCTAAATATGGTTTTACACCAGTTCAAGGTAGAG
CTTCACAAATAAGCCCAGAAGTAGGTGACATTTCAATAACCCAGAGATTTGGAAATCACA
AATATGGGCATATTGCTATTTGGAATGGTTCTAATTGGGTTTCAGATTTTAAACAAAACT
CAGTTTCAATTTATAGAGACGTAAATGCTTTCGGTGGGCCGGATGCTAATATAACTATTC
TAAGAGATACTTCAGGTCAAAATCCATCTCAAGAACTTGTAAATCAACAATTATCCAATA
TGAATAGTTCTTTTAAAGTTGCATTAGGGGGTGGAGGTGCTAAAGGTGCTGTTTATAGTT
TGGATTCTGGAGTTTCAAATGTTGTTACAAATACAGCAGGCGCTGCAGCTAGTGTTATAA
GTTCTGGTGTAAGTAGTATCCAATCTTTTGCTAATGCTAATTCTATTACAACCAGAAAAT
CTTTAACTCAAATGTATACAGAATCTGGATTAAGTACTAGTTTTGGGTCAAGTTCAGCCC
CACAAGCTGCTAGCCCAGCTGCAAATTCAACACCAAAAGAAACAAAAGCAGATATTAAGC
CAGCTTCAAAACCAGTAGCGTCAGTCCCACAAGCTGCTAGCCCAGCTGCAAATTCAACAC
CAAAAGAAACAAAAGCAGATATTAAGCCAGCTTCAAAACCAGTAGCGTCAGCTCCAAAAG
CAGTTCCTAAAGCTGCTAGCTATGGTACACCACACAGAGGTCAATATGATGCAGAAACAA
TGGAAGACTTCAACAACTTAGGAGATAACTTTAGTAAATCCAAATCACCAATTTCTTTAC
CTGGAGATTCGAAATCTAACGTTCAAACTAACAATGCTGGCTCAGTAGTACCAGTAACTC
CTGTAGTTAATATAAAGAATAATTCATCTCCAAGTGATTATTCTTGGGCTTCTAAAAACA
GTTTTAAAATTGCTAGAATGTTTGGGTTAGATGGCATCAGCGATTACGAAATACTTAATG
AAGGTTCAGAATCTGACTTTTTACAATCTTATGGTATGTCTAAAAGACAAGCAATTCAAT
CAGCAGGGTAAACAATACAGTACAAACCAAAGTTGCTAGTAATGTTAAAACAAAAGATG
TGATACCAGCTGTCAATAAAACCCAAATAAATAATACCAATATACAGACTAAAACAAAAG
AAACTTCTAATAAAGATTTGACTGATTCTTTTGTTTTGAGCTAAGGTTCATTAAATGCAA
AGGATTAAATTTTGGGATTATTTGGTTCTGTCAGTAGTGTTATTTCAGGTGTTGATTTAC
CAAAAGCTACGAAAACTTTCTCGGCCAACAATGGTGCTGAAATTCTAAAATTTACCAAAT
CTTTAGAATCTGATAATTTTAAACACAAACAAATAATATTGACTGTTTATGACCCAAATG
ATTTCTATAAAAAGTCAAGATGCTATTGGTCAAAAAATGTCAAGCCTGATGACAGCAG
GAACTTCAGCATTTTCTGGTGATGGGTATGATTCTTCAGATGCTAGCCAAACTCTAAAAG
ATGCTGGTCAAGACATTGTAGATATGTCAGCAGTCAATATATTATATACAATACATTTAC
CATTAATGAATGCGTTCCAAGAACAAAACTCTCATAATTATTCTGAAGATACTGGTATTT
TAGGTTCTATGTCAAATGCTGCTAATGAATTATCAAGTACAGCTAGTTCTGGTATAATTG
AAGCTTATGGTAGATTTGGAGATTTTGGTGGAAATACAGATAATATGGCATTTGCTCCGC
```

FIG. 15BA. Continuation of (CJLB-13-1 [organism=Campylobacter phage CJLB-13] partial genome contig_1)

```
AACTACCACAAGTAGATCCATTAAAATGGCAAAACTTTAAAGGTTCTAACTTAAGAACAT
TTCAATTTACTTTTAAAATATCTCCCAGAAACATAGATGAAGCTTCTAATATGATGCGAA
TATTTTGGTTATTAAAAGAAGTTCATACCCTAAAAAAGAAGCTGGTGGTGTCTTATTGA
TACCGCCTGCAAGAATAGGTGTCCAATTTTCAAACCCACTGCTACATAAGTTGATAGCTC
CTGGTATTTGTGTAATAGATGGTGTTTCTATGGTTTATGAAACGGTGATGATATTGCTG
TGACATTAGATGGAGTTCCAAAGAAAATAGAGTTTACATTATCATTAAAAGAATTCCGTC
AAAAATACCAGGATGATTGGAATTTTGAAAATGCTAGTCTATAGGAGTTAGAATGTATAT
TAGTAAGCAACTTACAAATTATTTAGATAATTATTCGTTCAGTGAAGCTAATAAAACTGA
AGCAGAAGTTTGTAATGTTAGAGATTACAGGTCTATGGATTATAGCACTATAACAAAATA
TATTAATGATTCTAATACTATTAATGTTAAAATAAATGCAAATGATTTCATTGAAAGTGT
TTCTAATAGATTGTATAATGATCCTAATTTATGGGATTTATTAATGCTTATTAATAATAA
AGATGCCTTGAGTGATATGCCTTATGATAATGATAGAATAGCAGATATGGCTGACGAATT
GATAGCCAATTATTTTAATAATCCTGAGAAACCATACCAAGGTAATGTTACTGAACAATT
AATAACCGAATACAGGGAATATTTGATAGATTTATTGACACAAAAGAATTATCAAAATAT
GATTATAAAAGCTTTAGACCCTGCTTATTGGGTGACTTCTTAAGACTTTTTAAGTACAA
ATAATTTAATAAGCCAAGCATTTTTTATACTTTTTAATATTAGTTTAAGCTTTGCTTTAA
GTTTTAAGCATATGCTGGGATATAATACTATAGTATATACTACTAAAAACCTTAGCATTT
TTTATACTTTTTAATATTAGTTTAAGCTTTGCTTTAAGTTTTAAGCATATACTAGGATAT
AATACTATAGTATATACTATTAAAAAGCCAAGCATTTTTTATACTTTTTAATATTGCTTT  AAGTTTTAGACTTATACTATAGTATATACC

>CJLB-13-6 [organism=Campylobacter phage CJLB-13] partial genome contig_6
ATGATACTATAGTATATACTACTAAAAAGCCAAGCATTTTTTATACTTTTTAATATTAGT
TTAAGATTTAAGCATGTACTAGGATATATAGCATTGTTATATACTACTAAAAAGCCAAGC
ATTTTTTAAGTACCAATAAAACTACTAAAAATTTTTAAAAAAGTTTTTTATATTATAATA
TCATATTAAAGGGTAAAATTTTTTAAAAAATTTCAAACTCTTTAATATTAAATTAGAATA
TTAATAAATTTAAAATTTATAGTTTTTTATTAAGTTATCGTATTTGATAGAGTCGTTTTG
AGATTTAATCCAGTAGTAATTTAATGCAAGCTCATAAAGCTCAATAAAAATAGCGCTGTC
GTCAAAGCTTTTATCTTTTTTAAGTTCTTTTAGGTATTTCCATCCGACCCATTTCTTAGA
TTTTGATTTTAAAATACCTAAAAACACTTCTTCCTTAGCTCTCTGTTTATAAAGAGGTAG
CTTTTTTACCACCTCATATATTGGTTCTAAATCTTCACAAAATATCATTAGTTTTTAGTA
TTACCTTTCCAAACTTGTGTATATTTTTGTGAATATCTCTTCATACGAGCTTTATGTTGT
CTTCTATATTTTTAAGGTATTTAAGCGCTTTTTTGCGTTCTCTTCTACCTTCACCAGTT
TTTCTAAATCTTGCTCTTAAAACTGCTGATCTTTTCCAAGCTGATCTTTTTCTATCACGT
CTTAATTGTTTAGTATGTGCAATATCTACTAATTGTTCACTTAAATCACTTAAATCATTA
GCTTCTAAAATCATAGCAGCTTCTTTAAGAACTTCAGCATCATCAAATGATTCATCTACT
GGAGTTGCACCATATTGTTCATAATTGTTAGCTTCATACTCAGAAATTTCTTCGAGAACT
TCTAAAACAAGATAGCCAATATCTTCAAAATCTTCTGCTGATAAAATTTCTTCTTTGGAA
GCAACTATATATCCATTATCGTTAAGAATACTTATAATTAATGCAATCGTATCTGGATCT
AAAGAATTAATTATATCGTCGAATTCTTCCTTTGATAGTGGTTCAAGCTCTGAATCATCG
CCAGAATCATCTTCATCGATTTTAGAATCTTTGCGTTTAACAATATCTGCTTTAGTGGTA
GGTGTTGTATCTATATCACCAGAATCAGTTTCTTTGATTTCAGGGTCTTTATAATCCAGC
ACTTCACAGCTAGAATTCTCATAAACTAGGTTTAATAATGTGTCTTTGAAACTCATTTTA
AGTCCTTATTTTTAATTATTTTTAATAATTCATAATTCGTCTCAGCCCAGGATTTAAACT
TGATCCAGTTCTCTGACAAAATCTTAGCATCTTCAGCACTCAACGAATAATATTCTATGT
TATTTATTTTTATTACAGTTAGATTATAATCTTGTGTTATAGGCGGTTCTTTAATATCCG
GTATTTTGGGTATACAAACTCAGTTCTAACAGTGGTACAGCCTATAAAAATAAAAGGTA
TTAAGGCCAATAAAAACTTTTTAAACTTCATAAAGATTCCTTATTTTTGGTTAGATATTT
GAGTTTTACCTATATTTCCTAAAAATAAAGGTATACCTTTAGCTGAGGTAATATTGGTGT
CTACTTTAGATATTTGAACTTTACAATCCTTGACTGTTACATATTTTGTTTCAGTTTTAA
TAGGTTTATTTTCAAGTTCTTTAATGTTGTTAACAAGTTCTCGATTCTTTTGGTCTTGTA
TTTTATTTAAATTAACCTGGATATTTAGAGAAGTTTCTAAACCTTTGTTTTTGGCTTCTA
AGCTCGAAATAGTTGTTTGTAATTGAGCATTATCATATTTAAGCCATCCTATATATCCTA
GCATAGCAACAATAATGAAAGCAATAGCTACATATTTTTGCATAGTTCCTCTTTTAGTTT
ATTTATATACTAATACAGCTATCATAATTAAATCTTAAACTAATATTAAAAGTATAAAA
AATGCTTGGCTTTTTAGTAGTATATAACAATGCTATATATCCTAGCA >CJLB-13-7 [organism=Campylobacter phage CJLB-13] partial genome contig_7
AGCAATATTAAAAGTATAAAAAATGCTTGAGTTTTTACAGTTTATACTATAGTATTAAA
GCTTAAAGCAATATTAAAAAGTATAAAAAATGCTTGGGTTTTTTTTAATTTTCACCATAA
TATATGTAATTTAAGTTTACTTTAAGTTTAAATATGCAAGACTAAAGCTTAATAAATACT
TAAAAATGAAGTTCAAACAAGGCATTTATATACCAAAAAACCCAGAGAAATATATACATA
GTTATACAAAAATGAATGAACACACTGAATATCCTGTTTATAGGAGTTCTTGGGAGCTTA
GTTTCTTCAAATTTTGTGATTATTCACCCTCTATTACTAAATGGTCTTCTGAGCCAGTCG
GTATAAAGTACTTTAATCCCGTCAAAAAACGACAATCCACATATTATCCCGATGCTATGA
TTATTCGTAACGATATAACATTTTTAATAGAGATTAAGCCTAAATCTCAATTACCAGGTT
```

FIG. 15BB. Continuation of (CJLB-13-1 [organism=Campylobacter phage CJLB-13] partial genome contig_1)

```
CTAACTCAAAATCCAGTTATGATAAACTTTCAGCGGCAGTTAACGAAGCCAAGTATAATG
CCGCAAAATCTTATTGTGAAGCAAACAATATGCAATTCATAATCTTAAGTGATTCTTTCT
TTAAATCTTGATTTTAAAGTTTTAAGCTTTTTTTGGTTTTAAAACTTAAGTTTAGTATTC
AAAAATTTTTGACCTTTTTAATATAATATATTATAATATATTATAATATAAAAACTTTTT
TCAAAAATTTTAGTAGTTTTACAGTTGTTTAGAATTTGTTTTAAAATCTAAACTAAAGTT
TCAGTTTAAAACTTAAAGCAATATTAAAAAGTATAAAAAATGCTTGGCTTTTTAGTAGTA
TATACTATAGTATAATGCTTAAAGCTTAAAGCAATATTAAAAAGTATAAAAAATGCTTGG
CTTTTTAGTAGTATATACTATAGTATATGCTTAAAGCTTAAAGCAATATTAAAAAGTATA
AAAAATGCTTGGCTTTTTAGTAGTATATACTATAGTATAATGCTTAAATCTTAAACT
```

FIG. 16A. (CJLB-14 [organism=Campylobacter phage CJLB-14] complete genome)

```
TCAGCTTCAAATTTCAAACCATAATCAGTTAATTTTAATATATAATATAATAAAACAAAA
TCATAAAAAGATTTATAATGTTAAGCAAAGAAGAAATAAAATATTTTCAAACACATAAAA
ATGAAATAACAGACGAACTCTTAGAAACAATTAGAGCTCAAGGAAAACTAGGAAAAGCAC
AAGCCTTAGAAATCTTAGATTTACCTAAAGACTCTGACAACTATTACTTAGATGCGTATA
ATACGAGAATTAGTTATAATGGGTCTCGTGGTCTTAAAAAAGCTTACACAAAATTAAACT
TAAGTCCGATACATATCAGCGAGCTTGAAAAATGTGCGAATGATCCACTTTATTTCTTAA
GAAATTATGTTCGAATGACTACACCAAAAGGTTTTGATTTCGTAGATTCTAGGCCATACC
AGGATGAATTTATACAATTGCTGAGCGATGATTCTATCGAAAACGTGATATCAATGCAGC
CTCGTCAAAGCTCAAAGTCAAATACTAAAATAAATGTATAATAAAGATTATATCATTTA
TAAAATATGATCATTGTTATGATTTAACTTTAGAGCATTATCACCTTTATTACACCAATG
GTGTTTTAAGTCATAATTCATCAAAGTCAACTACAACAAGTGTAAAACTTGCACATTTAT
ACTGTTTTAAGAAAGATCTTACCATAGGTATAGTTGCTTATAGTGGTAATTCTGCCCGAG
AGTTCTTAGATAAAACAAAGAAAATATTAATAGGTTTACCAATATGGATGCAGCCAGGAA
CAGTTACTTGGAATAAAGGTTCAATAGAATGTGAAATAATATACGTATTTTAACGGATG
TCCCAAGTCAAGATTCTTTCAGGGGTTACAGTTGTAATATAATCGTTGTTGATGAATGTG
CATATTTAGATCCAGCCTCTTGGATAGATTTCACTGATGGTGTTTTACCATCACAAGCTG
GCTTAGCTTTCAAAAAATTAGTTATTTTATCTACACCTAAAGGTAAGAATCATTTTTACG
ATATTTGGCAGGGTGCTGGAGATACTTTAGATACTTCTGTTAATGGATTTGTAAAACATA
AAGTAGATTGGAGATTAGTCCCAAGGTTTAAATCTGATGGTACTAAGTATGAACCAGAAG
AATTTAAACAGCAACAAATTAAATCCAGTGGTCTAGTCATTTGGAATTCTGCATACGAAT
GCAAATTTGAAGGTTCTGCGATGACATTGATACCTAGTGAAATATTAGATACTTATAAAC
CACAAGAACCAATAGAAGTTGATAATATTAAGGATTCTAAAATACTAATATACGAAGAAC
CAATACCCGGACATAAATACGTTATGGGTGTTGACACTGCTAAAGAAGGTGCTGATTTTA
CAGGGGTTCAAATATTTGATACTACAGATTTAAATTTCAGACAAGTAGCATCAGCAAAAC
TTAAAATAGATTATATGTTATTACCAGAGTTACTCAATGAGTATGGTTTAAGGTTCAATC
AAGCTTTAATAATTGTAGAAAATAATGAAGGCTCTGGTCAAGTGGTTGCTGATATTCTCA
AAAGAGATTATGAATATGAGAACTTATATTATGACGTCAATAAACAAAAACAAAGATTAA
AATATCCTGGGTTCAGAACTACAAAATTATCAAGGGATGTTATTTTACAAACTGTATCAA
CGTTAGCACAAGCTAATAAATTATTATTAGTGGACAAAGAAACTATTAAGGAGTTTGGAG
TATTTACATTAAATGATAATGGTAAGTACCAAGCAGCTGTAGGATATCACGATGATTTAG
TAATGTCTTGTTGTTTATGTTTTGGTATTTTTACAAATGTTAAGAACTTTGAAGATATGA
AAGAAATTGTAGATTCTTTAAAAAGTTCCGAAGGAAAAGTTTTGAGTATCTAACATTTG
GAGCTTTTGCAGATGGTTTAGGTACAGAGCCAGATTCTAACACTGATAATAAGGATTTGA
ATCACAGTAATTTGGAATATTATTAAAATTTTGGATTCTAAATGAAAGAATATATTAAAT
ACAACGATAGAAAATTTACTTTAACAGCTTACAAAGTTAAAACTGAAAGAGATTTATTAT
TAACTGCAAGCTCAGATGATACTGTATACAGTAAAGATCTAAATGATTTAAACTTAGACA
TTTACTTAAGAATCTTAGAACCTTATATAGATTCTAATATAAACATTTATGATTTATATC
CGGAAGAAAAATTATTTTTACTTTATAGATTAAGAGCAACTTCTGTTTCTGACCAATTAT
CTTTAAATACTAGGTGTGATTGTGGTTGTACTTTTAAATCTAACATAGACCTAGGAAAAA
TTGGAGATCTCCATAGTATTGATACAAATACATACCCAGATTTGAAAGACGTTTATAGCC
CAAATTTAACCGACATATACAGTGATTCTTACTTAGAATCTAATATTATGGATTATGATT
CAGAATTAGATACGTATTTAGAAGCTAATACTACTAAATTTAACTTTATTAAAGTTGTTA
AATGTTATAATTGTAAGAAAGATCTTGAAATCGATTTAACAAACCCAGAAATATATAAAA
ATATATTTTCAGAGAATCCTATAGGTGAATTCTACAAAAGTTTGACAAGATTATCATTTC
TAGGTAAGTTTACCATAGATGGTATTTTAAATGATTTATATCCATTTGAAAGAGAAATCT
TTATAAGTTTAATAAATGATGAAGTAGAAGAACAAAATAAAGCACTTAAAAAACAATCTT
AGTCTTTAAGTGCTTAGTGTGCGCTACTTTGTATTGTTTTTATCTAATCTATCCTTAATG
CTTTCATTAATTTCTACAGTTATTTCAGATTTTAAGTCATTCTTGACTTCGGACTTAACT
TCAGACTTTATAGCATCCTTAACATCATTCTTAATATTTTCAGCAAGTTTAGCTAAATCT
TTATTTTTTGTTTTCTTTGAGTTGATCAATAATAACTTCTGGTTTTTTAGAACAACCA
ATTAAACTACCATTAAGATCTTGTTGTGGTGTTACATAATTTCCCGTCGATAAGTATAAA
ACACCGTCTACACAAACTTGATTAATTCTGGAATCCGAAGTTCCACGAACTTCTTTGCCT
GTTTTATCGCTGGAATAATCAGATCCACACCCTATTATAAACAAAGCTAACAAAGCTATA
ACGAAACATTTTAGATTCTTCATAGACCCTCTTTTAAATATTTTGATTTTATGATTT
TATGATTTTTGATTTAAAACTTTAGTTTTGAATTAAGAATGTTTTAAGATATTTTATAAT
ATAATTACTCAAAGGAGATTGAAATGAAAGAATTTTTTATAATTTAATAGCACAAATTA
AAGGACTTAAAATTCATAAAAATGAAAAAGATACTTGGTATTTAAAATGGGATTTACACA
CCGGGTATTATATTGAAGGTTTAAATACTAAACGTAGATTATATTGTAGTGGTTATTCTG
ATAGTTTAAACAAATTAAAATATTTGTATTGAAGCTTTGTATTAGTGTGAATAATAAAAC
GTTAAGAAACTTTTAAGATATTTTACAATATAATATCATAAAGGAGATATAATGATTAAG
AAACTGACTGATAGAGAACATATTCTAAAAAGACCTAGTATGTATATAGGTGCTATAGAT
TCTACAAATACAGAAGATTTTATTATAGAATCAGGTAAAATTAAATACACTACTTTGAAT
TATGTACCCGGTTTAATTAAAATAATCAATGAGATTATCGATAATTCAGTAGATGCTGCA
ATTAGATCTAAATTTAAATCTGGCTTAAATATCAGTGTTAAAATATCTAATGATACTGTT
```

FIG. 16B. Continuation of (CJLB-14 [organism=Campylobacter phage CJLB-14] complete genome)

```
AGCATTGAAGATGATGGAACTGGTATACCAGTAATAAAATCAGGTGACCACTATATGCCA
GAACTAGCTTGGAATCACGCTAAAGCAGGTTCTAACTTCGATGATGATGCTAATCGTGTA
ACAATAGGTACCAACGGAGTTGGAAGTTATTGTACAAATGTTTGGAGTATTAATTTTAAA
GGTATTACAGACGATGGTAAAAATAGATATATTTTTAAATCTAAAAACAATGCTGAAACT
TATAGTGAAAATATAGAAGCTTCTAAAAAATCAGGAACTTTAGTAGAATTTAAACCAGAT
TTAGAAAGATTTAATCTTAAAGAAATCGATGAAACTCATAAGAATATAATCTATCAAAGA
TTATTAAACTTAGCTATTTGTTACCCAGAAATTAATTTTAAATTTAATTCTAAAAAAATA
GATTTAAATCTTTTAAGAATTATTTAAATATGTTTAGTCCAGATTTTGAGTTATACGAA
AATCAAAATATTAAAATTGGTATTATTCCAAATGAATTGGATGACTTTAAACAATTTAGT
TTTGTCAATGGTTTAAAAATACCAGACGGTGGTGTCCATATAGATACTATTATGAGCAAT
GTAGTTCAAGGTATAAGAGACAAATTAGTTAAAAAATATAAAAGTATTAAACCTGGCGAT
ATTAAAAATAAATTAATGATTGTTTGTTTTATTAATGAAATGCCAAATCTTAAATTTAAT
TCGCAGTCTAAAGAAAAATTACAAACTCAGTAAAAGAATTTAATGATTTTCTAATATA
GATTATAATTTCATCAATAAAATTCTTAAAAATAAATCTATTATAGATCCTATTATAGAC
ATATATAAAGTTAAAGAAGCTTTAAATGCAGATAAAGCCCTTAAGAGTGTAGAAAAATCT
AAGAAGTTAAAATCGGAAAAATATTTTAGAGCAACAAAAAGTCAAAAATATCTTTGTATT
TGTGAAGGTTTTTCCGCTTATGGTGGTATATCACAAGTTCTTGGAAATGAACATACGAGC
TTCTATGTTCTTAAAGGTAAACCATTAAATTCCTGGGATGTCACTAATCAAAAATTTGCA
GCCAATCGCGAATTATCTGAATTATATCAAATACTTTCTGAGAACGCAGAATTTGAAGAT
CTACAAGATGGTAAATTCTATGAAGTCACAATAGATGGTAAAACATATATTATGAATGCA
AATGATACAATTGAAATTAATAATATTAAATATAATTTCGAAGATCTACAAAAAGGATTG
TAATGAGACCAGTTAGAATAGCAATTTCAGGAGCTCAATGTTCTGGTAAAACTACATTAA
TTAATTTAATGAAGAAACATAGTTATTTTAAGAATTTTGATTTCATAGAATCATTTTCTA
ATAAAATAGCTAAAACAAACAAGAAACACTCAGAAAATACAAACTTAGCAACACAGTTGC
AAATGTTGCATTATAGTGTTAATGCTTTAAAAAATATAAATGCACCCACTGTGCACGATA
GGTGTATTTTGGATGTTATAGTATATACAGGAGCCAATGAAGACATCGATTTAAAATTAT
TCACAGATTCTTTAATAAAATATTATAAACAGTTCGATTTTATTTTTGTTTTAGATTCTG
AAAATATACCATTAGAATCAAATGGTGTTAGATCAATAGATCCTGAATTTAGATCTAAAA
TAAACAATATTTTTAAGAAAGTAGACTTAGAAAACGTCGTTCACTTAGATTCTAAATTAG
ACCCAGATTCTAGGATATTAAAAATAATCGAAGCTATAAAATCTAAAACTAATTAATAGG
AGAAATAATGGATTTGAATCTTTATATACATAAAACAAATGAAGATGCCGTAATACCAGA
AATTGCTTATAATGGAACTTCAGCAGCATTTGATATTACTTGCACCGAAACAACTGAAAT
TAAACCAGGAGAATCAAAAGTTGTTCCAAATGGATTAAGAATTTCAATTGATGAAAAAGA
TCCTTTTTATATGACCGTTCATTTAAGAAGTTCTTTAGGTTTTAAAAAAGATCTAATTCC
ACATATTGGTATTATTGACGCTGGATATACTGGAGATTTTGGAGTTAAAATTAATAATAT
TGGTAAAGAAACTATAGTTATTGAAAAAGGTTCAAGATATGCGCAAGTTTTAATTCATAG
AAAAATATAGTTTTAAGTTCGCCGAACTTAATAATTCTGAATTCAAGGATTTTGAAGCTAA
GCAAGAAGAGGGTCTAAAGGATTTGGATCAAGTGGTAAATCTTAAAAGATTTGCATATT
TTAATAATTCTTAATAAGGATTTAAGTATGAATACAATAAAATTTTATCATAGACAAAAG
GAATATATAGTTCAATCTCAAAATATTAATCAACATACATTTAATAAGAACTATAATAAA
GTTCTAGCATTATTAAATGAAAATGAAATTAAATCTATTAATGAATGTGAATTAATACCA
GCGGGTAAAACTGATATTTTAAAATTATCTGCAATGGGTAGTGATGGGTTAATACAAGAG
TTTGAATTAAGATTAGAAAACGTTTATTAATAGGAGATATAGGTGTTAGACTTTGTAGAT
ATTAAGTATTTTAAGTTAGCAGTTCCTGGACCTTATAAAGAAAGTTCTTTGGATATTGCT
GTTAAATGTCCAATTTGCGGAGACTCAAAATATAAAAAATCTGTTAAAAGACTACACCTA
TATGAAAACAAGGAGTTACTTTAGTCCATTGTTTTAATGGTGATTGTGAATTAAATACT
CAAATGAGTTTAAGTAATTTCTTAAAGATTTATAAACCAGAATTATTATTGCCGTATAAA
TCAGAGAATTTTAAATTTAAAATTAATTCAATTGATTCTAGTACCAAATCTAACATAGAA
AGTAATAATGAAATAGAGACTATGAAGTCTTGTTTTGATTCTAGTGCTAGCAATACAAGT
ATTGAAAACATTGCTAGCTCTACTAGCATTAAAAGCTCCAACAATGGGTTCAAATATATT
AACTTAACTTCAGTGTTAGACACTAATACAAGTAAACAAATAGAGTTTTTAAAAATCTCGT
GGGTTTAACGATGATACTATTAACTTTTTAGATTTCTATAATGGAACTAAATCTTTTAAT
TTAAATGGTGTTTATTATGGAATCAAAGACTATCTTGTAATTCCATTTTCTAAAGACTCT
AATTATTATGGGTTCTATGCAAGATCTTTAACTGAAAAAAGATTTATTAATTTTACATTG
AATCAAAATTATGGAGTTTGGAATCTATTTAATGTTGATTAAATAAACCAGTTTTTATA
TTTGAAGCTATTCTCGATGCTTTGTCTTTTAGACAAATATACAGAACTAATCAAATAATA
GCTTTAAATACTTCCACAATAGCAAAGAATGTTTTAGATTTAATAAAGTACCCTTTCTTT
TGTTTAGATAACGACAAAGTTGGAATTGAAAAAATGATAAAATATAATTCGATACCAGAT
AGTCATTTTATATGTTATCCAAATGATTTAACACAAAAAGATTTTAATGAAATGCTTCAA
AATAATATTAAAATAGAACTTGTTTTTAAGAAAGGCTTCGGCGCTTTATTACATTTAAAA
TCTTTATTATGATTTTAATTATAAATAAAGCTAAAATATATTATAATTAAGAAAATATTA
AAAGGAGTTCAATGACAGTAGATTTAAAACACGATATTTGGGTAGAAAAATATCGTCCTC
AAAAAATTGATGACTTAATTTTACCAAATGTTTATTTAGATAAATTTAGAAAATATATTG
AAAAACCATCAAACATTTATTAAGTTCAGTAAACCCAGGAACAGGAAAAACAAGCACAG
CACAAGCCATTATAAAAGAAGGTAATTTTGAATCTTTATATATTAACGCTTCATTAGAAT
CTGGTATTGATACTATGAGAAGTAAAAATATTACAATTTGCTAGTACTGAAAGCTTTGATG
```

FIG. 16C. Continuation of (CJLB-14 [organism=Campylobacter phage CJLB-14] complete genome)

```
GAAAACCTAAAATTGTTTTAGCAGATGAATTTGACTACTTTGGCCAAAATGGTCAAGCAG
CTGCAAGAGCACTTATAGAAGAAGTTGCTGCTAATTGTAGATTCATATTAACGTGTAATT
ATGTTTCTAATATAATGCCTCCTATAGTTAACAGATTTGAAGTATTTGATTTTGATGTTG
TTCACGCTTCTAATAAACAAGAACTTGTTCAAAAAGCTTTTAATTTACTAAAAGAAATCT
TAGATAATGAAAAAGTTTCTTATACAAATGAGGATCTTGTTAATATTATTAAGAACTATT
ATCCAAGTATAAGAGGTATGGTTGCTTGTTTACAAAATGTAATTTCAATAATAAATTAG
TTCTTGACATTCAAAAAGATTCTGATTTTGAAGGTTTAATTAACTTAATTAGATCTCGCG
ATTTCGATAATTTAATGAAAGTAGTTTATGGTTTAACAAACCCAGATGCTTTTTATGAAT
ATGCATTTAAAAAATTAGATATTCAAAATAATAATAAACCACAAGCTATCATAATACTAG
CTAAATATCAATACCAAAGTGCTTTCTCAAGAGATAGAAACTTAAATTTAGCTGCTTGTA
TTATGGAATTAGCACCATTATTGTAAGGATTATATATGATTTTATATGATTTAAGTTCTT
TGATTCACAGAGCTTTACATACTAGTATTAAGCAAATGAATCCACATAAAAAAGACGGTA
AATATATTACTGAAGAATTCATAAGTGGGACTATTTTTAGAATTATAGAAGAATTATTAG
AAAATTATAGACTTTATAGAGGTAAATATAATACTATGGTTATTTGTATAGATGATCATA
GTGTTCCATATTGGAGAAAATCTTTATATCCAGATTATAAAGCTCAAAGAAAAACTCAAA
GAGAAGAATCTGAAGTTAATTTTAAAGAAGTTTATAAACATATTAATATACTAATTAGAA
TTCTAAATGATTATACACCATTTAAAGCTATTGGTGTCCCAGGAGCTGAAGCTGATGATA
TCATTGGTGTATTAACTAGGAAGTTCTGCAAAGCAGAATCTATTTTAATTCTGAGTCCCG
ATAAAGACTTTAAACAATTGCATAAATTAGGCGATATAAAACAATATTCAGCAATAACTA
ATAAATGGATCATCAATGATGACCCAGAAGGTTGGGAAAGAATACATTGTTGTTTAGGTG
ATGCTGCTGATAATGTACCGCGTGTTGTGGATTTTTCTGAATTTACACCTGAGTTTAAAG
CTTATTATCAAGGAACTGAATTAGATTTCTATAAGTTAGATGAAAACTTAAAACTAGGTA
TTATTAATAATTTTAATGAAGTTTATCCTGATGTTGAAGTTTATAAAAAACAAAGATTTG
GTGAAGCTGCTTTAAATAAAAAGATTAAAGAGTTTGGTTCTTTAGACGCCTTCTTAGATT
CTAACGAAATATATAGACTTAATTATAATCGTAATTATAAGTTAGTTATGGATAGTGAAA
TACCTATTGATATTGAATTAGAAATCTTAAAGAAATATACAGAATCTAGTACAGATTTTA
ATATGGAAAATCTTAATAAGTATTTTTCATTTTATAATATAACTACTTGTAGTCAATGGT
TTAGTCAATTATGGAATGAAATGAGTAAACCTATAGAAATGACACCTTGGAATGTGGATT
TTAGTAAGATCTAAAATCCCTTCATATCTTAACAAAACAGGGTTTAAATCAATTTTAAA
TTAAAGGGGTAAATGACATTCTTGACTGGAGGAAATGGTTATTTAGCCAGTTTATTGGG
TAAAAGATCTTAAAGATTCTTTGCATTTGTTATAAATTATATTATAGATCGGAAATAAAT
ATCCAAAAAAGGCTCAGCAGTGAACGTAAGATTACGTATTATTAATAATCAGCAAGTACC
AGAATTACCAAGTTCACAGATTCTAAAGAAGATAACTTAACTACGACGTCAAATTAGA
TGTCTTAACGCACCAAGAAGTAGATAGAAACTTTGCTAATATTATTACGTGGTTAAAAAC
TGTTAGTGATAAAATAATTGAGCAATCTACAGTTCTAAAACAATTAGATCCCGAAAATAT
GGAGAAACTTTTAGCAGCTGCTGAACAAATACAAACCATTACTGATGATATTAAAAGCTT
AGAAACTAAATACAACCAAGTTAATAATGATTTAACAAATTATAAAACTTCAAATGATTT
AGCTTTATCTAAGAAATTAGATTCTATAAAAACTATAAATGGAACTGATATCACAGGGTC
AGGAAATGCTGAAATTAATATAACAAGAACTCAATTCACAAATCACTTAACTAATATTGG
CATTAATGAAATTGGTAGCATAGCTATATTAGATTCAAAAACAACTTTGGTTTTTAATAA
TTTATATGCAGGATCTGGTTTATCTACAGACACTTATGCATATATGCAAGGTACTTGGAA
ATGTACTGGTAAAATAAGTGATACTAAAGGCTTATTCATCAGAGTATCGTAATCAAAAC
TTAAGCAGATTTTAAGCATTTATATAATATAATAACAAATAAGGAGATTTAATGGTATTA
GAATATAACCCTATCAAATTAGGTAATAGATCTATTAAAGTTCGTAATTGGAAAGTTAAA
GATAGAGAACTCTATAAAAGTAAATTAAAAAATACTAGTTCCACAGAAGACGAACTTAAA
GCAAGATATGAATGTTTTGTTACAAATGTTTTAGAAAACCCGACAGCTTTAAATAACGAC
GAATTAGAATATTTGTTTTTATTGTTAAGAATTATAAATCTTGGTGATGATTTAAATTAC
AGTTGGTGGTGCAGAAGTTGTGAAAAAACTACTGATTCTAAAATTAAATTAAGCAAATTA
TTTACAACAAAATCAGGTAAAATCCAAGATATTGATATTGGTGATATCAAAATTGAACTA
CAAGATGTTCAAAATATCGAACTCTATAATAACAAATTAAGAACTTCAGATTCACCAAGC
ACAGATGATTTGATTTTCCATATTAAATCAATTAATGGTGATAACACAAAAGGCTTCCAA
GATATTAAGGACTACTTCAATGAGTTAGATATTAATATAATGATAAGATTTCTGAAGCA
TTTGAAAAAATGATATTTAAAATTGAATCTAGGGAACATACAGTAACTTGTTCGCGTTGT
GGTGCTAGTTCAACTTTTAATTTCGATGTAATACCAGATATTATACCTCCAAAATGGTTA
AAACGTTAAGAAAGGATTAAATTATGAGTATGTATATAACATATATAGATCAAGGTGCTT
ATAATATGATTGTTTCCGCACAAAGAGACAATGCTTTTTTGTTACCGGGGTCTAGCACAT
TAGAAGTTTTTGACAGTAAATTATTTACAGCAGTTTTGGAAGCATTAGCAGATAAAAAAA
CTTGTAAATTCTATAAAGATATTGACGTGTTAACTTTAGAAAACTTGGAAATTGACGAGA
GCGCTAACTTAGTTAAGAATTCATATATTTTCCAATTAACTTCTGCAATTAGTCAGATTT
TTACGAGAATACCACAATATACTTATTTTAGATTCCAATATCTTAATAATATATTTGCTT
CACAAGGTTATTTTATAACTGATGATAATCGTGAAGAGATGTATATTAAAATTCTTGAAA
CTGATAATGATAAATTAATCGCTAGTCTTGAAGAATATCTTAAGATTGTGAATCAATTAA
ATCAATATGAAAAATGTATCAAGAATTCTTAAATGGTTTAGATGAAATGGAAATGACAG
ATGATGAAGCAACTTTAGATCAAATCTTACAAGAAGCTTTAAATTATTTTACGAACGCTC
AAAAGAATTTCGTAACTATGGATTATAAAGGATGGTTTTCAACAATTAAAGCAGATTATG
AAAATCGCCAAAATTCAGCTCAGCCTTCAAATCAGGCTGTCTAAAAATAAAGATCTAAGA
```

FIG. 16D. Continuation of (CJLB-14 [organism=Campylobacter phage CJLB-14] complete genome)

```
TAACTTAGATCTTTCTCACTTTAACATTTAAATTTCTAAAATTAAATTTCTAAATTCAAA
AAACTTTAAGTTATTTTATTATATAATAAAACAAAAGGAGATATAAATGAATAACCAAAA
TGCAGAAGTTTTAATGAAAGATATTTTGGAAGCTGAAGCTAATATCAGTAAGTTTTTAGA
TTCTTGGACTTTAACAGTTTTTGAACACCAGGTATTAGTAAGATTTTTAACTAATGAGTT
TATCGGTGCTAACTTTAATGATCCTGAAACTCTAAATCATTTAGGAAATAGAGCTAGGTT
TTATATTGAAGAATTCATTAAATAATAAGCTATATTTAACACTTTAGTGTTAATTTAAAT
ATAAAACTAAAACAATTTCAAAAAACTTTAAGTTGTTATATTATATAATATGAAAAAGGA
GATTAAATGATTTTCAAAACACGAACTAAAAAAGTTCCATTCTATGAATTTTTGGCGAC
ACCATTCAAGGTGAAGGACCAAGATTAAAATCTGCAGTATTTGTTAGAGTTGCGGGTTGT
AATAATACTTGTAAAGGTTTTGGATGCTCTGCAGTAGCTCCAGATGGTTCAGTAGTAACA
GGTTGTGATACTATTCGTGCAGTATCTCCAAAATTTAAATCACAATGGAAATACTTTGAT
AATTTCAAAGATTTAACATCAATTATTGACCCATTAGTCACATTTAAAAACTCTGAAATT
AAACATACCAAAGACATTATTTTAACTGGCGGCGAACCTTTATTATATTGGGATACTAAT
GTTATTCAAGATTTCTTAGCTTATTATATTTCAAGAAAACATCAAATAACAATAGAGACT
AATGCAAGTTTGGATATTGAGTTCTTTAAAGAATACCAAAAAGAAATTATGTTCAGTATG
TCAGTTAAATTAAGTTGTTCAGGAGAACCTAAAAAGAAAAGAATTAATATAAAAACAATC
AGTAAGATTCTTGAAAATTGTCCTAAATCTTATCTTAAATTTGTAGTTAATCCAGAAACT
TGGGATACGGACTACACTGAAATAAAAGAAATACTTTATGATTTACCTATATATACTGAA
GTATATCTAATGCCTATGGGTGAAACTCGTGAATTACAGATTAAGAATACACCATTTGTG
TTTGAAAAATGTGCTGAGCACGGATTTAGTTTTAGTCCAAGAGCACATATTTTAGCTTTT
GATACTAAGGAGGGTATATAATGTTAAGTAATTATGCACAATATAATATATTAGAAACAA
CTGGTTTAATTATTATTAAATTTTTGTTATTATTAGTTGAATTAGGCTTCTATGTGTCGG
CTTTATTTTAGCAGTTCTTAGCATTATCAGTGTGTTTAAAATACCAGGAGTGTTTTATA
AGTTATTCGTTTTTATTGTTTAGGTTTAGCAGCGTTTGCTTGTTTAAGTTTAGGCTATA
CTATAGGTTTAACTAATATTGAATTTATATTTAAGATTTAAGGAGTTAATATGAACTTAA
TAATTGGTTTTGGTGTAGTCGGACAAAGCTTAGGAAATTATTTTGATTCTAAAGGCATTG
AATATAATATAATAGATCCAAGATTTAATGATAAAGATCTTAATGAAATTGGTTTAAATT
GTTATAGCAAGATTTTTATATGCATTAATGTGTTGAATGATAATATTGATTCAAATCAAG
ACACAAAAACATTACGAAATTTTAAATACCATAGAATCAAAAGATTTTAGTGGTTTAG
TTGTTATTAGATCAACATTGTTACCTAGTAATGTAGATTTTATAGAATCTGAATACAATT
TAAAATTTGTAACCTGGCCAGAATTTCTGACAGAAGTTGATTCATTGAAACGAGCAAAT
ATCACGTGATAGGCGCTAATAATATTATGTATGCTAAAGAAATTGCTGAATTAATAGATA
CGCCTTATGATTTTTGTAGTCTTAGAGAAGCAATGGAAGTTAAATACGCTAGAAATGCTT
TAGGTGCTTTAAAGGTATTATTCTTTCACGAATTAAATGAAGCTGGGTTCAATGTTAGAA
AAATAGAATTATTATTAAATGAGTTCGAAGATTTTGATTCTCAAGGATTAATGGCTAAGT
TATGTGTAGATGGTAAAAAAGGTTTTGGTGGTAAATGTTTCCTAAAGATGTCCAAGCAC
TGATGTTTGAGTCTAATAAACAATCTAAACAAGCTGGAGATTTCTTTAGAAATATTTTAG
AAGCTAATAATCGACTTAGATATTGTTATAAAAAATCATAAATATATTAAATTTAAAGGT
GTTAAATGAATATGAATGTACAAAATCCAAAATTTTCTTTTACTGAAGATCAAACAAAAC
AAGTTCTTATGACAGCCTATCATCTAAGTCAAGCTTCAGAATATATTCAAGAAACTAACG
GTATGATGTCTTTAATGTTTAATTCTATGGCTATTGAATTATTAGATCAAGCTGGTTTAT
CTCAAGCATTTTTAGATGAATTAGGATATACTAAAACAACTGAGCCTAAAATTCAACTTA
ATAAGAAAGAACAAGCAGAAGTAGACTCTTTATTTGATGAGATTTTAAATGGATCTAAAT
CTACACCAAATGTAGAAACTGAAGTTAAAGATTCAAATACAATCACGAGAGTTGCGATT
GTAACGATTCAAAAGGAATATAATGGTTCAACAAGAATTAAGAAAAATAATTTTTATATT
ATTTGATGAACGTTTACTTTCACAAGTTGTAGAAATGTTCGAAAAATACGAATATATCAT
AGAAAATAACCCAGAGGGTATAGAAACGAGAACTGCGTATTTAATTTCGAAAATATATAC
AACTGATGATAAATCTAAAGTTTTAGATTATTTAAAACAATTGGGTGAATTAGAAGCTAC
TGATATTTTTCCAGATATCAAAATGCTCCAATGTAAATTAGCTATGAATTGTTATGAAAA
CAATTTAATTGAATATAGTAAATTAATAGCAACATTTGATAAAAATGATTTGGATTACGC
ACAAGCAAATAACCCAGTAGTTTACAACACACCAGCGTTGTACAGAGTTTCTATCAATGG
TAAAGATTTTGATGATAATATTAATAATATCAATAAATGTCTGACTTATTTAGGTGATAA
GGTTGTATTTAGACAAACAATTGATAAAGTAGATAGACCAAGTTATAAAAAATTACCTTAA
GATTAGACATTCTTTAGAACTTGGTGATTATGATTATGGGTTTGATGCAGTTAAAGCATT
ACAAGAATTATTTATCAAGAAGGTTTAGATGCTAAAATAAACTCTGTTAATTATAAAGA
ACTTTTAAGTGATTATATTATAATAATGGATTTTATGAGCGCTTTCCAATTACTTGGATA
TAAGTTTACCGATAAACCAGAATATAACAAATTAAAGCAAATGTTTAAAGATATTATTAT
AGAATTAAGTGTAGATTCTTTATTAATTTTAGAAACTTCTCAAGAAAATGTTCTTAAAAC
GCTCGCTGAGACTAAAAAACGTCTTATAAATGATGTAAAATATGATGCTAGTGAAGTTGA
TGCTTATTTGGGTCCAATTTTACAAAGGATTAAAGACAGTGGTAAAAGATTTAATAGATA
AAAATCAAGCCGAAGTTCAGTTAAAAATACAAGATTTGCAAGACATCAGAGTGGGTATAA
AATATGCTTTGCGTTGTGCTAAAAAGATTAGTTTAAATTCTGAATCTAACTCAAGTTTAG
ATTCGGATTTAAGCCAAGAAGAACTAAACTTTTTAGCTTGTTTAACTTGCTTACCTAAGA
CCAAAACTAAAAACAAAGGTTAAAATGGCAGGTAAACTAATAGTAGAATTTAGCTTAGAT
ACTAAATGTAACTTAGCTTGTAAATATTGTTATAGTGCACATACACCACCAAACCCTATG
TCTATAGACACAGCTATGAAATTCTTTGATAGAATTAATTATATGTTAGATTATTATGAT
```

FIG. 16E. Continuation of (CJLB-14 [organism=Campylobacter phage CJLB-14] complete genome)

```
AAAGATAGCTATCATATTTCATACTTTGGTGGGGAACCTTTATTAAACTGGGAAGTGATT
GAAGCAACTTTACCAAAATTCCAAGAAGATCCAAGATGTACCAGCTATGTTGTGATAACT
AATGGTGCATTATTAGACCCTGAAAAAGTTCAGTTCTTAAAGGCTCATAATTGTGGAATT
TCACTGAGTTTTGATGGTCTATGGCAAAATACTAATCGACCAGTGGTTGAAGGTACTTTT
GAAGGAACTTTAGATTATTTTAAGCAAAACAAAGCATTAATTCATAGCATTACAGATACC
TGTAAAGTTATGATACAACCCAAGAACTTCACAACAATGACTGAAAATTTTGAGTTTTTT
GTTAACGATTATGAATTCTTAAGACCTGATTTTTGTTTAGTTCGTGATAACATTTATACT
AAAAGTCAAATAGAAACATTTGCTATAGAAGTTGAAAGATTAGCACATAAAGTACTTGAA
TATCAACATAAAGGAATACCAGCAAGTGTAGGATTATTTGATTTATATGCTTTAGATATT
TTAGCAGGTGCTAGATTTGGTAAAAGAGACCACGGTTGTTTCGTAGGAAATAACGGTTGT
TTATATGCGGTAGATGGTAAATTCTGGCCTTGTGAGCGATACAGATCAACTAATAAAATG
GTTCTATATAGTCCAGAATCTGGATTAAATCTAAAGAATCTTAAGTTTATGTCTAAATAC
GCTGACCCAAGAAAATTCAAGAAATGTACGAAGTGTGAAATTCGTGAGTATTGTAATGTT
GGGTGTACGCACCAAGAAATGCGAGAAGCTAAATTCGAAGGTAGAGAACCAATAGATTCT
GTATGTCATTTATTTAAACATTCTTTTAAGTGGGCTATGTTTGTTTTAAGAACTCTACT
AAAGAATACAAAGATTATCTATATAGAAGACTTGAAGTTGGATCTTGATACCTTTAGTAT
CTAACACTCGAGTGTTATTTTTAAAAGCCTTTAATCAAAATTTAAACAAAATTAGGATAT
AATTAATTATGGCAAATATATTCGAACAATTTACAAACTGTCTCAAAGACAAAGACTATG
ATGAGAGTTTAGGTTTTAATAGCTTTATGTTTTGTAGATTTTTAGGGTCAAGCCCTAGCA
CTTTACAATTAGCTAATGCTATTAATATATTATATAAAAGCTTACCAGATGAAGCACAAT
ATAATTTAGTGAGATACACAAAAAATAAACCAAAATTTATAAGATTTGCGAAAGCGTTAG
CTGAATCAGAATCTATCAAAGAAATACAATTAAAATATAAGGTAAATAAAGAAGTAGCTA
AATTATATGCAAGTATTTTAGATTCTATGTGTAAATCTTAATCAAAGGAGCTATATTAGC
TCCAATAATTAAAACATTACACTCCATTGAATTCTGAATGCAACTGTTGATTCTTTACT
TTACCTTTAAAGGTTCTCATAGCAATTAAATTTGTACCACTATACAAACCAGCTTCAGTA
TAAACTACACCATCATTAGCACAGTTAAAAGCATCTTGCGCAATATTAATAGTATAAGTT
ACTACAGGCTCTGCTTGCTCAATACCAGTAACTGTAATATCTACTGTAGAGTTATTATTA
GCACCATCCTGAACGTTTGTGGCAGCAGTGTTAACCATATTACCACTTGGTGTAAAAATT
ACTTGGTTCCAAGTTCTATTAATATCACCTTGTTCTTGACCACTGAAAATATCAGTAACA
GACGCAGTAAATCCAGTAGTTTCATCCTTTGGTGTTAAAATATCAGAACCTTGATGTCCT
TTAGTACCCATAACAAATCTATTAATAGCATTACTTTCATTGATACCGGCAATCAATTTA
GCAAATTCAGCTCTTGCCACATTTGTAATAAGATTTTTCTGTTCGAATTTATCGATAACA
TTACCATTAGCATCTAAACTTTCAATACAAAAATAACCTCTGGCAGGTGTTTTTTGAGCT
TCTTTAAAATTCATATTAGGCCTTTATGATTTTTTGATATATTTATTTAGTAATAAATAA
AACAAAAAGTGAATACAATGCAAAAAGATCAAATTGATATATCTATATTAAATGCAAACA
AATATTTAACTAGCCAAGCAAGAAAAGAAGCTTTTATCTATGATAAAGTTAAAGTAGAAG
AAAAATATGATGGTATTAAAGTAACTATAGTTCATATAGATAAAACTGGTGATTATAAAC
AAGATTTTATTGTTTCATACAAATCCAATATTATATATCCTGATGAGTTTGAATACGCAG
TCAAATCCAAAATAAGACCTGAAAGCATTAATAATTCACAATTTACATTTATTTTCGATA
TTCTTAAAAAATGTGATTCAAAGAGTTTACCTTTAAATTATGAATTCTTTGTAGAATTCT
TGATGAAAAAACCTACGTTACAACATAAGTATAAGAAGATGGGTGCAATTTTATTAGCTT
ATAGCCCTTGTACTTATGAAGTCAAATTTGGGAGATTATTCACAAAACCAAAAGGTTTCT
ATACAGATTCAAGAGAAACTTATGCTAAGAAATTAGGATTTGATTACCCAAGAACTATAT
TTGAAGGTAATTTCGCTAATTTTGAACGTGGTATCAAATCACAAGAACTCAATGATATTT
TTAGAACTTATAAAAATATTCTTAAAATAGAAAACATAGTTTATATATACAACAAATAT
CTGAAATGTTTCTTAAAATGGAATCTAAGTATGGTGGTAAACCTGAAGGTTATGTTTTAA
CTTATCCCGGATTCTTATTAAAAATTCAACAACCTTATCAAGTGGATCCTAAAGCAAGAG
CAGAAACACGTTCACAATATCAAGGAGATCCTGATACTGAAAATGCTTATTGGGCTAACG
TTAGATTAGCAGCTTTAAATATTATTGGAGCTAGTAATATTAAAGGTTCTTTAAACGAAA
TACTTCAAAGGTATGGAGAAGCTCTTAAGAAATATAAGTTGAATTTTACACATCCTAAAA
AGACACAATTTCAAATAAAAGATGATATTCAAGGTAATATCAAAATGATCGTTATTAAAA
GACTTAAAGGAAATAATAACTTTTTATTCTTAGGCAAGTTTAGAATTTAACTAAAGCTC
ATTATAATATTATTAAAAATGGATTAAAAAAATACGATAATGGTGTAGTCTGTTTGGTAA
CTTCAAAAGATACTAAAGAATTTGAAGATCTTAGATTAGAAATGTTAAAATCTTGTTTTC
CTGAAATTGAAATTATACAACATAGTACAGGAAATATTATTAGTATTATGAATAAATCTA
AAATGAATATAAATGCTATTTTATGTGGTAGTGATAGATATAATGACTATGTAAACCAAT
TAAGAGCTAACCCAGATATTCAAGTTGTCGAAACGCCTAGAGATACTGGCGCTATTTCTG
CAACTGCAGTAATTGAGAATCTAAATTCAGAAATTTTCTTTAAAAGAAATACACCAAGTG
AAATACATTCTATGTATAATAAAATATTAAAAAGATTTAAAAGCTTAGGTTTAGTATCAT
ATTTGTCTAAAGAACCAGAAAATAAATAACAAAAATGACGGGCAAGGTTTAAAATGACTG
AGTTAAGATTAAATGTAGATTCTAAAGATATCATAGAAGCGGGAGATTATAAATCTACCC
AAAGAGGTATGTTAACATTTCTAAAAATGCCGTGTATTTAGGTGATGGTAACAAAGCTA
ATAAAATTATAGATGCAGAAAGCTTAAAAACCGAAATAGAAAAGTTCAAAATAATGTAA
ATAACACTATAACTCAGCAAATACAAAATGTAAATAACGCTATAACTCAAGTTCAAAACA
CACCTGCAGTTCAATTTTTAAACATATGTGATAATGCGACTGATTTAGCCACGTTAAAAT
CAAGTGTTACATTAAAAAAATGTTTTTGATAATTGGGTAAGACATTCTATTATGAATTCTG
```

FIG. 16F. Continuation of (CJLB-14 [organism=Campylobacter phage CJLB-14] complete genome)

```
CTAGTGGTCCTAAATTAGATGATGATGCTGGTCAAGCAGAAGCTGCTAAATGGTCTTACA
TAGAAGCAGAAGATGCTATAGCAAGTAATATAAATTCAAGTTATTATATATATGTTTTTAA
GTAATGACGTCAAAGATACTTATAGTGTGCAAATATCAGCTGTGGGCCAAGATAATGATG
ATGATGTTTTAAGTATTGTTGTAGCAGCTAAAATGATCAATGGTAAATTATATACATTAA
GCGCAGTGAGATCTTTACAATTAAACGCTTTACCAGGTGGTACTTCGTGGGGTTTATTTT
TTAATTATTGTGGCAACAATGAAGAACCTTATACAACTTATAGGTTATTAGCTTCTAAAG
GCAATATTACAGATAATTATCCTAAAACAATTTGGCAAGCAGGTAAACATTTATTAAAAG
TGGCTAGAACTAAAAATAGAGTACAATGTTGGACTTCAGATCTAAACCAAGCATTGGATG
GCAACTCATTAATTGATTATACATTACCAACAACAAAACCTAGTGTTTTATCCGATAATG
AATTTAATATATTGAAAGAATTATTAAATTCACCTTGTCAAATGGGTTTTGGTAATTGGT
CTCAAAATATTAAATTTTATTTTGATTCACAATCAGGTGTGTATGATGGTACTATAATAG
ATATATCAAACAATCAAAAATGGACATATAATAGTTCTAATAAAACTTGGGTGTCATCTA
CATTAGATAACTCAACAATACCAGAAATGTTTTAATTAGTTCTAAGAAAACTAAAAAAT
TGTTTTATAATAATGGTATTGAAATATCAAGTTTAAACTAGGATTTAACACTTGTCAAAC
CATTTAATTAAAACTTTCTTAAATATGGCTATAGCCGTATCAGTAGGTATAATTTGTTTT
TTAATTGATTTTTATATACATCATACATTATCTTGGAAAATGTTCTTAATATTTTGTATA
ATAACCATATATTATGATATTAAATTAATTTGTGATGTTGTTAATGAACCGTCAAATACT
AATATAAAAACATAAAATATAAAGACTAAAAATGCAAGATTTAAAACCTCGAGAACTAAA
AACTTATGAAATAGAAGAACTTATAGTTCTAAATACAAAAACTGCAAAAGAACTCAGAGA
TTCTATGGTAGAATCAAACCCAATTTGTCCTTTATGTGGTTCTAAGATCTTCAATCCTGT
ACTTGATCACAAACATAGTAAAAAACAAGAAAATTTAGGTGTACAAGGCGCTGGCTTAGT
CAGAAATGTTATTTGCAGTACTTGTAATATTTTCTTAGGTAAAATGGAAAATAATTATAA
AAGATATAGAATTCAAAACTTGTCTGATTTTTTAAGAAATGCTGCAAATTATTTGGAAAC
TGATACAACACCATATGTATACCCAAGCGAAGCAAAAAAATTAAAAGAAATTTTTCCGAA
GTCTTTATATAATAAACTGATTAAAGCAATTCATTTAGAAACCAAAAAAGATATTAATTA
TATTAAAAGAAAATTAAGCACACAAAATATCTTAGCCAAAAAACAAAAGATTTATTAAT
ATCTTATGGTTTATATTCTTAAAGTTTAAAGTATAACTAAAGTTTAAAAGTTTAGTACAT
AAATATTAAAAAAAAAAGGTTAATAATGGGGTTATTAGAAAGTATAAAAAATAGTATTAT
AGGTGAAAAAATAGATAGACCATTCTTAGAACAACCTATTAATAAAATAGATACTACAGT
TCCATTCGGTAGAGTAATAAACACTTTATCTGATGATGAACCTTTAAGATTCCAAACCTT
TTTTGATAATGTAAATGACATAACTTATGTTGATAATCTACAAAAAGCATCAGAACAAGC
TCAAAAAATTGATATCTACAGACAAACTGCTAAGATTGCTGAATGTTGGAGTGGTTTAAC
AGAAATTGTGGACGAAGTCGCATATTGTAGAGATTTCAAAGATCCTATTAAATTAGAAGT
TGATACTTCGAATAAGAAAATAGACATAGCAATATCTAATGCTTTTGAAAAAATAATGAA
ATTATTTGGAACCCAAAAATATCTACATTCTTTTATCAGACAATCTTATATAGACGGCCA
AATGAATATATTAATTAAATACCACGATGATAAGAAAAAAGGTATAAAAGAATTATATTA
TTTAGATCCTAGATATCTTTGGTATGATTTAACAGATTCTAAATACAAATACATAGATAT
AAATTCTTCAGTAGCTCTCTTAAAAACAATTTCTTAGGGAATCAAAGATATATCAATATCAA
TGGTAAAGCTCCAGTTCGAATAGATCAAGCTGCTTTAGAATACGATATAGAAGAAATAGT
TCATCAAAATTTTGGTTTGTTTTCAGATTCTGGTATTTGTTTAAGTGAATTAGAAGCTTC
TGTTAAAACAGCTAATCAATTAAAAACACTTGAAGATTTGTTAATACCTTTAAGATTTTC
AAGATCAATTTCAAGACGTGTGTTTAATATAGATTTAAGTGAATTACCTAATTCTAAAGC
AGAAGCTTATATGAGGGATTTGACTAATAAGTTCAAATATAAAAAACAATACAATCCAGA
AACTGGTGAAGTAACTAATAACCAACACATTGTCACTATGGTCGAAGATTATTGGATTGG
TAATAAAGCTGGTGCTAAAGGTATGCAAGTAGATATCTTAGACGAAACTGGTAACTTAGG
AGAACTTGGTGATATTATGTTCTTCTACAAGTTATTATATAGATCTATGGGAATACCAGT
TAATAGAATCTACTTAGATGACCAATCACAACAACCATTATTTGATTTGCAAGCAGATGC
TATCACAAACGAAGACATCAAATTCTTCCAAAAAATAACTAGGATTCGCCAAGTATACAC
TGAATTCTTTATGCAAATTCTAAAAGAGAATTAATTTGTACTAAAGTTTGTACTGAAAA
ACAATTTCAAGAACTTAAAGATTCTATTAATATATACTTTAGTGAAGAAAATCAATTTAT
TGAAAGAATGAACCTAACATTGTTTATGAAACGTATAGATGCATTCTCAACAGCTAAAGA
TTTTGGAGGAACAGTTTTACCTGTAGATACGTTATATAAAGAAATCTTTAGATTTAATGA
TGCTGAAATTAAAAAGAATCTTAAAGCTATTCAAAAAGAATCTAAGAATCCATTGTATAA
ACAATTTTACAGAGATTTTGAAAGTGGGGATGAATTCAGTTCAGATTCTGATTCTAATGA
TGAACCTAAATACGACGATTCTAATAACAATGTTGATAATACAGATACCGAAGAAGAATA
TGATAAAACCGGTTTATCTATTAAAAAAGACTCATTGATTTAAAACTTTAGTTACATTCA
GAAATTTTTAAGTTATATTATATTATAATTATTTCATTAAAATATAAAGGAGCAAAAATG
AAAATAATAGATGTTATGAACGATTTAATAGATCGCGTTAGAAATGAAAAATTAATATTT
ACATTCAACGGTAAAAATATTTTTAGATCATGTAGATTCTTATCAACACGGTGAAGAT
TTTGGTCTATTCTTTAGATTGGAACTTTTATATTCAATTTTTAATTAAAATATAAGGA
GTTTGAATGAAATTAATAGATGGTTATTATGTAGATTCAAACAATAATAAATGGGATGCT
TCTAGGTATACAGAAGAGCAAGCTATAAAAGTTTCAGAATCTTTAGTAAATTGTAAAGAC
TGTGTTAATTGTTTTAACTGCGAAGATTGCTTTGATTGTGAAGACTGTACAGATTGTGAA
GACTGCATTGTGAAGGTTGTAAGAACTGCACAAAATGTTGTGACTGCGAAAGTTGTGATT
ATTGTTATAATTGAGTCAGATGAAAAAAATGTGGAGAATGTGAAGACTGCTATTGGATTC
TAAAAAACGAGAAAATGCACGATTTAATAATTTTTTAAGTTCTAATATATTATAATTATT
```

FIG. 16G. Continuation of (CJLB-14 [organism=Campylobacter phage CJLB-14] complete genome)

```
AAAAGGAGATCAAATGCAAATTATAACAGATTTTTTAAATGAATTAAATGCTTCAAATAG
TTCTAATTATAAATTAGAAGTTCTTAAAAAATATAACAATGAAATCATTAAAGAATTTCT
TTCCATTAGTTTATGATAAAGTCAAATATTCTTACGGAATTAAAAAAGTGCCAGAATTCCA
AAATAATAATGAAACCATAGATTTCAATACAATTAAAAATACGTTCATAGCGTTGCATAA
TCGCGATTTTACAGGGAATAAAGCAATTAGTGTTGTTCAGTCATTACTTAATAATAAAAC
TCCAGAAATAACCAGGATTATTACTTGTATTTTAGACAGAGATATTCATTCAGGTATTTC
AACTAAACAAATTAACAAAGTTCATAAAAAACTTATAACAGAATTTCCATATATGCGTTG
CTCACTAATGGATAAATTTAAGAATATTAGATTTCCAGCAATGATTCAAATAAAAGCGGA
TGGAACTTATAGAACTTTTATTAAAAAGGTGATAGTGTCCAAGCATTTCAAGATCTGG
TGAAAGTTATGATCACCCTAAAGTATATTCAGCATTATTGAATCTGCCAGATGGTGCTTA
TATTGGTGAATTAATTTGTAATGAAGTTGAAGGTACTAATTCAACTGAAATCAGATATAA
ATCTAATGGTTTACTTAATAGTTTAACACCACCTGAAAATGTAACTTTTTATATGTGGGA
TTATTTGACTTTAGAAGAATTTGAAATGGAAATAGTAAAACACCATATAAAGAAAGATT
TGAGTTTGTTTGGAGATTAACTGAATCTTTAGAATCTAATACATTAACTGTTGTTAGAAC
CAGAGTTATTGATAATATAGAAGCTGCTAATGAGTATTTAAATACTTGGTTAAAAGAAGG
TGAAGAAGGTGCTATATTAAAAAATTGTGACGCTGTATTTAAGAATGGTACTAGTACAGA
ACAAATAAAATTAAACCAGAAATAGAAGTTGAAGTTCGTTGTATTGATTTTACAGAAGG
TAATGGTAAGTTTAAGGATACTTTTGGTGCTATTGTTTTAAAACAGATGATGAATTAAT
TCAAGGTAAAGTTTCTGGGATTAGTGATACTGAAAGAGTTGAAATATTTAAAAATAGTTC
TAAGTATTTAAATAAAGTTTTTACAGTTAAAGCAACAGCATTGACAAAATCTGAAGATTC
TGAAATATATGCTTTAATGCATCCAAGATTTAATGGATTTAGAGAAGATAAAGATTATAC
AGATACTTTAGATAGAGTTAAAAATATGGGATTAAAATTTTAAGAAATCAATTTAGAATT
CAACTAGGCAATTCACTAGCTGCTTGAATTCTAAATACAACTTCTTCAATTAAATATTTA
GGTTTATAATAAACATCTACATAAATGTTATTATCCTGAGTAGGATTATTAGAAATATCA
CAAACTATTTTAAAATCTTCTATATTATTATCTGCAACATAACTTCTACAAATTTCTTTT
ATTTTTGAAGCTAAATCATTTCTTGTATATTCATCATTATTTTCAAATACATAATATAAT
GCAGCATTTCACATTCTCGAACTAAATTGAAATATATTATTCTATTTGTTAATTTAGAT
CCTTTTAAGGTATTTTCACTTAAAGCGTATATACCGGAATATCCTTTTTTAACAATATTA
ATATTTAAATCATATAAATCTTTTATTTGTGATTCTGTTAAATATATATCCAAATCTATT
GTATTTAAGAAACTATAAATTGTTTTACAGTGAGATACTGATAATTCTTGTGAATTAATT
AATCTGGTTCTTAAACCAACAATATCGCCTATGCAATTAACATATATATTTTGATTATTA
AATGGATTTAATTGTAATTTAGAACCATAGTAGACAACAGCATTGTTTGAAATTTGTAAT
TGTTTAATATATTCTTCAGGTTTGATACCTCTAGGTATGCCTACGAAAGCGCAGCAATCA
CCACGAGTATCTGCTAAATTGATAGCAGAATTTGGACTTTGTGTATTAGCAATTATAAAA
TCAAATATATAATCGTTAGATTCGCCTACATTTTTATATGTTTCATCTATTTGAGCTGCA
CTTGGTAAACTTGCGTACCCGTTACTTAATTTAAGACTATTAGAACCGTAAAAAACTGTT
TTATCTGAGTTAGGTTCATTTCCATCAGCTAAGCGATTTAAGCCATCCACATAGTGTATA
TTACCATCATATAACTTGTATTTTTTAGGATCGAAAATAATGAATATATAATTAGAATTT
TCATTAATAGTATCTACCCATATCCTCAGCTTCTTTTAAGATATATTTTTTCCATTAATGTA
TCTTTTAAGAACACACAAATACAATATTGATTTGAACTCATTGAATTTTGAATATCTTTT
GCTAAATAATTGCTGTGTATTAACATATTATTAAGAACTTCATATTGTGTAAAAATACAA
ACTGTTAAATCATTTCCCCACTCTCCTGGGTTTCTAGCAAGGATTCTCAAGAAATTATTT
TCAGAAATTATACGTTTACTTCTAAAATCATCTAAGTTATCTATTCTGACGTCAAAGTCA
TTAAATGGATAGCTAATACTAGCATTAACTGAATTTTCACCAATAGATCTCGAAATAACT
ATTTCATTATTATCATATAAAAATAATTTATAAATTTGAAACCAGTCATTTATATTATTT
TTGTTTGGTTTACCAAATTTTGTTTTAAAATCTAATATAGAATAAACGGGTGTTAAAGTA
TCTGGTGAACCTTTATCGAAATATCCAGCATAGAATACTCTTCTTGGTTGCGAATAATTT
GATGTTGAACTGGTATCACTATCAATAAATCTAACACTTGGGACTGGCATCATAATCCTT
CATATAAAAATATGATTTTTAAATTCTATAAGAATCTATAAGAATTTAATCAAATATT
ACAAAGTAATATTCATTTTTTGTATCTTGAGAAGTCTATTCTTCTCAAAGATATGGGATA
ACCATAAATCCCCACATATTTTGGCTATATTGACAGCTGAATTTATATCTCTATCAACTT
TGAAACCTGGGCTTAATTCTACCTCTCTAATACTAAGATTCGAGTCTAGTTCTCTTTTTC
CTGTAAGGCAGTTAGTCTGAGAAGTATATGCCTCATTCACAAGTAAAAAGTTCAATCCTT
TATTCTCTGCTTTATACTTTAAGAAACCCTTAAATCTACTCAATAGTCCTTCATTTTGAG
TTGATTTATTTAAACTTGTTTTATAGTCTTTCTTTAATTTTTTAGTCTTGATATCTCCGC
AAATGATGTTATCTATACCATTAAGAATGCAGAGATCTACTATAGTCTTTGAGGTCTTAT
GAAGATAGTCTTTCTTTTATTAGTTAGTTTTGCTTGCTTTCTTCTGATTGTTTTGTTAA
GTTTTTTATATCCTCTTGAACCTTTCTTCTTCTTATCTCTTTTAGACTTAAGTTCATTTA
TAGCTCTTTCTAAACCTTTAAATCTCTTAGCTTGTTATCTGCAGACAATCGATCTTATTTG
AGTAACAAGATGCTATACTGCTTATTCCTAGATCTATAGAAAGAAAATTTTGATTTAGTG
CTTTTTCTTGTTTTTTCTCTGAGAAAACAAAAATACAATCTATTCTCTTATTCTCATCAA
TCTTGATGACTATCTGTTTTAAAGTCTCATAGTTGATAAGTTCTATATCATAGTAAGGGC
ATTTACTTAAATCTAATTCAAATCCTATTGAAGTAAAGTTTATTTTCTTACCTTCTAGTT
TAAATCCTCCACCCGGATAGTATTTCTTTTCGAGAGTCACTTCTCCAGTTCTAGAGTTAA
CAATCTCCCCCGTCTTAGAGGAAAGATTTATGTCCATAATGATAGGACTATATTCTCTAT
ATAATTTTGGAAATCTAGCAGACTTATCGTTCTTCTTTTTCGCTAGATAAGATTTTACAG
```

FIG. 16H. Continuation of (CJLB-14 [organism=Campylobacter phage CJLB-14] complete genome)

```
CATTTATAACCTCTCTAGAGGTATTCTGTATATGTTTTGAATGTAAGCCTATTACTTTCG
ATCTACCTTTTGTGATTTTAGATAGATCTTTAAAATTCAAATTTTCTTTAAGAAGATCTA
GACATTCGTTGTAGATAGCAGAAAGAGATTCAGAATATTGATATATTTCTTCTTTTTCTT
TATCAGAGATAAAGCTATCAATTCTTATCTTTCTAGATAACATTCTAAACTCCTTTCTTT
ATATCTATTTATATTTCTTTTTCTCAATTTCTTAAGGTTGTCTTAGTAACATATATAATT
TTAGAAAATTCTCCAATAATATACATTTAAAGTCTTTTTAAGAAAACTTATAATATAATT
ATAGATATTTATATATTCTTATATATTTCAATATAAAATGAATGTAACTACTAAAAGTAG
TATTAATAAATCTACTATTATTAATTGTTCATATTCTTGGTCATTATGTATCAACATATT
TTATACTTTAGTGTTTACTAAGCCAACTAGTTCAGATTCTTTAGATTCTAAAGCTATACC
TATAAAATATTTTCTTCTTTTTTGCTTGGGTTTACACAAGCATAACCGTCATACTCAGC
GTATAATTCATCACCGGCTTTTACAGAACCTTTAACAATTACTGGTGTCTGACCCTTTAA
AGCTATTAACACACCTTTACAATCTTTATTAAGAATAAATCCTGGTTTATCTGAAACTAC
ACCTAAAGGTCTATTATGTTTATAGATGTCGAAATATTCAATTTCTGAATTTTCATTAAT
ACCTAGAACAGCTCCAACTTCAAACTCTTTATCGGTTTCGTAGACCTCAGCTAAGTCAGC
GTATTTTGCTTTTAAAGCAGTTCCTATAAAATCTTGAGCATACATAGCTTTAAATTGTTG
CGTTGTTGAGCCAATTGTAGATATTAAGTTTAATCCTGGTAATAATCCGGCTTCTGTGGT
TAACCAAGCTTCTTTTTTACTTTTACGAGTTTGTAATTGTTTAGATTTAGAATCAACAAA
TACATAATCCGTTAACAAATCATCTATATTAGCAACACTTTGTTTCACTTCATCTATTAA
AACATCGACATATTTTTAGTTGTTACGTGAGTAGGTTTAGATACTTCTAAATCTATTTT
ATTGTCTTGTTTAATATAGATGCCTGCAGATAACCATCTAAGAAATCTTTAAATTGTTC
TAAAGACCATTTAAGATACTTTAAGTTAATAACATCGTAATCATCGACAATAGGCCAATC
TTTATCATTGTCAGTTTTAGTAGGGTAATTATCTACATCTAACCAAGGATATAATTCATT
TAAAGTGACTTTTTTCCACATATCAGAGTTAGCATCTGGATAATACCCTTGATTTTCGAT
ATCACTAGGCAATGCTAAATAATATGAATTTTTAATGGTTTCCACATCTGGATTATCTTC
TGTTATATAAGAAACTATTTCACCTGCTTCATAAATTATGCTAGCATCCCATCTGATAGA
TTCTTTTGAAGTTAATATTTTAAATTGACCGATTAATTGATTAACCTCTCTTTTGAGTTT
ATTAACCGACTTGTTTAGTGCGTCTGCGCTAGCTCTTTGGTTATCCATAATATTGAATTC
TTGAACGAACTCTCTAAAACTAGTTAAGTTAAAATTATAGCCTTGGTATCTAAAATCAGA
CATTAAATCTCCTGCTTATATTTTTAGTATTTATTTTTGATCAGAGGCTTAAATAATTTA
AATAGATTAATTAGTGTTTAAGGTTATTGTATAAGTTTCAAAGCTTGAAGTTTCTACTCC
TGTAAAATTATAATTAATACTTAATATAACCCTGTTGAATTCTGGTTGTGAATAAATGTC
TACACTTTGAACTTTGATTCTAGGTTCGTAAACTTTTAGACATCTTGTAATTTCGGTTTG
CATACTATTAATAGTAATATGGTCAATCATTTCAAACAAATAAGCATATAAATTGCAACC
AAATTCTGGTTTACCAGCTAAGGAACCTTTTCTAGTAGTTAATATATTAAAAATACTTTG
TTCTATAGCTCGTTTATCTATAACTACATCATTCAAAGAATCATTATGAAAATCTTTATA
AGTTGCCATTTATATACCTATTATATTATTTTAAGGTATAAGCCGATTTAATACCGACTT
ATTTACCTTAATTTTCGCTATGTTAATCTTCAGACTCAGTTACTTCAACACTTAATTTAA
CAACTTTTTCAGAACCACCATTAGCTGTAGCTTTTACAGTTAATTTCAGAAGTTCCTTTGG
TTGCAGCAGTTATAGTGAATTTACCAGAACCTTTTTCAACTGTAGCATTAGTATTGTTAG
ACTCAACTGTGAAATCACTAGCATTAGTTGTTACAGTGATATCTTTAGTCTGACCCTTCT
CAATAGTTTGTCTATCAGCTGGATTTAAAGATAAAGTAGTTTCTACTGATGGTGATTCTG
GACCACTTTCTTCATTATCTGCTAAGTTTGCTTCAGTTCTTTCAGCTATGATAGCTTTAA
CCTCAGCTTGCGATTTTTCATAGATTGAACCATTTATGTCAACTTTAACTGGATCTGCAG
TAATATGTTCTAATGCCATAAAATACCTTTCATAATTATTAATTATTAGATATTTATTTT
ACATTCTAATGTTATATGTTTTTAAAACTAACATTAATTCAAAATCTTCTAATG
TTATATGTTTTTAAAACTAACATTAAGTATATTCAAAATCTTTGAATGTTATAATTTGG
AATCTTTATCTTTGGGAGATATGTTATCTAATAATCTATCAATTATACTTTGTATTTTTT
CATATCCAGCGAATGCTATAAAAATAGACACACCTATTCTGCTCGAATATGTTAAATCAA
AATTATCAGTTATTAAAAAGAAGATAATGCTAAAACACCAGAAGTTGATGATGTTTTTA
TAAAAAGTTTAAATCTCGTTAAAAAATTGGTTTTAGATTTAGCAGCTTTATCTATATGTA
AGAATTGAACAGTACCTATAACAGCACCTATAAGTAGTATAGGAAGGGAGCCAAATAACA
CATCGTAAATATTCAACATTTTACTCCCTTTAAAAATTTATGTTATTTATAAACATAAAT
GCTGATGATCAATGGGTTAACCAACATAATTAAAAAAACTAGCTATTGCATATATTAACG
AAAATGTAATAACTCCCCATATAGTTCTATTACATATTTTCCAAACAGTTCTCAACGAAA
TGGTATAATGTTCACCACTGGAACAATGGTATCTACCTATTAAAAACCATCTGAAAATAA
ACCAATAATATCTTAGTTTCTTTTTTAAACCTTCTGTGCGTTCACCCATTTTAAACCTTA
TTTATTGTCATATTTTTCTTTTAATTCATCATATTCTTTTTTAAGAGCTTCATAAAGAGC
TTCAGCTTTTTTAGAGCCGTTAACACGAATACAATAACCTATAGCAAGGCCAACAACGAA
TATAGCAACATAAATAGCAACACTTAACATTCATAATCCTTTAATATTTTTTATTATTTA
TTAAACAAAAAATTGGTCATAAAAATCAAATAAATATTACAAAAAATCAGGATTTTCAAA
TGGCTATTATAAAAGAAACATTGCCTTTTACATACGATGAAATATACCAAGATATAGCTA
AAAGATTAATTGAAAAGGCTGGGATGGAGGAGCTTATGAAGGCTCTAATGGGCAATCT
TAGCATCTGTTTTATCTTATATTGTAAGTTCTTTGAACTTCAATACCGCAGTAAATGTTA
ATGAGAATGTTTTAACTTTGGCGACTAAACGTAAAAATGTTATACAAGATGCTAGGGTTT
TGTCTTATGAACCTCTCATAAAAAATCTACAATACTCGAAATAACATTAAGTTTTACCA
GAACTGGCTATTTTAAAATACCAAAATATAGCACATTTACCATAAATGGGTTTACTTACA
```

FIG. 16I. Continuation of (CJLB-14 [organism=Campylobacter phage CJLB-14] complete genome)

```
ATTATTTAGGTGATGATTTAGAATTTAATATAGATAAAATAGGAGCTACAACTACAATAC
AAGTAAAAGAAGGTACATTAATTAAAAACGAAGAATATCCTGATATTTTAACTTATAAAA
TAGATGAAAAATTTGAATACATTGATATACCTTGGAATGATGTAGAAGATGATGGTGTGG
AATGTTATGTTACTTATTATGATACTTTTGGAAATTTATCGGATAATGCAACTTTTGTAA
AATCTTCTTTTAATTTAATTGATATTAAGGATAGCACCAATAATAAGTTCTTTAGAAAAG
ATGATGTGGATACTGGCAATGCTAGGATATATTTCCAACTAGGGACTGCTGGTACTAAGT
TGCCTTCTAATACGAGAGTTTATATTAATGTTTAAGAACTTCTGGAATAGACGCATATT
ATGAGAGATGTGATTCAGCTTCCGTTAACGGTGATCTTGGCTCTTTTTGTAAAATATTGA
CTTCTGGTAAAGATGCACCTGTATTAGTTTCCCAAGCTCAGGATGAAGAAAGTATAGAGT
CTATTAAAACAAATGCACCAATGTTTTATAATAGTGCTTCAAGAACAGTAACGATACACG
ATTATAATTCAGTTATAAAAACACACTCTAGTGTTAAAAATGTAGTGACTTGGGGGGGTG
AAGATGAATATCCAGTTGCTCCAGGTAATTTGTATTTTTCAGCTGAACCCCGAAGAAAAG
AACCAGAATTTACAATCTTTAAAAAAGTTCAACAAAGTGATGGAACATATACTTACAAAA
AAGAAAACTCTACTTTAGCTAACGGCGAATTATTGAATACTACTGAAATGAGCACCAATC
AATACTACATAAAAGAATCTTATAATGATCCTGACACATTATATTTAAATGATGGTGAAG
TTGTTTCTGCAGAAAAAGATGCTAACGGTTATAAAAACCCAGGTATTTTTGACTTGGTAG
ATACATATAATTTACCAGCACTTAAGAATAATCTTAAAAATCCAACATATGTTAATATAG
ATTTACAAGTTCTTATTAAACAATATCCATTTGGTACTCCAAAATCAGATATTCGTAAAA
AAATCTATGCAAAGATTCGTGAAAAAATGGCAGAAATTGAAAAATTTGAAGGTGAATTTA
TCCATTCTAACTTAGTTAGGCATTTAGACAATGAATTGGGTCTGGGTAATGGTATAGAAG
TAAATCCATATTTTAGTTTATTACTAAGTGAAGAAAACTGTGTAAAACAATTTAAAGAAA
ATAAAGACTTTAGTAAAGTAAATTGTTTTTATGCTAAATCATATGACAAATTATCTAAGA
ATTTAGTTCTTAGTGTTTATTTTAGTTTATTGGCTAGTGTGGGTGATAAATTAGAAGTTT
ATTTTAATAAAGAAAGTTTGCCGTTTATTTTAGACAATACAGATCATTATACTTATGAAT
TAACGGATACTGATATCAACCAATCTTACAAATCTTTTTATTTTAAGGATGTGGGATTTG
ATGAAGAATCATTAAATGTTAGAATAATATCATACGATGGGTTGACCACCTATGGTGGAA
ACGACATTAATTTATACAACTTAAAAAATAAAACCGTATTTTTTAATGTTAATATAGGTA
ATGAATTATCAGTTATTAAAATAGCATTGCCAAGATTTGTTAGTGTAGGTGATAGTTTTA
AAGTTTACGGTTTATATGGTTCTCGCAAAGCAGAACAATTAATATATGATTTCTATATTA
CTGAAGAGATACTTTCGCAAGGCTATCTACAATGTGATGATTTACAAAGGGGTAAATATG
CAGGTTTTGTAGGAGCAAGTGATTATAAAGTTGTTTATACTTGTAATAGAGAATCTTTAA
AACCAAGTGATAGTGAAGAACCTGATAGCAATGGGTTAAAATCTAATCAACTATTAGGAA
CTGCCAGTGGTTCTTGGGAATCTGCAGTTAACCAAACTGAAAGTCAAGATAATGTTTTTG
GTGATATAGAAACTTCTAATTTATATTATAACTGGTATGAAGATTCTGATGGTCAAATAG
ATATTAGAGTTTGGATACCAAGCTCGGTAAAAGCCAATGATACATTATTAATAGATTATG
CTCAAAAAACTACAAGTATTGTTATAACAGACGCTATGATAGCTCAAAGGCAGTTTGATA
CAAAAATAGATGGTATATTATTAGATGTTACAAAAATTTCATTTGGTAGTGCTGATGGTT
CTATCGGTATATATCCTACTTACGTAGAAAGACAAAATGAATTAACACCTGTAGAAGATG
ATAGAATTCAATTTGTTGCTAAACAGTTTGAAAATATAACAGAATATACACCTACAACCA
CATTTGATAGAGAAGTTCAATTAAAATCTAATGAAAAAATTACATTTTATGTTAATTATA
ATAATAAATTCGACGTCAGGAATTTAATTGCAAATCACGATGATTCATCAGATTCATATA
CAGTTAGTATACCAGAAGGTTCTCCATTAAAATACGAAGCACCATACGTAGTATTAAATA
ATTATAGAAAAACAGGAACTTTTAATTTTAATTTAGACGTTCAAGTAAAACGTGGTGATT
TATTATATCAAAATCAAATAGTATATGTTAAAGAAGCTGCAGTAGATTTATCAGTAGATG
AAGGGCCTGGTGGTGCTTATGTATATTTAGATTTACCAATTGAAGGTATATATCATACCA
AGGGTCAAATAATACCAGAAAATATACCCACAATAGAATGGGCTTTATTTGCTAAAGCTA
ATCCTGCAGAAGGTGAAGATAATGAACCTATTTGTTTTGAGGAAATACAAGAACCTAGCA
AAATACATAAAGTTATCCCAGCAAATTTAACAAATTATGTGGCGGAACAAAAAATAGTTG
CTAACTATGTTATAGATGAAGAATCTGTTAAGACTATGTTACCATTTTATACAACAGTTG
AAGAATATATTAATTTGGATCTATCTAAAGTTGCTTATATAAGAATACCTATTAAATTAA
TGAATAGAAGTGCTGCTACACCAGAAGAAGGTGAACAAATTGTGGGTTCTTATACAATAT
TTAATTCAAGGATACCTTATATTAGAGTTAAATTCCAAACAAAAATTTTTCAACCTGGAT
ATAATTATGAATTTATGTTAAATTACCCATCACATAATTTTAATTAATAAGAAATTCAA
TATTTAGACTTAGATCTGTAGTTTTTGATGATTTATTGGATTATCAAGAAGTTAGAGATA
GTTTAAGAGCTGGTGATATTGATATGAGCACTATGAGTGTTTAATTATCTAATTAAATAT
ATTTTAAGTTATTTTATGATATAATTATGCAAATTAAAATAACGAGGCTATGATGAAGTT
TTCAGATTTTTTAGAAGAGCAAGCAATTGCTAAATCAGGTGATTATGATTTGGAAATTT
GGAGTATTTAATGGTTCTTTTAGAATAGTTAAAATTATATACTATTTTAGTGGATGATTT
TAAATGGGTATTGATGGGTGATTCTGAACAATATGAAGGTGCAAGAAACTTATGGACTTC
CTTGTCTAAATCTCCTGGGTTTAACGTTGATATAGTTGAGTTAGCAACAGGTAGAAATTT
TGCTAAAAAGGTTAAATTAAAAGATGCTTTAGATCCAAGAATTTGGACCGATGAAGATTT
ATTTTTAACAGGAACTAAAGAAGAAAGAATACGTGGTAGATTTAATAGATTGGTATTAGC
TTAAGGTACAAAATAAAGGATGAAGTTTTCAGATTTTTAGAAGAGCAAGCAATTGCTAA
ATCAGGTGATTATGATTTGGAAATTTAAAGTATTTAGACGGGCCCAGATATACTTCAAT
AGAATATACATTCGATAAATCACCTTTTGTGTATAAAGTAATTTATGATGATAGAGAATA
TTATTTTTATCGTAGAGAATCTTATCATATTTTAGCTATTAAAGTACCTGAAGATTATCC
```

FIG. 16J. Continuation of (CJLB-14 [organism=Campylobacter phage CJLB-14] complete genome)

```
AACTAAAGCTAACCCCAATGGAACCAAAGACAGATTTTATCCTATAGCTATGATTAGATT
ATTACCCACTGATAAAATTAAAAGAATGGATTATAAGACACTTATACAGTTAGTGCTGT
AGAAGTTGATAAGGATCTACGAGGTAAAAAACTAGGTAAATTATTATATTATCTAGCAAC
TACCGTTCTTAAATATACTTTATTAGGTGATTCTGAGCAATATGAAAATGCTAGGAGAAT
ATATTATTCTTTTAGTAATAACCCAGGATTTACAGTGGATATAATTAAATTAGGTCAAGG
TATCTTAGCAAAGAATGTAAATCTAAATGATCACAACGATGAAAGAGTTTGGAGTACAAC
ACCCGATAAAGTAGGAACTTTACATAGGGTGGTTCTTAAAAGTGTTCATATGGAATCTAA
GGTAGAAGTCAAAAAATTAAAATAATTTAATTTAAGACTAAGAACCAAATAAATATACTA
AAAGTATGATCAAAGGTTTGCTGTGTTTAAAAGTATAGCTAAGAACTTAGTACCAGAAAA
TTACAAATCTAATAAATTTATTATGGACGTCCTTGACGTTTTTGTAGATTATATCTATGA
TAATTCAAGCCTAGCGATTGACATCAATAATTTATATAATTCTAAAAACGAAGTTCTATA
TGAAGAAATTATTAAAACATACGCTGCAAACTTTTATAAGACTATAACTGATGGTTCAAA
AAATCATAAACTTGCAGAAGCCGTTAGAAAAGCACACGAAAAATATGGTTTTGATTTTAG
TGAAACCCAATTAGATATAAATGTAATACACTTATTATCACAAGAACAATTAGAATTATT
TAAAAACTTTCAACAATCTAAAGGAACATTAAGATCTATTGAGTTTATATATCGTATTAT
AGAACAATTAAATATTGAAAGTTTTGTATTAGAAACCGATGGTCAATTAACAATAGAGCC
CGGTGAAAATATATTTGAATACCGCGTTTACGGATCTATGTTACCAGAAATATTTGAAGC
ATTTGTTAAACCATTAGCTCACCCAGTGGGTTGGACTTACTTATTTACAAGAACTTACGT
TCTTAAATTCGAAGATTATTTCTTATGCAAAGAAGTTTACGATGTAAATGTTTTTAGAGT
AACTTGTGAAGATTCTGATTGTGAAGATAATTTTAAAACAAATACTGGATATCTTTTTGA
AACTGACATTAATAATAATATAATATATGAAAATAATAAACCAAAAATGTATAAAGCTGA
TGGAAATCCAGTATTTAATGTTACAAGATTTGGTGTCAATTACCCAGAATTAACATTAGA
ATCTGAATTAAAATTAGTTAAAGATCCTACTATTAGAACTATTGAAAAATCCAGCATAAA
AGGTAATGACAAATTAATTGTATATTTTGAATCTGGTGAAGATTAGAACAAAATTCAAA
CCCTAAGAATTTAATATTATATTATTATAAAGGTATTAACTCATTAAATCAAGAAATTAA
AAAAGATTATACTGATTTCTTAAGCAAATGTGCTTTGGAACTTAATTATGTTAGAAGAGT
TATAACCACAGTTAAAGACAAATATCAATTTCAAGTAGATTTTGGTTTAGCTAGCACTAC
TGGTAAATTTGCAGCTATTGGCGCTGGTAATATGTATCTAGGTTCAGATACTTGGGTTCT
TGGTAAAAATAGAATCAATGCAAATACACCAGTAACTTATGGAACTAGAGTTCGTAATAA
AGTTTTACAAACTTCTGACTTTAAAGCATTATATAAGAAAAATGATAATTCTATTAGACA
GGTATTTGATAAAGTTTATTCTGGTTTTGATGATCACGTAAAATCAAGTACTTGTAATTT
TATTTTAGAATCTGACAATTTATATCATTATAGATTATATAATCCAAATGCAATATTTTT
TGAATTAATTAATACTTACGGGTATAGAGTTCGCGCTAAAATAAAATATAACGAAGATTC
ATTAGAAGTTATAGCTGAAGATGAACTTAAAAATACACAATTATTATATATAGATAAAAC
ATTATTCAGTAAATACAATTCACAAGTTTACAAAGATTTTAAAGAATCTATGAATAAGCC
TTTAGGTCAATATTATACAGTCCTTAAAAAAGGTGTTAATTACTTGAATATTGTAGATTC
TAATGGTTATATAGTTAAAGGTAATTATAGGCTTGTAGATTCTGAATATAGGCTTTATTT
AAATATAAAAGATCCTGTAACTATTCAATTTATTGATGATACTTATGAATACGATTCAAG
ACCATTTCAAATTATTGATGCCGAATTAAGTTATAATAAAGATTCTAAATTATATGAATA
TACTACACCAGAAAAAGAATACTATTTTGTCAGCGTAGCTAATCGTATTAGCAATGTAGA
TTTGGACATTATGTATATTGCTGGTTTACAAAAAGGTTTTAAAATAACTTCAAGCACTGC
TCAAAAAATAAGAGTATATGTTATAGATAATACTTCTAAAAGATTTCCGATAACTATACT
GAGTGCAACTAATGAAACTATACAAGCAAAAGAAAATAGTATATTCTTAGGTTTAATCAA
TGCTGATAACCAATACGTTGAAGGACAAATAGTTTACGATTCTGAAGGTAAATTAGCAAC
ATTAGATTGTAATGCAAAAACAAATAATTTAAGTTTATTATACTTAGATTATTCTGCAAG
TATTAAAAACCCAATAACTATTAAATCTACAACATTTGATATTGCTGGGAAATTTTCAGA
AGTTAATGATAAAAGAGGTAAATTCCTTTATAATTTTAGAATCGAAATATTATGATTGT
TAATATATTCGATAAAAATAATCAAAGAATACAATTAGACTATGATATTGAAAATACTGG
GGTATCTTTTTATACTGATACAAATGAAGCTATTACAATACAATACTTTGATAATATAGA
TGAAGGTATACCAAGAACATATACAATAGATGCTGAATTTAAATTAGATACTAGTTACAT
TAATTATAACGCAAAAATATTTAAATATAAAGATATATTATTAAATATGGATACTAGTAC
AAACAAATATGTTTATAAGCACAACGAAATGAAAACTTATCCTTTAGTTGTTATGGATAC
TGATGGAAATGTTTTAGACGTTGAAATAGGTATTTTAACTACTGGATTTAAAATATCTTA
TTCTGAAGGTATAAAAGTAAGAATATATTATTTAGATGATACTAAAAATAGGGCTGATGT
TACTTATAATAAAGCTGGAGACCCGGACCCCACAAAATTATTATATGCTGTTAAAAATGG
TGTCATAGTTAAACAAGATATCAATACAGTGTCTACTGAAGATTTTTATTCATTTCAAG
ATTAAAAACTCTTAAAATTAAGAAAGCTGATTTAAAAGCTGTGGAAAGTAACGACCCAGA
TTCAAAACTAGGTAAATATAAATTTATTAAAAATATTGAATATGGTTTGCCAGTTATGGC
CGGTTTTAACAATGATTTAAAATTCAAAGTTAATGAAGATTCTATAACAATTTACACAGC
AACTAAAAAAGATATTAATATTAGATACGTAGAAAAAGTTAACGAAGAAAGTTTCTTATA
TACTTATAGTATAAGAAAAGATGATGATTTATTTATAGATGCGCAAAAAGATTCTATAA
ATATTTAATAGATTATCAATATGATTATTTAAATAATAGAATTATTTTTACAAAAGAAGA
CGATGATATTGTCAAATTGTTTTTCTTAAAGAATAAAACACAATAAGAAAACAATACTTAG
TATTAATAACGCAAACTTTGAGGATATTGATTTTCCAATTAAAATTTATTTAAATGACGA
CTTTGTTGAGTTTGAAAATAAGGAATCTATGCAATTAGATGCAAATCCATTAGATCTTAA
ATTCAATCAAGATATTAAAAATAGAAATTCAACAATTAGAGCTATTAATAAAGATCTTGA
```

FIG. 16K. Continuation of (CJLB-14 [organism=Campylobacter phage CJLB-14] complete genome)

```
AGTATTGGAACAAATAGATTTTAATTTAGCACCACAATATACCTTTAAAGCACTTGGTGA
TTATCTCTATGAGATAGATTTTAATAAGATTAAATTCAAAGAAAATAAACTTAATGAAGA
ATCCTTGTGGTATAGAGAAAGTTCAGTTTATCATAATCATTATGTAGGATATTTTGCAGC
TAATAATGTTCAGCCAACTCAGGTATTTACTGGTACGTCAAACAAATTAGATTATGAACT
CAGAGAAACAAACCCTTGGGGATTAACAGCCATAGATACATTTGAATTAACAGGAACTGC
TGCAAATGATGGATTTGATGTTAATTTTGAATTTATTGATTCTTGGCCAAAAATCACAGA
AGTCTATAAAAATGATTATACAGGATTCTATCAAATAAATGGGGTTGGCAATCGGGATA
TGTTGACGTTTATAAAACTACTAGGGATCTTGAAAGATTTAATGAAAAATACGAAAGATT
AGAACACGCCAGCGTATACCAAATGGATGATTATATTGTTATAGGATCTAATGATATAAC
AAAAGATTATATGTTTAAATGGTATCCAACTAGTAAGTCAAATGATTTTAGTGATAGTTT
CTTAAGAAATGGTCAAGTCTCTGAACCAGTAACACCTAATAAAATATATACTAGAAAATA
TGATAGAGAACCTGATAATATAATTAATAAAACAAATACTTGATTATAAAGGATTTAGAT
GGCTGATATTATTCAAATAAAATGAATCAAGTGATGGGTGATTTAGCTCGCCCCACTAA
GTTTAAATGTCAAATATTTCCACCCAAAGAAATTAAGTGCGAATTAAGTATTTTAAATGA
AGGAGATTCTGCAACATCCAGTACTTCTGAAATAGGACAATATTTAGACTATTTTTGTCA
CGCTACAAGTTTTCCGGGATTGACTGTAGAAACAATAGATTTTAAATATAGAGGTAGAAC
CCTACCAGTCAAATCAGTACAAACTTATCAACAAAAATGGACAGCAACTTTTTATAATGA
TGAAAAACACGCAGTTAGAAAGTTATTTTTAGATTGGATGACTTATGATCAAGCTCACCA
ATTTGAGGATAAAACTAAAGGTAATTTTGAAGGTATATTACCAAGCATTTCTATATATCA
ATTAGATTTTGAAATGTCTAAAGATTGTGTTGTATATACTATGATGAATGTATTTCCAAC
AAATGTAGGAGAAATTTCAGTTCAATACGACGGGTTAAATCAAATTGAAACTTTTACAGT
TGAGTTTGCATATACACATTTTGAAATTAATACAATTTCTGGGGAGGGGTTAACGAGTTC
TGAAGTCACTAGTTTGATCAAGAACACTATACAGAATACTATTAATAATGTTACCAATAC
TTTAAAAGATGCTGTTTTTGGTGCTTTAGATGATTTGATTTCACCCGTATTAGATTCAGT
TTCAGATTCATTTGAAAATTTTATAAGTACAAAATAAGGTTTTTTATTATATAATATATT
TTCGATCTTTTTAAATTGTGTTGTTACGAACTTTTTTTGAGTTTTTACAGTTTATACTAT
GCTAGTACTGCTAAAACTTAAAGCAATATTAAAAAGTATAAAAAATGCTTGGGTTTTTAG
TATTTTATATATGCTAGTACTGCTAAAACTTAAAGCAATATTAAAAAGTATAAAAAATGC
TTGAGTTTTTACAGTTTATACTATAGTATTAAGTCTAAAACTTAAAGTAATATTAAAAAG
TATAAAAAATGCTTGAGTTTTTACAGTTTATACTATAGTATTAAGTCTAAAACTTAAAGC
AATATTAAAAAGTATAAAAAATGCTTGAGTTTTTACAGTTTATACTATAGTATTAAGTCT
AAAACTTAAAGCAATATTAAAAAGTATAAAAAATGCTTGAGTTTTTACAGTTTATACTAT
AGTATTAAGTCTAAAACTTAAAGTAATATTAAAAAGTATAAAAAATGCTTGAGTTTTTAC
AGTTTATACTATAGTATTAAGTCTAAAACTTAAAGTAATATTAAAAAGTATAAAAAATGC
TTGAGTTTTTACAGTTTATACTATAGTATTAAGTCTAAAACTTAAAGTAATATTAAAAAG
TATAAAAAATGCTTGAGTTTTTAGTATTTTATATATGCTAGTACTGCTAAAACTTAAAGT
AATATTAAAAAGTATAAAAAATGCTTGAGTTTTTAAATTTTATACCACAATATATGTAAT
TTAAGTTTACTTTAAGTTTTGAATATACTAGACTTAAATCTTAATAAATACTTAAAAATG
AAGTTCAAACAAGGCATTTATATACCAAAAAACCCAGAGAAATATATACATAGTTATACA
AAAATGAATGAACACACTGAATATCCTGTCTATAGGAGTTCTTGGGAGCTTAGTTTCTTC
AAATTCTGTGATTATTCACCCTCTATTACTAAATGGTCTTCCGAACCGGTTGGTATAAAG
TACTTTAATCCCGTCAAAAAACGACAATCCACATATTATCCCGATGCTATGATTATTCGT
AACGATATGACATTTTTAATAGAGATTAAGCCTAAATCTCAATTACCAGGTTCTAACTCA
AAATCCAGTTATGATAAACTTTCAGCAGCAGTTAACGAAGCCAAGTATAATGCCGCAAAA
TCTTATTGTGAAGCAAATAATATGCAATTCATAATCTTAAGTGATTCTTTCTTTAAATCT
TGATTTTAAGTTTTTAGCTTTTGGTTTTAAAACTTAAGTTTTGAATTAAAAAAATTTTTG
GCTTTTTTAATATGATATATTATAATATAAACTTTTTTTTTCAAAAAATTTTAGTAGTTT
TACAGTTGTTTAGAATTTGTAGAATTTGTTTTAAAATCTAAACTAAAGTTTCAGTTTAAA
TCTTAAAGTAATATTAAAAAGTATAAAAAATGCTTGGCTTTTTAGTAGTATATACTATAG
TATAATGTCTAAAACTTAAAGCAATATTAAAAAGTATAAAAAATGCTTGGCTTTTTAGTA
GTATATACTATAGTATAATGTCTAAAACTTAAAGCAATATTAAAAAGTATAAAAAATGCT
TGGCTTTTTAGTAGTATATACTATAGTATAATGTCTAAAACTTAAAGCAATATTAAAAAG
TATAAAAAATGCTTGGATATTTCATAGATCAACACAGAAGACTGCAAATATTTAAACCAT
TCTAATAAATTTAAGAATTTTTTAAGCTTATATATTATATAATATACCAATTGAAAGGAA
AATAATGAAACTGACTTACAAACACAAATTGTATACCAAACATCAAGATATTATTAACAC
ATATCTGCGTTTAAAAGTAGAGTTTAATTTATTCAAGCTGGATTACAAACGACTTAGATA
TTCAAGTTTATTCACACAAAATACAAGACTTAAAACTCAAAAACAAATAGAAGAGCTTGA
AACGAAACTAACCAAAAAGGCCTCAACACACAAAAATTACGCAAGTTATACACTAAAAT
TGTTAACAAAAAACCTTTCAATGATTTTGAACAAATCATCATTAATAATTTTGTAGAAAA
TGGCAAAAAAGCACCACAATTATTCAAACACGAACGTAAATTCGATAATAGATTTACAAG
CCTACTATTAGAACGTAAAAAACGTCGCGCTAAAGCAGCTAAAGAAGTATACGCAAGAAG
ACCATTATCTCCAGAAAAACAAAAAGCTCAGCAATTAGTTCCATATATTTTTCAATTCAT
TAAACTCAGAACTATGGAAAATTTGGCATATAATGAAGATTTAGCAGTTGAAATAACTGG
CAGAATTTTTGGACCTGGGTGTGAAGAAGCTCTTGATATGTATTTAAAAGAATTCAGAGA
TTTGTATGGTAATACAGACCAAGCTTTAGAGCATTTCAAAAAAGCTGAACTATTAGCTAA
TTAAAAATATATTTAATATTTAAATTTAAAACTAAAGTTTAAAATCTAAAGGTGGTAAAA
```

FIG. 16L. Continuation of (CJLB-14 [organism=Campylobacter phage CJLB-14] complete genome)

```
TGAGTGAAACTCGTATGAAACACGATTATACTAACGAACTTGAACTAAAATCGCTAGCTA
TTCGCGAAAAAAACTTCAGATTAAATCTAGGCTCTGAAGATCCTGATGGTTCTATAAATG
AAGACTTAGACATTAAGATAAAAGAATATATTAAAACAAAAGATCCAGATCTTAAAGACT
ATATTATTAGTATATCCGAGGGTGTAAAAATATCACCAAAATCTCACGAATATTTTGGTA
ACATTGTTATTCTAATGATTAAAAAAATATTAACTAAACCTAATTTTTCCGGGTATACTT
GGCAAGATGATTTTTATAGTGATGCTTGCTATCGTGTATTTAAATATATTCATAACTTCG
ATCATACATTAAAATCTAAAATTACAAACCAATCAGTATCTTGTTTTAGTTATATTTCAC
AAATAATTCATAATAGTATTTTAGCTATTATCAATGAGAAAAACAAAAAAGATAAAGAAC
TGAAAACTTAGCTTGTATGTATAATTCTGAATATGATATACATAATGAATCTAGGAATG
CTTCAACTATAGATATTGTTAATGAATTATATGTAGATTACACAATACCCAATTTTAATT
TAAAAATGATTGAAAATATTTTAGATACCACTGAAATCAAATACAAAAATATTAATATTA
GATACAATGAAGGTTTTATATCATTTGATGATTACGCTGAACTTAAAAACGTTCTAAGTA
ATTATAAACATTTTAATGTAAATCTAACTAAAGGTGATTCAAAATGAATATTAACCAAGA
TTTAATAGCAAAGGAAATTAAAACATTAAATAAATTCTACAAGTTTTTAAGAGAGCATAA
AAATGAATGTGTTATGGAAATAATGCAAGATTTTTGTGATTTAAATGATATCCCTTTAGA
AGAACTTGGTTTTTTGATATCAGAGGATGCATACTTAAAAGATTATATAGAAGCAAATCT
TATTAAATATAAATTCTATAAAAGTCCTAAAAAAACTGTTTTTAGTGATGATTTTTAATT
TTATGTATATAAGCAATATCATAAATTACACTTGGTGTTAAAATTGATATTTGCTTCGAT
TCTGCCAATACTAAATACTACTAACACTACTAACACTACAAAAAATAAGCTTAAAACAAA
ATTAAACCGATTTTAATAAATATAAAAAAATTCAAAGAAAGGTACCTAATGTTAGACAA
AGTTTTAAGCAACGATAGCTTTAAAGATGTTCTAACAGAATCAGTTAAATCAGAAATTGA
ATCTGTGTTTAATGAAGCTGTTGAAATTAAAGCTGTTGAAATAGCTAATGAACAAATCGA
ACTCGAAAAAATCAAGTTAGTAGAAGAGTTCAAAGAAGCTAAAAAAGAACTCGAATCTAA
AATTACTGAAAATATAGATTCATTCATCAATGAAGAACTTTATAAATTTAAAGACGAAGT
TCTTGAAAAATTAGACGCTGTTGTTGAGAATGAAAAGGCTGCTACTCTAGTAAGTATATT
TGATAACTTAGTAGATGTTGCTGGATCAAACATACTCGAAAATTATGCAAACAAAGATTC
TGAATTAAGTGATCAATTTGATAAATTAGTTGTTGAAAATAGAGAACTTAAAGCTGAACT
TGCGATTCTTCAAGAATCTAAAAAAATTGATGAATTAGCTGCTAATTTAAATCTTGTAGA
AAGTGAAAAATTTAAAAAATTAGCTAGCTTGGTAGAACGAGGTGAAGGTTTTGAATCTAA
ATTAGAAGCGTTATTTGAAGCTTGTAAAAAAACAAACGAAGATGATTCTGATGATTCTGA
TGATTCAAAGGATTCAAAGGATTCAAAGGATTCAAAGGATTCAAAGGATTCAAAGGATTC
AAAGGATTCAAAGGATATCAAAGAAAGTTTTAAAAACAAAGCAGGCGCTGACATTAACTG
GGCTAACTACTAAGTTCAACTAACAAGCTCAGTTAAAATTCAGTTAAAAAATAAATATAT
AAAAAATTAAAAGGTTAAAAACAATGGATAAAAATGTAAGTCTTAATGAAAAAGTAGAGT
CTTATATTAAAGATTCAAAATATGCTGCTTTAAATGAAAGTGAAGCTGTATTGATGAGTA
CATTGCTCAGCAACACTGCTTTAGCATCTCAAGGTGCACTTGTAGGTGAAAGTGTTATCT
CTAGTGATATCGCTCAATTTACACCAATCTTAATGCCAATTGTAAGAAGGGTTTACCCAG
CATTAGTTGCTAATCAACTTTTAGGTATTCAACCTTTAACAATGCCTACAGGTTACATTT
ATGCATTAGTCAATAGATATACAGGTAATAAAAAAGACGGTGCTATATCTCCAGTTTCTA
AAGCTCAAATTCTTGTGTTTGAAGCTAATGTGACTAAAGGTGATACTGTTACAGGTACAA
CTTCAAGTGCGACAGGTAAAATTATACACGTTGAAAAAGATGGTAAAACTGCTTTAGTTC
AGTTAACTAGCGATAAAAAATTCCAAAACGAAGCTGCTGATAAAGGAACTAAAATCGTTA
ACGTTTATTCTAACGAAGCTACTTTCCATAAAATCTTAGAAACTTATTCAGGACCATATA
GTACAGCTGACGGTGAAAAACTTGCTGAAGATATGAACACTGTAGGTTTTGGAATTGAAA
AAGATACTGTTGAGGCAAAACAAGAAAACTTAAAGCTGAATATACTTTAGAAATGTATG
AAGATTTAAAAAATCAACACGGTGTACTTGCAGATGAACATTTAGCTAATCTTATTGCTG
CTGAAATGCAAACTGAAATAGATCGTGAGATTATCAATTTCGTAAACAATACAGCTACCG
TTGTCGCTGATACTTTAAGTCCAGGTGCTGAACACAAAGAAGCTGGTAGATGGGAAATTG
AAAGATATAGATGTAATGCTATCAAATAGATTTAGAAGCAAGAAACATTGGGTTAATGA
CAAGACGCGGTTCAGGTAATACATTGCTTGTATCTCCAAAAGTTGCTACTATGTTAGATC
AAATCGGTACATTTAAATTTGCTTCTAGTTCAAGTAATATAGCTACTGATGTATTTACTG
GTAATGTAGGGACTTATGATGGTAGATATAATGTAATTGTTGATCAATATGCTAAATCTG
ATTATATCACTGTTCTTTATAAGGGTACAACCGCTCAAGATAGTCTCGGATTCTTCTGCC
CATATGTACCATTAAGCTTCCAAAAAGTAATGAATCAAGAATCAGGACAACCAGGTATGA
TTGCAAGAACAAGATATGGCTTAGCTACTAATCCACTTGAACCAGAAAATTACGCAAGAA
CATTCGGTGTAGATTTAACAGGAACTATTTTAGCTTAATTGCTTCAATAATTTGGGGATG
TTAAATCCCCAATCTAATTTTTAATACATAAACTGAAAAAACTCTTAAAATTCAATTTTT
AAATCCTTAAATAAATAATAAGATTCCAATATACTTTAGTCGTTTTAGCCTAAAGGCATC
GAAATTGGTTTAAGAGCTCAACAACGAAGCTTGATGCAGTTCGAGAGACTTTTTGTAATA
TCAAATCATATTAAAAGGATTAAAATGGCAAATTTACTTAGCCCTGGTATCCAGGTTTCT
GAAGTAGACCAATCTCAAATTACGCCTGTTGAAGGTGACTCTGCTGCCGTTTTTGGTGGT
GATTTTGAGAAGGACCAGTTGGTGTACATACTTTAATCTCAAGTGTTCAAGAACTCAGA
GATAATTACGGTATGCCTAATACAAGAATTATAATGATTATTATCAAGTTCAAAATTTC
TTAGCTTACAGTGGTGCAATTTATGTTTCTCGTGCAGCAGACATCAATGGTACACCCACA
CAATTAGATGGCTTACAATTTGAAGAAAATGCATATAAAACAAATGTTAACGCTAGTAAA
ATCGAAGGTGTTAAAGTTATCGAAGTTGACTCTGTAGACGTTAAATTCGAAAAAACTGAT
```

FIG. 16M. Continuation of (CJLB-14 [organism=Campylobacter phage CJLB-14] complete genome)

```
AAATTCGAAGTTGGTCAAGTTCTTAAATTCAACGATTCTAATAAAGAATATAAAATTAAA
TATGTTAGAAATGAAGTTAAGCAAATACCAAATCCAGATTATCAACCATTAACCCAATTA
GTAGTGGACCCAAGCCAAGTAAGTGCTTATGTTGATGAAGTTGTTAGCTACGTAATAACA
ACCGATGCAGAATCTTATACTGTGAAACAGATAGACCTGATGTGGTTCTTGTTAACAAA
TCTAATAAATCTTTAACTGCATTAAAAGTAGGGACTGCTATTGTAACTTTTAAAGCTACT
AAAGAAGGTTCGAGAACTAATTCATTTGAATTAAAATTCGACGTTCAAGAAAAAGAACAA
ACAAAACTTTAACGTAACAGCCGAAGATGCCGATCCAAGTGGTAGAGCTAACCAAAAATC
TAAAGCTAAGAAAGGATAATAAATGGCAGATATCTACGATATACCAGAGTTTATAACTCA
AGAAGTAACTATTGTTACTTTAGACAAAGAACCAGGTGAACTAAATGCAGACACTTCAGT
ATACTTAATGGAAGGTGAATCTCAACCAGATTCTAATTATATTTTAAGTCTTAGAGGTGC
TAACACTGAATTAAAACGCGGAGATATTATAGCATTTTCTGATGTTTTAACTGATCCAAG
ATTCAGAATCTTAGCAATCTCTGACAGTATAGTCAATGGTGAAGCTTTCACAAATATTAC
TTATGAAGGAACTGAGGATTCTGAAGCTATTGTGAAGCAACTAAAGGTTTTCCAGTTTA
TTTAGTTAAGGCTACTAAATCATCTTGTGTTGAAGTTCCTGTAGAAGGTTCTGAAACCAA
ATACGATGCGGCAGAATATGAACTTTATGACCATACTATTAGTAACTTCAATACATTTGA
TGAAGATAAATTATCTAAACCATTTGTTTATAAAGATGCAAAATTAAAAATATTTGCTAA
AACACCGGGAGAGTGGGGCAATAAAATTGATGTCGCAATCGCACACCCTGATGATTTCAA
CAAAGGAAAATATATCACTGATGGTATACCATTAGATTCTCAATTTGATTATATTCCTTA
TGGTGATCAATTTGCTGTTATTGTTATCTACGCAAACGAAATTCAAGAATCATTTATTGT
AAGCTTAGGCTTAACTGATAAAAATGAGAAAAATGAATTTACTTATATAGAAACAATGAT
TAATGGCAAGTCAAGCTATATCTTAGTTTCTGTAAATGAAGCAGTTCAAGGTAAACCAAA
AACTTGTTTAGGTGAAGATTTACTTAAACTTGAAAATGGTATGGATTCAGCTCCAGGTAT
TGACGATATTATAGACGCTTATACAATTTTTGACAACAAAGAAGAAATCGATGTTGATAT
CTTAATTTGTAACGAAACTTATCCAAAAGCAGCTACTGATATTGCGATTACTCGTGGTGA
CTGTATAGCATTTATGGGTGCACCAAAAAGTTGTTCAGTGGGCTATAAATCTACAATTGC
TAATCAAAAAACACTTGATTTTAGAAAATCTTTAAATATAGATTCTAAATATGTAACTTT
GTGTAGCAATTACAAATATCAATACTGTGCTGAGCTTGGTGGTTATAGATGGCTGAACTT
AGCTGCAGATATTGCAGGTCTTAAAGCTCAAACAAATTATAATCAAGCTAACTGGTATGC
AGCTGCTGGTCTTAACAGAGGTCTCATTAAAAACTGCGAGGCGTTGGCATATAGCCCAAC
TGGTGCGATGCGTGATATACTTTACAAGAATGGTATAAATCCAGTAGTTATGTTTCCAAA
CACTGGTGCTGTTCTTTGGGGTCAAAAAACATTACAAACTAAAGCTTCAAGCTTCGATCG
TGTAAACGTTGTTAGCTTGTTTAACCATTTGGAAAGATCTTTAGGGCGTATGTCGAAGTA
TAGTCTATTTGAGTTCAATGATAGTTTTACAAGAAATTACCTTGTAAGTATTATCAAACC
TTTCTTGGCTCAAGTAAAAGCTGGTCGGGGTATACAAGATTACCTTGTGATTTGTGACGG
ATCAAACAATCCAGCAAGTGTAATCGCTGCGAACCAACTCGTCATAGACGTATATATTAA
GCCGACTTATGTTGCAGAGTTCATTCATCTCAGATTCACGAACGTCGGTTCAAACGACTT
CAGCATTGTTGTAAGCTAAACCCAAGGTTCAATTTACAAAAGATTCAAGGATTTTACGAT
CCTTGGATCCACTGAAACTTCATATTTCCACAATCGTATATTATTCTATAACCATTTAGC
ATCATATTAGCACTTTCTGAAAGACTAGGGTCGAAAATCTCTAACTTTTCTTTTAGCTTA
TGTTTTTGAAATTGATGTCTAGCCAGCAATTTTAAATCTTTGAAGTAAAAATAATTCGGT
TCTGTATTCTCTACGAACTCAAAACCTAAGGTTTTATATATTGACCCTTTACTAAATCTT
CTATTAGCATAACTCACTATACTTTTTGGTTTATAATTATCTAAGAAATACTTAAATAAT
TTAGAAGCTCCTCCTATAACTGAACAATATTTTAAAGTACATAATCTTATTAATTCATAT
TCATAGTTTTTATTAAATCTAGGCTTACCAAATGTCATAACTTCTACTAATTCGTTATTA
TAAAATAAACCTAAATTAATTTTTGAAACTGTCGATTTTTGTAAATGATTCTCATTTAAA
AAGTCAACTACTTCATTATAACTTAATTCTTTTATAATACATTTTCTAGCATAAATTTTT
TTATTTAATCCTAGTTTATTATTAATCATTGAAAACCATATATCTAAATCATCTGATTCA
AAAATATGAAATAATTGTATTCCTAGGGCTTCGCACATTTCTGTCTTTTTTAAATGATAT
TTTTTATCATAATCAGGTGTATTAAACATTTTATGTTTATGCAAACCTCTACTATGAAAA
AATAAACCATCGTATTCAATTGCTAAATTATAATCTGGTAAAAATATATCTAATTCATAA
GGTGATATAATAGATCGCGAGTTAACGACTAGGTTATCTACTTCGAGCGATTTCGCAATT
TTACTTTGTATTTGTGAACGACACGATTTATTAGGAGCTCATAAATGCTTCTTTATTAAAT
TATTTTACTGCTGTAACATCCGATATATTAAAGTAACTCATAAATGCTTCTTTATTAAAT
AAAGAATCATTAATAAAGTTTTCTTCTATAAAATCTTTGTTTAAATCACTCCATTTAGTA
ATATGGCTAGCTCCACATTCATTGCCATAGATTTCTAAATTGTTTGTTTTCTTTTTTCA
CTGAGTTCTGCTAGCTCTTTTGCAGATTTAGAAGCCCAGGTTTTACTAACAGCTTCTTTA
AATTCTTTTGTTTGAGAATTACAGATAACACCATATTTTTTAGATTTGTTTCTACAGTT
TTATTTTTAACAACTTCACTTTGTGTCGCATATTCGATTATATATTTACTTAAATTGGTT
TCTTTTCTTTTATTGTTTATTTCAGTATAATCTGTATTGGCTTTGGTGTTTCTAATTTTA
TCATTTACTTCTGGTATTTGTGATACATTTTCTACATTATATTTTCTTTTATTGTTTCT
TTATGTTTATCTATATTATTATAGTTAGCATCACCATATCTTTCTAATTTTGTAGATTTG
ATTTTAGCTATGCGTATTTTGTCATATTCTGGTGATTTTAGGCATTCTTTACAATATTGT
GTCTTTGTCTTAGTTCCACAAATTACACAAAAATTAGGATTGTTTTGTAAATCCTTGTAG
TCTTTGTATATTGAATGAAATTCCTCATTATATTTAGGGTCTTTTAATAGAATATCAATA
ATTTGTTTTCTATAAAGTGGATACTGTTTTAATTCAATGAGTATTTCTTTGAAAGTTTTG
TTTAGATCTATCGTTATATTTTTATAAGTTACTTTCATTTAAATCCTATTTTAAATAATG
```

FIG. 16N. Continuation of (CJLB-14 [organism=Campylobacter phage CJLB-14] complete genome)

```
TTATTATATAATATTAAAACTTAAAAATATATTAAACATATTTTAAAATATTTAAAATAT
TAAGTAAGTTTTAAGCTTTAATATATTATAATTACAAAAAGGAGATAACAATGTTGAACT
TAAAAGATTTAAATCACAAATATATTGATGCTTTATATCGATGTTTGAATGGCACTGAAA
ATACACCAAACAAATACCACTTAGAACCGAACGTTGGTATACACACCGAAATGGTTATGG
CCAAAGTCAACGAATTATATAAAGATGATCCTGATTATAAAGTATTAATATTAGGGGCAG
CTTTACACGATATTGGTAAAATAATAACTAGAACACCATCTAAAAATAACCCAGAAAAAA
TACATTTTTTAAATCACGAAAATGCTGGTGTGTTCTTTGCATTAGATGTTTTACACGATT
TGGATTTAAATCTATCCAAACAAGAAATAATAGATATAATTAAAATAGTAGCCCATCACG
ACATTTATAAATTCGATTTAGAAACCCTTAAAAAACGTTATGTTTATAGAGATTTAAAAT
TATTATCCAAGTTTTCAGTTGCTGATGCTTTAGGTAGAATCACTGAAGTTCCAAAAGAAC
TTCCCGATTTAAATATTGAAGCTTATGATAGATCTAATGTTGCTAATGAACCAGTTTTAG
AAGTATTAGTAGGATTACCAGGTTCTGGTAAATCAACTTATGTTTATATGAATGATAAAG
CAGCTATATCAAGAGACGATATTTTAATGAGATACCGGTTTTAAAAAATATAATCAAGTTG
AATATTCAGATATTTGGAGAAACTTAACAGATTCTGATCAAAAAGAAATCGATTCTTTAT
TTAATGATAAGTTTTTAAGAGCACTTCAAAAGAATCAAATATTTTAATAGATAAAACGA
ATACTTCGATTAAATCGAGGCGTAGATTATTTGCTACTTCGAGCTTGGTTAGAAATTATC
ATAAGAAAGCAGTAGTATTTTAACACCTATACAATGATATTAAATAGACTTGAAAAAA
GAAATGCTACAGGTAAAATAATTAATAAAAGTGTTGTGGATGCTATGATGAAATCTTTTG
CAATACCTACTTATGAAGAGTTCGATTCAATAGAGTTTAGACTTTGGTTCTAAACTTAAA
AGCTTAAATTTTAAAATAATTTAAACTAGAGTTTTAGTTTTTAACATAAGATTCATAGAA
CTTTAAGTTCAATTATAATATAATATATGAAAAAGGAGTTATATGCTAGTTCACACGAA
GTTCCGTTAAGTCTTTTAGAAAAATCAAGAACGTTTAATGATTATGATTATGCTTTAGTT
CATTTATTTGAAATCTACCCAGAATACAAACAATTTTACATAGATTCATTAAAAAAGCGT
AGAATAGTTTATTTAGATAATTCTTTATTTGAATTAGGAACCATTATACGATCACGATAAG
TTTGCTAAAGAAGCAAATGAATTAGGTTCTATCAATCCTAGTAATTTCTATTATATAGTC
CCTGATGCTTTAGGTAATGCTAGTGCAACAATACAATCTTTTAGAGACTTTTCTAAGTTT
AGTATACCTGGTAAGAAAATAGGTGTTGTTCAAGGTAATACTTTAGAAGAATTAACAGAT
TGCTTTAAGTTTATGAAAGAAAATGCAGATATGGTAGCTATTTGTTTTTCAGGAGACTAC
TTCTATGAATACGAAGGTGATACTAAAGAAGCTAAATTAACACAAGCAAGGATAGATTTT
ATAAAACATTTAGATAAATTAAATCTATTAAAAGATTCTAAAATACATTTATTGGGTTGT
CAAGTTCCTCAAGAATTTAAAAATTTATAAGAACATTCCAGAGATTGTATCTTTAGATACT
TCTAACCCAATTGTTCACGGTATATATAATGTAAGATATTCTAAAGATGGTTTAAGAACT
AAAATAAGTACTAAATTAGTAGATCTTATAGATTATAAAGGTTCCGCCAATACTATTTTA
TTAAATATTATGGATTTTAGAACTATTAATGGCCTTTGATATGGTTTAAATAGCCAAAAT
TAGGTTTTAAAGGGGTTTAAATGAAAATAGGATTTACAGGAGTTTCAGGTTCTGGAAAGA
CGACTATAGCCAAATTATTAAAAGAACGATATAATTTGGATATTATTCCAGGGCCTGGAA
GAAAATTAAAAGAATTGGGTTTTAATATAAATGAAGATGGTGATATGGAAACTCAAAAAG
CAGCTTTGCAAATTCATATAGAAGATCTTAACAAAGATGGTATATACGAAAGAACAATAT
TAGATGCTGTAGTTTATACTAAGTATTTAGTAGAGATTAAAAAATCAATACCTGATGTAT
TTTTAGATTTAGCTGAAATAGTTTCTATTGAATTAATGAAAAAATATGATATAGTTTTTT
ATATTAAACCAGAATTTGATTTAGTTCCGGATGGTGTCAGATCTACTGATTTAGAATTTA
GAAATATTTGTAGTAATTACTACGATTACTATATAGATACCTATGGTATTAATGTAGTTA
ATTTAAGTGGTTCTGTAGACGAAAGATTTAAAGCAGCTGTCAAAATTATCGACAAAAGAT
TTGGAAATTTAAGGAACTTTTAAGGATACTTAGTATATAATTATAAATATAAATAAATAT
AAATAAATTAGATCTTTTAAATATCATTGTTAAACAGATTTAGAATATAACCAAAATTGT
GAGCATTTCGGATTTCCTGACAGAGAAAATCATAGTAGAGTCACTCCTTTTTCTTTAGAT
TGCAATGTAACTTAATTGAAAGATTAAAAAATTTAAAAAGTTTAAAAATCTGAACAGAGA
GATGCTCACAATTTTGGTTATATTTTAGTTTTAAATTCTAAACTTAGAATGTTAGAACTA
TAAAGACTTTTATGTGCAGAACACCATACATACTTCTTATTTAATCGGGAATTTGTTAGT
ATAAACTTAGCACACCGGAAGTCTTTATAGTTCTAATCAATGTTCAGAATAGTCTCTACC
TTGCTAAGAGATAAGCGAACTGTGGATACTTCTATAATATTTTTATGAAGGACTGGAGGT
AGAACACTACCACAAACTCAAGCACATTCTTTAGAACTCGTATATCTTTTCTATCCTTATA
TTTTTGAAGGACCATTACTTGCTCCTATCAGAAGATTTCACACTATAGTGTCGTATTTTA
ATTTTAGAACTTAAAATAATCTTAAACCATAAAAATCATCAAAATAATAAATAAAACAAA
AGCAAAGGAATGGTTTAACAGTTATGTCTAACAAAATTGAAGAAATTAAAAACGCACTAA
AATCTGGTGCAAAAGCTACAAAATACCGTGTTAAACTTTCATTTCCAACAGAAGTGCAAC
ATAAAATGGAATTACAAAGCTTGAACTGCTTAGCTAAAGCTACTAGTTTTCCAGGTGTAA
CTATTGGACAAATTGAAGTATTTAACCAAGGAAGAAAGCTTCCTATACCTGGTGATACTT
CGTATGATACACAATGGACTGTGACATTTTATATGGATAATGCCACCAAACTCGTAAAG
ACTTCTTAAGTTGGATGAAAGCTTGTGATAACTTCCAAGCAAATACACATTCTGGCAATC
CAGGAGGTTTATTTACAGAAGTTTCGGTCTGTCAATTAGATTCATTAGAAAATGAAGTTG
CTGAATATACTTTAAGAAACTGCTGGCCGAGTGGTGTTGGTGAAATTAGTGTCGGTGCTG
ATCAATTAGATACATTACAAGAATGTGATATCACATTTAGCTTCTCAGATTGGATTATTT
CTAATGGATCTGAATTTAATATGCCACAAGATGGTAAATCAGCTGCTACTAACGTAGTTT
CTGTAGACCAATAATTCTTAAGAGTCTGGAAATCCAGACTCTTAAATACTTCAAAACAGT
CAGAAAATGGATAGTTTAAAGTTAGTTAAAAAATCTTATTAAAACCAAATCGGTTGAAAAA
```

FIG. 16O. Continuation of (CJLB-14 [organism=Campylobacter phage CJLB-14] complete genome)

```
GGACAAATTTTAAAACCTGGTAATTTAGTAATTTTTAAATATAATCCTAAAGATACCAGT
GTTAAATATGATAGAACTCCATTGTGCCTGGTACTCAGAAAATCTAAATCTTATACCTTA
GGTATAAATTTTCACTGGTGCCCGATACCAATGAGAAAAATGCTTTTAAATGCCATATTT
CGACTAAATAAAAAGAATATTAAAGAGAATAAACCATTAGATATAGATTGGTATAGAATT
AAGCCTATGCTCAAAAAGTTTGGATTTTTTCCAATAATAAGACTTTATATTAATAGCAGA
ATATATAGAAGAGCAGTCAAAATACCTAATGAAAATATGAAACAAATTATAGAAACTAAA
ACAGAAACTTTTATAGGTGTTTCTGCAGAAGCTTTGTATAAGAAAGCGCTTAGGGATTCA
AAAGTTTCAAGTAAATCTAAAAAATAAAACATTTTTTAATTTAAAGCTTATAAGATTAT
AACATATAAACAATCTAAACTAAAGTTTAAATTTTTGTAATTTAAAACTCAAGGTTATTA
AATCATAAATAAAATCAAAAGCCAAAAGGCTCCAATGAAAACTTATGTCGTTGATACTAA
CATCATTTTAGATGATGTAAATAATCTCTCACGTTTATACGATAGTGAAAATCGTATTAT
AATCCCCGAAACAGTTATTGATGAATTAGATGCCAAAAAATCATTATTCGATGAAGTTGG
ATACCAAGCCCGTAATTTTGCAAGACTTTTATCAAATCTTGATGTCATTGAACTTAATAA
ATTCAATGACTATACTGAGACAACACTGGGTGATTCTCTTTTAAAAGTAACTATTACTAG
TAAAAAGAATATAAACACGCAGATGAACCTATTAATATTCTAAATGATAGAAAAATTAT
AGAAGTTGCTAAGTTATATCCAGATTGTATTTTTATAACATATGATAGTATGTGCAAGAT
AAGAGCTATATCTGAAGGGGTAAAAACTGAGACATTCGGTTTAAAAAAAGATTTTAATGA
AGTTCCAGAGTTTTTTAAAGTTCTCGATGTTGAGAAATTACCAGAAAATCTTAGCAGCAT
TTTAAGTGTAGATCCAGATTATAAACACGAAAATTATAACTACTTAATACAGAGTAAAGA
TGGTAATAAAAAACTAGCAAGGATACAAAATCACAGAATTAATTACATAGACGAAAAACA
CTTGGAAAAACAAGATGTCAAACCTATTAATATCCGTCAAAAATATTTCGTGGATGCTAT
GCTAGATACTAATGTAGATTTACAAGTTGTTTCTGCAGTTTCAGGATCAGGTAAAAGCTT
ATTAGCTATTGCGACTGGTATCAGATTAGTTAAAGAAAAACAATATAGTAAAATTGTTTA
TATACGTAACTCAATTGAATCTTTAGATAAAGGTGAAGATATTGGATATCTTGCTGGAAA
TGACGAAAAGTTTGCGGTTTTTAATCACCCACTATATGATTCTTTAGAATATATTGTTAG
AAAAAGACTTGAAAAATCTAATGATAATAAATCAAGAAAAGTTAAAATTGATAATTTAAA
AATACAAGAAGGTATTAAAGAAATTATTGAGTTATCTGGTATCGAAACTATGTGGATTGG
TGCTTTGCGTGGTAGAACAATTTCGGATGCGTTTGTTATTGTTGATGAATCCCAAAATAT
CTCTACTAAGTCAATGAGCACCATATTAACAAGAGTTGACAAGGATTGTAAAGTTATAAT
AATTGGTTCAAACTCACAAATAGACAATCAATATATTAATAAGTATAACAACGCTTTAAC
AGTTCTTCAAAATGCAGTTAAAAATCCTAGTATAATTAATACTTGGGGTGGTGAGTTAAT
TAATGTGGTTCGTGGACCTATAACTGAGTTTGCTGAACAAATTTTTAATAAAGATTCAAA
ACAAGAACCAGAGACTATGAAATCTTTTGTAGATTCTGGTATTAGCACACTTGAAGTGAA
TACAAATACTGAGAACTTAGAAACAAAATTAGACTCTGCTAGCTAATTTAATATTATTTT
AAGTTTATTACTATATAATTACATTGATAAATTAAATCAAAGGAGATTAAAATGATTTTG
ATTTTAGAATTTGGTATAATATTGAAAAGAAGTATATTAATACATAATTTATAATAAATA
AGTTTATTATAAGGTTAATCTGTTATAATTATGTATAAAATTAAACTATTAAAAGGATAA
CAAATGACGTTTACGAAATTTATTAATGAAGCTGCTATTGATGATATGCTCAAGGAGATT
AATGTAGCCAATAACAAATCAGGTCTGGCCTTCAAAAAAGATTATAAAGATATAGAATCG
CTTGGGAAGAAAGCTTTAAAAATTCTACACAAGCTTGCTGATGGTCCACATAGCAACAAA
CAATATTATAAACTTTATAATGACTTACTGAACGAAGTATGGAATATAAATCAATATCTA
CTTAGCTATAAAAACAAGATGCCTTGGTATAGAGAGGAACTCCAATCACAAGAATTGAAA
AGATACAAAGAAATCATCAAAGATTATATAGATGAAATCAAGCAAGCTATGAAAGATTTA
AAAGCCGATTATGCTTCTGTTTCTCACATTAGTAATAGAAATCTGGAAGCTATCATAAAA
TCTATTATAGACGAATATAAAAGATTATATAAAATAGTTGAAAAATGGCAAGACAAGCC
AATAAAGCCAATAAGTAAAATTATTAGAAAATAAACTTATTGGAGAACTTTATCGTATTA
CAAGAGTAGGTTAAAAGTTTATAATCTATTTCTAAAAATCAAAAGCACAACAAAGGGTAG
TTATTACATATCATATAAGTTTAAATTTAATAAGTATTATGTTTCGGTGATAAAGGAGG
GACCATATTTGCTAAAAATTATGAGGATGCTTTAAGAACAGCAGACTGGATGAGCGATAA
TTCATATTTAAATTTATTTTAAGTTTATTATTATATAATTACATCAATAAATTGGAGGAG
ATAAAAACGAAATTGGTAGAAATAAATTATTAGAATTAATCAAACAAAATGGCAATATT
GTTAGCGAAAGTGATTTTATAATGCTAGAGCAAAGACTTGATATAGATGATAAGATTTA
AAATTTGCTTTTAAAGAATTAATCAAACAAAATAAAATTATGAGTGTTTGGGTCAATCCA
AATACTCATTTATGTGTTAATAAAAAAGATTTCGAGCATTATGAAATAGGATATAGTGTA
ATTTATCCAAAATATGACTTAGATGAGTTATGGTTATAAAATACTAAAAACTTCAGCACA
ATTTAAGTTTATTATTATATAATTACATTAATAAATTAAAGGAGCTAAAAATGAATAAAA
ATAAAAAATTTTGTGATAAACAATGCAATAATTGTACATTAAATGCTAATTGTTATTGCA
CATACGGTGAGTGTTCGTTTGGTGTCGAATATGTTATTGTTATGGCTATAGTTATGACTG
TTGTGTTGGTGATTGAATATTTTCTCGATAAAGGAATTAATTTATGGTAAAAGCCAGTG
GTGTCGCTATTGTACCTGATGGTATCGAGTTTAGTGAAGAGACGAATGAATTTTGGGATG
AAATAACTAATAAATTTTAGAAGTATTAAATAGTAATATTGATATTCTTGTAAATGATG
GTGGTATGAAAAACACGAAGCTATAGTTCAAGTTTTAGAAGATGTGAAGATGTTATACA
GAAATGATTAAGTAAGAATGAATACTAAAATTTAAATTAAAGGAGATTGATTGAAATCT
TATTTAGAAGACTACTTAGAATCTATCTATGAAAACGAGGACAAAATTCCTAAATACAAT
GTAAATCAATATTTTAGATCAAGTGAAGAAATTGAATCTTTAGATATAGATTATGAAACT
ATTCTTATAGCTAAGGATATTTTGAGAAACCCAGATGCTTATACAGAAGAAGAAATAGAT
```

FIG. 16P. Continuation of (CJLB-14 [organism=Campylobacter phage CJLB-14] complete genome)

```
TTAGTTTTAAGCGGTATTTTTTATATTGCAAATAATTTAAATAAAATTTGTGAAATAATA
AACACCTCAGAAACAAATTATCTCTTAGACACAGAACACTTAATTGATATGCTTATGTTA
GGTGAAAATAGACTACAAAAATTAGACGACGTTACTTTAAAATTTGCGTTGAATGCTATA
GTGGGTGCTACTATCGATTTGGTAGATTCTTTGTTATTTGGTTTAGAAACTTTAGCTTCA
ATTAAAGCTAAGTCTAAAACTAAGGCTAAGACTGAGTCTAAAATTGAAGTTAAAGCTAAA
ACTAAAAATTAATTTTGTTTTAAGTAATTTTAATATATAATAATGTAAATCCATTCAAGG
AATATTAATGAAAACAGAAAAAGTTATTTTAGGTGTAGACATAGGTTACAGCTTTGTTAA
AGTTTGTGTAGGCACTGGTGATGGTCAAATAATTAAAAAGTTTAAATTTCCAAGTGTTAT
AGGCCAAACCAAAAAACTTGAAGGTGTTCAAAATGATAATATAGTTCATTACAACGAACG
TTATTATATGGTAGGTGAAGATGCCAAACATTTACCAAGTTCTAATATCATAGATTTAGA
TACTTATAAGAATTTAGAATATTTGGACCATTGTTATTGAATCACGCAGTGAAAATTGC
TAAACTCAGTAAAGTAGATTTAATAGTTTCAGGATTAAGTATTGCAGAAATTAAACAATC
TGGATATTTTCAAAATGTACTAAGTCATTTTGTGGTTGATGGTATTGAATACAATTATAA
TGTAATGTTGTTACCTCAAGGTGCTGGAGCTAAGTTAAGTTATGAAAAATTCGGAAATGA
TTTTCCAAATCTTCAAAAAGAATACTTAGGTGATTCAACATATTGTATTGTGGATATTGG
ATTCAATACATTAGATTTAGTTCTTGTTAATAAAGGAGTTACTTCACCAGAATTATTCGA
AGGAATTTCACAACACGGATTGATGAAAATAGCTTCGCAAGTTGCTAAATTAGTAAATGA
AAAACACAACAGATCTATTTCATTGCCAGAGGCTAGAGAAATCTTAGATACGGGTGTTTA
TAAACTAAGAGGCCAAAAATATGATTATACTAAAGAAATTGAAGGTATTAAAAAAGAATA
CTTAAGAGAAATTTTAGCATTAGTAAATGAAAGATATAGCAATATATTGGATAAACTAGA
TTTCTTGGTTGTGCTAGGCGGTGGTGCACACATTTTCAAATCTTCAAGTGATGGTTATAT
TCGTTGTGTTATTAAAGATACTGAGTATTATAATGCTATTGGAGAATTTATATTTGGAAC
TAATAATATAGATTATATTGAAGTGAATGATTAAGACAAGGAGATTTTATGTTTAATATA
AGTAAAACATTTGAATGTTGTTACGGCCATAGGGTTTGGAATCAATAGTAAAAGTACCAT
CAACATCTAATAAAAAATTTAAAGTATTTGGAAATTAACTAATAAAAATAACAGTTTAAA
TGGACTATAGACAAACAATATGATTTTTGTATGGGTCAAAGAGTTTGAACTCAAACATTA
GATACAAAATATAGGATCGATAGCATTTGGGCTTGCAGAAATCATCATTCGCACAGTGGC
GTAATAAAACTATTCTTAGGTTCAGATGAACTAATCAATAATATAGATATTGATCATAAA
TTTGGAGAAATTGGAAGGTCTGGTAGTTGTCGATTTTGTCCCTACTAGTGAAAACTTATG
TAGTTGAGTTCTGGGAAACACCAAAAATTCAAGGAGCTTTTATAGCTCCATAATTAATTT
TTAAGCTTTTTTATTATATAATAAAACAATTTTAGATTCTAGTTCTAAGCATACGACACT
TTAGTGTTATATACCTGGCTCTAAAATATAAAACTAGAATCTAAATACGGTTATAACCAC
TCAAAAACACGGTTAAAATCGACTTTAATTTTTTTGTTATGTAAAAAAAAGTATTAATTT
ACGTTTAAAGGAGTTTAAAAATGATTTCTGCAATTGAATTATCTAATATTACCGTCAACC
CAAGTATTCAAATTATTCGTTTCTTTAAAGACTACGAAGAAACAAGTCCAGGTAAGTTCG
AATTATCCGATGATTTTGATCTAAGTACTGAATTATTTTTTATAGATACTAAAGAATCTA
TTGATAATATTATTAAATTAATTATTTTGGATCCAGAATTAACACAAAGTGTAAAGTTTG
GTTCAATTAAATATGATTTTATTATAAACAATAAAAATTTATATAGAAAAATTGTTATTA
ACTCAGGCTCTATTATTGACAAGTTTAGTACTATACCATTTGAATATGGTTATGAAGAAC
CATCTAAGGATACACTAAAAGAATTCAATGAATTTATAGAATTAACTACACGCAATTATT
TATTCAATACAAAGAACCCAAAGGGTATAATTATTACAAATACAAAAGATTTAAAATTCG
ATGAACTTAATGATTTTTTAAGAAATTCAGGATCGCAAACATTTTTCAATACCGATGCTA
GAGATTTTGATATTCTTAGACGCGAATCAACTATGGTAACTCCGGATAATATTTCTTTA
ATCGTGGGGTGAATTAGTTTGTGTTAATGATTTTATTGACCCATTAAATGTTTTTAAGC
GTACTACAGCAATGCTGTTAGCATCTTAAGTATTTTAGTATTTAGAATGTGCTAGCAGCT
TAAAATGTTATAAATATACATAAAGGAACCTTAAAAGATTTTGATTTTAGAATTGATTTT
AAAGATTTTATGCATAAAAGGCAAAAAATGAATAAATCAGAATTTAGAATATATCGTGGT
ATTGTTGTTAATAATGATGACCCTAAAAAAGGAGGTAGAGTTCAAGTTCGTATATTTGAA
CTTCACGGAATGAGTGAAAATGCTACACCTGGTCAATACCCAGTAACTTCTGGAGAAAAG
GACACTAAATATAATCAAATACAGGAAAGTGATTTGCCTTGGGCAGAAGTTATGCAAAGT
ATTGATTATATTGGTTATTATCCAGCACCTTCAGATGGTTCTGATGAATATGCCAACAAT
ATAGATGGTAAAGGTTCTAAATCTGGATACAAAACTATAACAAGATCTGGAAAATATCCA
GGATTTGGTTATAACGTTATATTAACACCAGGAACTTGGGTATTTTGTGTTTTAGACAAT
AATAACCCAAACTTACCTATTGTTATAGGCTGCATTGCAAGTGAAAACGAAATACATAAA
AATGCAAAACCTAAAAATACTAGAGTATATGATAGTATTACAGGTCATTACGAAGAATGG
AGTGATGAAGATGGTAATATTATTTTTCACCACAGAACTGGCACTACAATTACTATGAAT
AAAGATGGGGAAATGACCATCAATACTGTAAAGAATAAAAAGAATATACACAAGAAAAT
AATTTGTTACACATCGATGGTGAACAAATGAATACGTTAAAAAAGACGTTAATGAGAAA
TATGACGCTAACCACAACTTAAATGTTAAGTCAAACGAAAAGTTAGAGGTAGGTTCTGAT
AGAACTCGTAAAGTAGGAGGTAATGAAAATGTAACAATTTCTGGTAACCAGAATATAAAT
GTGTCCGGTAGCGAAACAATTTCAGCAGGACCAAGTATTACTATGTCTGCTGGAGTCATC
AAGCTAAACTAAATTCAACAGCTAAACTAAATTCAATGAAAGGAATTAAATGAAAATATT
CAAAAATATTAAGTTCTTATTTTATATAATACTAATAATATCAATTATTTGTGATATAGT
GTCTTTAATTACAGCAGGTAAGGTTGTCGTAGAGCCAGCAACTTATGCTTTGATTTTAGT
AGCTATTTGTATAGAAGAAGTTATATACACTCGCAATAAAATTATAGAAGAAATTAAAGG
TATTGACGTTCATATCAAATTAAATGATTATTTAATATCTGCTAGTAATGCCAAAACTAG
```

FIG. 16Q. Continuation of (CJLB-14 [organism=Campylobacter phage CJLB-14] complete genome)

```
ATATTTAAATACAAAGTCTGAAACCGAAGCCAAGTTAACTAAAGACAAAGCTGTTAAAAC
TGAGTCTAAAGCTAAAGAAAGTAAGTCCAAAGCATCAAAAGCTAAAACTAAATCTAAAAC
TGATAAAGAGATATTAAAAGATATGTTAAACGGAGCCAAATAATGCCTCCTTTAACTAGA
GTTGGTGTTGATTTTAGTACAGGACATTCTTCGTTTCCACCTAATGCAATTTCGAGTGGT
TCTGCGAATGTATTAACTAATTCAATTAGTACAGTTAGACAAGGTGATCCTATGATACCA
CACCCAAGTCCTAGTCCATCACCACCACACGGTGGAAGTATTGCTACAGGTTCTGGGACT
GTTATGGTCAATTCAAAACCTGCTTGTAGAATAGGTGACGCTATTAGTTGTGGACAAGCT
GTAGCGCAAGGATCTGGAAATGTCATTTGTGGATAAAGATTTCTAATTAAGGAGTAATAT
ATGTATTTATTTCTTTTAGTGAAAGTATAAGCAAAGATGTTGAATTAACGTTATTTGAT
AATAATTTTCAACGTATTGCTAATAATTTTTATATAAACGCGTCTACTAAAAGTATGTCG
GATACATATAAATTCCTTTCTGAAAATTATTTTGAAAATGTAAAAATATATTATGGTAGA
CTTGGAGATCTTTCAGTTGTGAAGATGGTAATCTTAAATTTTTAGAAGTTGATAATATA
ACAAAGTTCTAACCTATGCTTGTTATACTAAAAAGGCTGAAAATACTAGACTTATAAAGC
TATGAATACGAATGCTATTTTAATAGGACCTTGCAAATCGAGAATCCCCATAGATGGGTC
ACTTTCGAATGCTTTTGAATATTTTTATTTCTCTTGGTTATATAATAAAAATATTATTCT
TATAATAGATACTACTTTTGAATCTCTTGAGATTGTTAAAAAATATCTTGAAATTAAATA
TAACATTAATAAAGATTGTTTTAAAAATATTATAATATTTAAAAAATCTTTTATGTCTAT
TAATAATTTAATTTTATTTGAAATGTACTGTATAGATCATTTCGACAGATATAAACCATT
TTTAAAATGCAAGAATTTATATGCTTTAAGCGGCTCAAAAAATCATACACTCGAGTGTAA
TTATTTTGTGGAATACGAGCATTTAAAACCTGTCGGTAAATCAGTTAATTATAGAAGTAA
AATATTTTTTGAGATATTGAATAAACCTAGATTTCAAAAGAATCAAAAATTTATTAATAC
CAGAGCAAAATACATTAAAAAAGAATCTGAAATAACTAGAAGTGATTTAAATATTATGTC
TAATATATTTGAACAATTTAATGAAATGTTATATATACAAGATCCTGTATTTTTTGATGT
AAAACCTAGATTATTTCAAGAATGTCAATATTTTGGCGTTCCTTACGAATTTATAGCACA
TAAAGATTGTTTTGATGGGGCTAATTTAAGAGCATTTGACTATGATTTAGAATCCAGATT
TATGAGCCTTGAAGACCCTATAATATCATTATTAGTGGATTCTAATAAGTGCTGATTCTA
ATAGTGCTGGTAATGTTAGATCATAAATAAATCAAAGGAGTTTAATGAAACTTATAGATT
GTTTTAAAGATAATAATGATTCTGCTTATATTTTTAAAGGTTTTATATATCATTATATTT
TTAAATATAGAATACAAATACTTCAAGATAAAAGCTATATTATCATAACTTGTTACCGTG
GTAAAGATAATGAATACGTAGCTATAAAACCAAAAAAATTCAAAAAAATTATTAATAAAT
TAATGGAAGAAAAACAAGCAGATATATTCGTGATGGAAGGAACTATTAAATTAAACTCAG
TGAATTCTAAAAATTTTAGATTTACTTTAGATTCTGGAATGTATTTGTATATAAGAAATA
AATCCTAGATTAATCTGGGTACGAAAGTACTCAAGATTTTCAAATTACTAACCGTATTCG
CATTTGCTAATCGTAAGCTAATAGTTTAATAAACTTTTAAGTTATTTCTTTATATAATAT
AATTTTAATATAATTTAATAAGGATTTTAGAATGAATTTAAAAAGTCGAATTTGTAATA
TTTTCAGTGAGTTTCTTTTGAGAAGTTAATAGAAAGATTTTTTACGGGGTTATTTGTTT
TGTTTATAGCTATATTTGTAGTTGTTTTATATACGTTTATGTTCTCGTATTTAGTCAGTG
TCATAGGTTCTATAACTATTGCTATATTATTGTGCGTAGTTTTTACAATTATAGTGTTGT
TTTTAGGATCACTCTTAGCTGTATAATATATAAATAAATTAAAGTTGTTTATATAATATT
GAATGGATTTGAGTATATTAATTTTAACACGCAATAGACCAAAATTATTTAATAGGTGTT
TAGAATCACTCAAAAAATATCGAATTAGATACCATAGATACCATAGGTATTAATTACGAA
ATACTTGTGAGTAATGGTTCTGATGCTAAACATTAGGAGTTAAATGTGCTTTATACACTA
GACGATATTAAGGACTTAGTGATATATCAGATGATAATAAAGTTTATTGTAATCAAGATT
GTGCTGATATGTATGCTTTTATTGATCAATTTGATAAATTACTGTAGGCGAACCTAACGA
TTATATAAATTAAAGATTCTAATTCATTATGCAAGCGCTACGAACAATTAAATAATTATT
TGAAAATATAAATGTGATTATTTATTTTTAAAAAATTTTTTAAAAAATATACTGAAAA
AACACTAAAAACCAACAACAATAATGCAATTCATACAATTTGATTACAATAGAGATGATG
AAGACAATATTAAACAAATGTATAAAAATTCCACATTTGATTTGTTAGTAAATTTTTAA
AATCAATTTATAAAGAAAGAATACAAAATTTGAAGATAATTATTCTATATTTATGGTAAT
ATTTTTCCTATGGATTTTGGTGTGTTTTAGTAAATGATGCAGCACTTCATAAACCTATT
AAAGAATATCTGCCTGAAAAATTTCATAATTGGAAATTTATAAGTACTAATGGTGATTTT
AAATATAAAACATATTATATAAAAATGGTTTTGATGTGATACCAGTTCGATTAAGCATT
GTGAATTATTCGGTGGTGGTATACATTGTTCGACTTTAGATTTAGTGAGACAAGATTGAA
AATACCTAAAAGATTACTATACACATAACATCTAATTGTTTACTCAAATGTAACTTCTGT
TGGTTACAAAATAATAATAAAACTTTAAATATAATCAATAATATTAAATTAGGATGGTGC
AGAGATTATGAGAGTGAGGCTATTAAATGTTTTAATGTACTGAATTATTTAACAGACATA
TATAATATTAATATAGATAAAATAGATTTTGATATTGTCGAAGAATTAGCATAAAAGATT
GTACGAAACTGAATCACTGAAATGCGCCGAACTTTTAAAAAAATACACTCAGTGTGATAT
TTTTTATATATGCCCTACAAATAATGGTGTTGATGAAAATACCAAAAAAAGATATAGTAA
CTTAGGTGTCAATTATATAGAAAATACATATAGATTTAGATATGTAAAATATAGTACTTA
ATAATTATAAAAAGATATGATTGGGTTTTCTTTTAAATAAATAGAAAGAAAGAATCATA
GTGTTACGCGAAGCAAGGGTATTAAAATTTTATAAGGATACTTTGGGTAAAACCAATGAT
TCGCACGAAGATGATATATTAGCTGGTAATAAAGTATATAGAGCTGATGTAGATTTTTA
TGCTATTCACTATTTAAAATATTTAAAATTGAAGATATTGCTAATCTCAAATAAAAACCA
AAGGTTTAAAAATGAATATAAATTATGGTTCAATCAAAAGTTTTTGGGTTAGATCCAG
ATGAAATTGACATAATCCAAGAAGTAGGTGATATCTTTCAATTTGGTACTCTTTGGATAG
```

FIG. 16R. Continuation of (CJLB-14 [organism=Campylobacter phage CJLB-14] complete genome)

```
CTTTATTTTTTATAGCTTTATATCCTATGAATATGACAATTACACCTATGGTGTGGCTTT
ATGTAGCTGCAGGACAATTATTAGTATCCGCTAGTCTAAAGAAATTGGTTTCTAAATACT
TTCCTAAATTATCAGTTAGACCCAATGGGGGTAAAGATTCAATGCCTTCGGGTCATACGT
GTGCTGCTTACGCTGGTTTTGGTTGTTTATTTTTTGGTATAAATGAATATAATACAATTT
TAATTATAGCTACTGTGATATAATATTTTAAAAAAGGAGAATATAATAGCTAACTTTAAA
GAATTTTATTGCTGCAAGAGTCTTTGACTAAAAAGACTAATTATATTAAGCTCGGTGAG
AAATACATTAATATGTTTAATCAAGTTCTGGATGCAAAGAAATATCTGCAAATATCTCTT
TTTAATGTAGATAATAAACAATACTATTGCATCCTAATAATGAAGGATTCAAAGTTGGAA
CCACATTTTGGAGTCTTTATGAAAATAAATTCAATGAGTTGGTAGAAGCTTTTAAAAAT
AAAGACACGAAGAGAATCAGTGATTTAGTGAATAGTGAGCTTTTTATTCAAAAAGATGGT
TATCTAAATTCTGATGTAAATTTTCTAAAAGTATTATCATATGTGTTTTCAGTTTTAGTG
GATTACCTGGCAATAAAGCCGATAGGATTTGTAAAAATTATGGGGATACCGAGAAAGTTC
AATCTTTATCAAAAGGTAGTAAAAAATATCATCCAAAAAAATGAGATACCATATCATATT
GTAGTAGAAGAGCAAGATGATAGTTATTCTGGTAAAATTACTGGACAAACAAACCCTGCT
AAGTCAATGATTTTAAAGTATAATTTTGCTTAGTGTGAACAAAATGCTAAAATATGAAAT
ATGCTAAAATCTACTAAAACTTCAGTTTAATTTAAGATTATTATTATATAATTATATTGA
TAAAAACAAAGGAGATAAAATGTACGTTGCTAGATTTAATGAGTATTTTGGTTATGACTA
CCAATTAATGGATGTTGAAACAGTTGATATTTTAGAAAATATCTATGATAGTTTAGGATA
TATGCCTAGAGACCCAGAACCAATTGATTTAGAAATTGTTTTAGAAGAATTCTATAATAC
AGATAAAATCTATGTTTTATGTGAAGCTGATGATGAAGAAATTGAATTTTGTTCTTGTAT
TGATGAAGTAGAACCAGAAGTTATCATAGATTTTTTGAAATCTAAGGGTCATACTTTTAT
GGATTCAAATGCTTGATTGCGTTTGATTATAAAATAAAGGAAAAATTATGTTATTATCGT
TTTTTATATATTTAGCTGGTGTTTTTGATGCTCTTAAGAGCACAGCTGTAGTAGTACTTT
GTTTAACATTAGTTGTTTTTTGTTTGTCTTTTACATTTAACGTGGCGTCGTGCGTCGACA
GAGAGGATCGTTTATATAAAATGACATCAAAAAGTATAAAAATTTGTGCGATAGCTAGTA
TAATATTTGGTGCTATAATTATTTTAGTACCTAGAAGCAGCACTATGTATTTGATGGCTG
GTGCTTACGTTGGAACAGAAGCGATAGAAAATCCGAATATTGTTAATAAATTATCTAAAG
TTAATAAAATTATAGATTATAAACTTGACGAAATGTTAAAGGAGCTTGAATCTAAGAAAT
TAGATTCTAATATAGATTACGAAACAATTAATTTTGTGCCGGCTAATACTAGCTGGTAC
CAGTTTGTGACCATCAGTGTAAAATACACAAAATAAATAATCACAAAAGAGAGATTATG
GACTACTTAAACCCGGGATATGAAGCTCCTAAAAAAGGTAATATTAAAATTACACTAGCA
TCTTTGGTAGATAGCTTTCAAGAATTTTTAACAAAACGTAATTATTTTTATATAATATA
ACAACTAAAACTCAAATAAATGATATCAAACAAACGAAAGTTTATAGTGATTTGCACGAA
CAGTTGAGATCTGTAACTTATAGTCATTTTTATGACGATTATACTTTTTATGCTAAAGAT
ACCTTTGATATTGAGCGTGTTAAATTAATTTTTATGACTTGTTATTTAGATTTACTTGAA
GAAAATGATATTGATTTATCTAATAATGAATTAGTTACAAATAACGACGTCAACATCGAA
CATTTTGATTTAGCTTATAAATGGTGCGATTTCAATACTGAATTGATAAGAACAAAAGCA
TACGAAATGGGTATATTTAAATCTTAAGCTAAAGGTTCTAAATGGATGAAATCAATTATG
ATGTATTAGAATATATCATTCAAGAGCATTTAAATTGTTCTTTGACTCGTGAAAAATCTG
TATTAGATTACTTGAATTTAGAAGCAACTAAAAGAAACCAAAAAATCACGGGTGAGACTG
AATCATTTGTAGTCTACAAATTCAAACCATATATGTTAAGTGATGATATTTTAAAACCTT
TTATTCTGTGTACAAATAAAAATAATAAAGGTTCTTAATGATTTATAATATCGACAAATA
CGATATAAAACTCTACAATGAATTTTTGAATAATTTATCTAAACATAACGTAGATTACAC
AGAATACGTGTGTACAAGAGATAATAAGTTCTATTTATCAACTCAATTAGAGCCTTTTAT
TCTGGATTATATCCCTATTCAAAATGCTTCTAAAATGTTTTTGATTCTAAAACAAAAGG
AGTTAATAACCAAGATGTATACCAATATAGAAGACAAAAAGTGACAGCTTCTAAAGATAA
TTTAAAATTATGCATTAATGATGCTTATCAATATTTCATAGATTTAAATCAAAAACAGAA
AAATTCTATATTTACTTGTTAATATATCGAATAAAGAACGTGCCGAAGCTTTATCTAA
ACAACTAGGTAGGCTTTATTATTTTGGGTTTTATTATAATAAGTACAGAGTTTATTTGAC
CAATAATCAATACACAACAAATTACATAGATTCTGAAAATATTTTAGTAAGTTCTAATGA
TTTGTTTGATGCTGAGATGCAATTGAATTATAATATATTTAGATTGCAGGATAGACTTAA
AAAATTTAGTCAAACACCCTATAGAGAAAATGGTACTACAGTGTTACCAAAATATATAGA
TCCATTTTTTAGAACTCAGGTTAAAGTTCAAACTAATTCAAATGCTAAAAATTAAAACTT
TAAATTAAAATATAAATATAATATATGAAATAAAATTTAAAACTAAAATTTAAAACACAA
ACATTCAAAGGAGGCAAAATGCCTAAAGAATCAAGATATACAAAAGTTAAAAAGCACCA
AAAATGATTTCAGATGAAGACTTTGCTGAATTCTTCCAAGCAGCCATAGATTCTAATCTT
AATGAAGATTTTAAAAGACCACTCATAGAATCTAAATATAAACTTAAATCTAATATTTTA
TACTTAACAGATGCTTGCAATTTTGATTGTGATTATTGTTATCAAAAAATGATAGAGAT
CGTTTAATAAAAACACGTATATCTCTGAAAGAGAAATTAATGATTTTTTTAAAGATCTT
ATTAAGAGAGAACCCGATAAGCCTAGCACTGTAGTTATATTTGGTGGAGAACCATTTTTA
AACCCAGATATTGTTTATTATATTTTTGATTTAACTGATAAAATAACATTCCATACTAAC
AAAAAGTTTAATCTATCATTGACTACAAATGGTGCATATTTTAAAAATACTAAAAATGCT
GATTATTTTATAGAAGAACCCGCAAATTATTAAATCATTTTTCTTTAGAAATATCTTAT
GATTTATCAGGAAACTCCAGAAGAGTTTACAGAAATGGTAAAGATTCTACAAAAGATACT
GAGTTTGTTTTAAGTTATTTTAAATCTAAAGACTATAAATTAACTATCCGTTACACTGTA
CATAAATTAAATTATATGAATGCTTTAAAAGATTTAATAACATTAAGTTTAGATTCTAAT
```

FIG. 16S. Continuation of (CJLB-14 [organism=Campylobacter phage CJLB-14] complete genome)

```
TATAAAAAAATTGTAGTTAATTTCTATGAAACTGAATTAGAACAATATATAAATGTATCT
GAGTTTAAAGAAACCCTGAAAAGGCAAACTTGTGAAGTGTTTAAAAGAACTAAAATGCCT
ATTTGTCATTTAAATTGTTTGGCTTGTATGGGTTGTAATTTTGCAGATTTTGATGGTATA
TATTACCAATATAATGATAAATCATTTGAAGTGCAAGAAAATGCAAAGATATTTGAATCT
TTTACAGAACATTCTTGATTTAGATTTGGTTCACAATAAATAAACTAAAAGTATGAACTA
ATGAAATTATCTGAATTAATACTTATTTTAGAAGGCGGCAATACCACAACAATCAATAAA
AAAACGGGTGAATCTAAAAGTGCTGAAAAAATAGATTTTAATAGATTGTCAATAGAATCT
TTTAGAGCTGAATTCATAGATTTATTCACAAGTCTTAATAGATTGTTTTTAAACAAATAC
AAAGAAAAACTTTGGGCTAATGATTCTTTGATTAAAAAAGGTCTTGTTTTTAATGGTTCC
ACGAGTTATATTATGAACCCTAAAATGGACCCAAAAGAAATCTTTAAATATAAACAAAGT
TCCGGAGATATTGATATTGTTATACCTGCTGAACACCAAGAAAAACTATGGGATTATTA
GATTCTTTAGAAGGTAAAACAATAGGTAATTTTGAATATCACGGTTGTTTTTCACAAAAT
CGTGAAAAATTAGGAGATCAATTATTAACAATATTCGTGTATAAACCCGAAACATAGCT
TGCCAAATAGATTTTGAAAATGCCGACTTTAAAGATGGAAAACCAACGGAATTTGCGAGA
TTTAGTCACGGTTCAAGTTTCGAGGATGCCAAAGAATCTATAAAAGCATTTGCACATAAG
TTATTATTAAGAGCGTTAGTAGGAGCTATTTCAGCAAATCCAAATATAGTTGTAGCTACT
AAGAGTTCTAAACCAGGCAATATCAAATTAAAAGCAGATAAAAGCACACCTAGAATGGCT
CAATTCAGTGTTACCCGGGGTTTGAGATTTGGTTTGGTTCCTATGTTAGATAAAGGTGAA
CCCGTTTATTACGAAGGTAAACAAGTATATCAAGAACAAGATACTAGTGATTCAGAATTT
ATAACAGATTTAAAAGAAATATTTAAATATATGTTTAAATCAAACGTGGGAATAAAAGAT
TTGCATAGTTTTATTGGTGTTGTTAAATTAATGAAAAAATACTGCGATGAAAAACTATT
AAATTAACACAAGAAAGATTCTTTGATATCATTTTTGGAATGCCAGCACAATTCATAGAG
CCAAATGATTTGAAATTAGATAGACAAGTTAAATTAACTGCTTATAATTATTTCTTAAAA
GAATTACGTTTAAGACATCCAGGATTAGAAGCAGATATAGATAGATATTATGTTGTTAAA
GGTTCTAAAGCTAAAGCTAAAGCTTAAAAGCTTGAACTAAAATAGCTTGACTCAGCAATA
AATATACAAAAAGTAGGGTTAAATGGCTGAAATAAAAACTGGTATTTTATTAAGACGTAA
TCTTAAAAAACATTTTGTAAATGACGCAAAACCAACACAAGGTGAAATCGTTCTTGCTAT
CGATACAAATGAAATTGGTATGCTTGTAAATGATGAAATACAATGGACTCCTATCCAAGG
TGTTGTTAACACGGTTGCGGGTAAACAAGGTGACGTTGAATTAAACAAAAAAGACGTAGG
TCTTGAAAACGTTGATAACACTGCTGACATTGACAAGCCAATTTCTAATTCTACAAAATT
AGAATTTCAAAGACATTATACAGCTGAAAACCCACACAATATAACAAAGAAAACGCTTGG
TTTAGAAAACGTTGATAACACTGCCGACATCGACAAGCCAATTTCTAACTTGACTCAAAT
TGAGTTAAATAAGAAAATTTCTTGGGATGATGCTAGAAAGCAAGCCGGTGGGAAAGACCC
AGTTTTTACAGATACTACTTATACTATTAAAGATGGTGAGCTTTCAGAATTTAACTTTAA
TTCATATTATAAGAATTTCATAGATACTTTTAATACTAATTCCAGAGTTTTACCAAGCAC
ACAAGCTCTTACTGCCAATGGTAGAACAATAACCTTAAGAAGAGCTGACGGCTCAAGTGA
AAGCATAGAAACTCAAGATACTTTATATGATGATTCTGAACTTAGAGCATTAATTGAACA
AGCTAAAATAGATTTACATATAAACATACAAGATAATTTAGAATCAGATTCTACTAAAGA
TGCTTTAAGTGCTAATCAAGGCAAAGTTCTTAAAGGTATAATAGACGAAATAAAGAAAGT
AATTAATATTACAGATGATGATTTAAAAATCTTCAAGATATTATTAATTATATAGAAGA
AAACCGCGAAAAATTTGATGATTTAACAATTGCTAATATCAAAGGCTTACAAGCTGCTTT
AGATTCTAAATTAAATAGGGATGATTCTACATATGTTGCACCAAATTCAGCATTATTAGA
ATCACACCCAGCTAGTGATTTTGTATTAAATACAAATTATAATGCTAAGTAATAGAAAT
ACAAGATTCTTTAAATTCTATTAATTCACAAATTAAATTATTTGAAACGCAATCAGGTGT
AGATTCTAAAATAAACCAAGCAATCAGAGATTTAAATTTCACTGAAACTATACAGAGTAT
TAATGAACAAATCGCAAGATTACAAGGCTCTTTAGATGGTATTGATTTGGATGCTATAAC
AGAAAATCTCCAAAAAGTTCAACAAGATTTAACAAGCAAGATAGAACAATTAGAAACCAA
TACATCTAAAAAAATAGAAGAATTTGAAGTTATTATTAATAATTTTGATATGTCTGAAAT
ACAAAAGACTATTGAAGATTTCAAAAACCAAATCAATCAAATATTGATAGCATACAAGG
TGTTGTAGATTCTATAACAAAATCATTAGATACTATTCAAAATCAAGTTTCAAAGGATAT
AGCAAACAAAGTTTCAAAAGATGAGTTAGCTGCTGAGGTTAAAACTATTAATGATAACAT
TACTCGCTTATCAAGCATAGCAAATGAAGCAAAATGGCAAGATAATTTTTATTGTAAAGT
TGAAAGAAAACGACAATCTTTATGGTCAATTATATCAATTTCAAAAGACTCTTTCAAAGG
TTCATATAAAAAACCAAATACTTATAATTACTGGGAAGCAAAATATAAAAATCTTAAGTA
TATCAATGATAATTTTGATAACTTAGAAACAATATCTAATGCACCTACATACGACGTTGT
TACTAATCAGGTTATTAAATTAACTTTTAGTGATATTGCGGAAGCATCATTTTTAATTGG
AAGTCCTAAGAATAAAATTCAAATAGCTAAATTATAGCAGTAAATGCTAATACTAAAAA
AGCTGTGTTTATATATGGGTACCCAAGTTTTATGACCGACGATTTGTCAAAATTATGGT
AACTATAGAAAAGATTCAAGTTTTGGTAATTATCTATCAAGAGCTAATAAAACAGATCC
AGAAACTTTTCAAAAAATTGTAACCACGCAAGAATTTGATTTACCTGACGATACTGATGA
TTATTCATATTTTGAAGCTAGTTATGAAATATCTGGAAATATAATAACATTAACCATACC
TGAAAATATATTTTAGAATTCTATGGTAATATGACAGCAGTGGAAACAACTGTTACTGG
TTCTAACGCAGCTCAAGTCTGGTCAACGACTTTAAAATCCACTGATTATGAAGGTAATAA
ATTATTCTCAAATGGTGTGTTGATAGGAAAGATTTAACCGGAGAAATCTTAACTATATA
TGATAATAAATCTACATACATAAATACCTTGGGTGAAGCTAGAACTAATTATAATGATTT
TCAAATAATACGCGAAGAATACGAAGATATTATGTATACAAGGGATTTTTTACCAGGAAC
```

FIG. 16T. Continuation of (CJLB-14 [organism=Campylobacter phage CJLB-14] complete genome)

```
TATAGAACCAGGGGATGATGAGTTAGAATGGTAATAACTTTTAAACTTTAATTTAAACAT
TAAAAGCTCTAAGATTTAAACTTTAATTTAAACATTAAAAGCTCTAAGATTTAAGAATTA
TTTAAGTCAAAATATATTATAATTATAAAACAAAAAGGAATTATATGTTAGAATTAAGCA
ATTTTCTTAGATCACCATTCTTAGATATGCCTAGCATATCATTTAATAACAAAAATCTTC
AAGATTTATTAAAAAATGTTTCAGAAACAATGGAAACATATCCATCATCAGTTACTTCGT
ATTTAACAACTGAAACTAGTTCGGGAATTGATGTTGTTGTATTAGCACCAGGAGTCCAAG
AAGATGGTTCTAAAACAATTGAATTAGACTTTAAACCTGATGAAATTGTAGTTAGATATA
AAGTTATAGATGATGCTAAATCATTTTTTATAACTGGTTATAATACAATCAGAGTTAGTT
TGGATTCTGTTAATAACTTTAAACTTAAACAAAATTCATTTAAAGCTAGAAATGGCATTA
TAACCTTTTCGTTAGAATCTATTAAAGAAACTAAAAATACATACACATTCTAATAACTTA
AGCCTTTGGACAAATACTAAAGGCTTATTAACCACAATTCATAAATAAATATACAAAAAG
CAAGGATTGTGATGGCTTTTACACACAAAAATCAAAAAACCTTTTATACTGATTATGCTA
TTAAACACGGTATGGTACCTACTGAAGATACTATAAATCTATTTCAAGTTCGTCTTAAAA
AAGAGACAACTGATATCTACAATAAATTTCAAATAGTAAACGGAAAATCACCACTCGAGT
GGAATCAATCTGAAAACTATGAGGTTAATGAAATTGTAAGATATAATGAAGTAGATTATA
AATGTGTGCAAGAATGTGTTAATAAAGTTCCTAGTGAGGAACCTAGTTTTTGGGTCGTTA
CAAAATATCAAGAATATACTGAATTTCCCGCCAGTAATTACCTAGCTAAAGACAATCAAG
ATCCTTATGATCCTAGTTCAATGCAAGATTATGAAGAATCTAATACTTTTCACCCAACAA
CCGTTAAACACGTTGAAGATCGTCTAAAACATTGGTTTGATAATGAAACTGTTACAAATG
CTGATAGACTTGATGGTGAACACAAGATTATTTCTGCTCTAAACAAGAGTTTGATGATT
TTGTTAGAATAGCATTGACTGAAGAATCTGTCGTTGATAGTTTAGAATCTGATAATCGCA
GATTACCATTAAGTGCTTACCAAGGTAAGGTTCTTAAAGGATTAATAGATCATATCAATA
CAATTTTAACTTCAAATGACATAAACTTAGATGAACTTCAGGAAATTGTTAACTGGATTA
AAACAAATAGAGATATGATTGAATCTTTGGGTATTGATTCTATTAAAGGATTAAGAGATT
ATTTAAATCGCATAGATTCTGATCTGAAAAAAGAGTTACTTACGATTATTGGAATGCTG
AATTTCTCAATAAAATTAAAGAAGTAGATGGACATTTATCTGGAGTTGATGCTGATACAT
TAGATGGTCAACACGCAGGTTATTCTTACCAGCAAGTAGATTTACACCAGAAGAAATTG
CTTTATTACTTCAAAAAGTACCAGGATCTTTGGGTAAAATAGATGCTGATAAATTAGATG
GATTAGATTCTAAAGATTTCTTGAGACGTTCAACCAGTGATACCCCTACTCAAGATAATA
AATTTAGTTTAGGATCTACAGCTTTAAGATGGTCTAATATATATGCTGTTAATTTCAAG
GAACTGCTTTGCAAGCTAAATATGCTGACTTAGCTGAGTATTATCTACTAAAGAATCTA
TTAAATCGAATATAAAAGCAGGTCATATATTAGGCATAGATGCTTGTGGTGTAAATTTAT
TTAACCCAGGTATGAAATTATTTGGTGTTGTTTCAAAAAATCCTGGTGTAATTCTAAATA
ATGAATGTAGCGGTGTTCCAATTGCATTGAAAGGTAGAACTCCAGTTTATTGTAAAAATG
AACCTAGTGTGGGTGATTATATCTATGCTGATTCTAATGGGTTGGGTATTGCAAGTGAAA
CTGAATTAGATTTACCATTAGTGGGTATTTGTATAGGTTCTATAATAAATTATAAAGATT
TTTGGATTTGCGAGATCAAAATCTAATCAAACATAAGGAGTATTATAATGAAATTAATGA
TTTAATTACTAAAAACTCGAGTTTAATTTTTTAAACTCAGTTTTTAATTCTTATATATT
ATACAATATTATATTTTAAATTTAAATTTTTAAGTTTTAAATTTCGGGTAATAATATGCA
GCGAGTTCCAAATTCAACACCTTGTGTATCTTTTTGGAATTGAACACTTGAATAAAAACT
ATCTTTAAAACTTGAACCTACTATAGGAAATGTTAAAGTATCTTTATACGTTGGATTTCC
TCTCCATTGGAAAGTTTGTCTTGTGGTGTCTACGGTAGCATCTTGTAAAACACTCCATTT
TGGAATACCGCAAGAATCTATTTTATACTCAGAAGTTGTTCTTACATTTGCGTTATTGTA
CTTGGCACCAACATCCTTAAAATAACCTAATGGGCTATCAGAGTCACTGTTTATATAAGT
TATAATCTCTGCTGGTAATGTAGTTTCATCATAATTATTAGTATCTACTAAAGATTCTAA
ATCTAAATCTGTTATATTAGTGCTTTCTTTGATAACACCAAAATAACTTCTATCTAATAT
ATAACCATACATAGCGCCTATAGCCAGATTAAATAACCGCCTACTAAATCAACAACCCC
ACACGCGTGACCATTATGACTAATTTTACCCATTTTAGAATCTGAAACACTACCTGTTCT
GTACAACGCGTTAGTACCATCTGTATACCCAGCAGTTTTATAATCTAAATTATGAATAGC
TTGAATATCTCTTTGAGTACTTTGCATAGTATTCATACCTTGAATAAATGCAAATCTATC
TGTTCTTGATTTAGCAAACTCAATATTATTGAAATTATTTGAATTATAAGCATTTTGATA
TATACATTTAGACAACAAAATCAAATAATTATAAGCAAATACAGTTAATACTTGAAATTC
AGGGCCTCTATTTTTAACAGCTTCTAAGAAGCTTGAATTTCTATTCTTAATAGATTTTAA
ATCATCAGAATCTAAATCAGAATCTTCTGTAATTTTATTACCCAAAGCAACCTTTGCAGA
AACTCCTGAGATTAAAGCTACAGAGTTAAATTTAGAATCACAGGTTAAAGGCACTGTATT
ACGCCTAGAACCTAAATACCCCCTTGGTTAGATGCTAGATATTTGTCTATAAAAAAACC
TGGAATTTCTTTACCATTATTAATAAATGCTCTATGGCACCAAAAACCTTCTTCTTGAGT
AGCGGAAACTTCAACTTTTAATCCGTAATATGGTGCAGCGTCTACATTTGAAGTCTTAAT
ATAAAGTTTAGGTATCCAAACCATAACATTACCGCGGATATCAGTATAATTTCCATAATT
CATATGACCAGGAGTAAAAGTTCCTAGCATAGGATACATATATATTGTTAGTAATTTC
TTTAGGTGCAATACCCACGCCAAAACCAATATCACCAAGATTTGGATTACTTGGAAGTGC
ACCAGCAACTTCTCCGTTTCCGTTTATCCAGCGATTTTTATTTTTGTTTTATCTATACA
AGTCCAAATAACTCCAGTAGCTGTATTTAAAAAAGTTGCACTATCGATTGTAGGATTTAT
AGAAGCTGTGGGATCATTTGATTGCTTATAGTTTATAGAATAATTATCAACTTGTGTATG
CAAAGCTTTAACATCTTCTTTAACCGGATCTAATTTTTGATCTATTAAGAAATTAGCGGT
ATTGGTATCTATAGAATTTTTAATTTTTTCATAATTATCTTTAAGTTCATTTATGGCTCC
```

FIG. 16U. Continuation of (CJLB-14 [organism=Campylobacter phage CJLB-14] complete genome)

```
TACTGCTGTAGTTTTTGCTTCGGTTTTTAATGTTGTTACATCACCAATAGTATTGACTTT
TTTGGTTAAATCTTTTTGCGTGTAAGCACCAAGAGCTAAATCTCTCATTACGAACCTTTT
ATGTTATTTATTTGAATCTATATAAGAAGCCTTTAAGATATTTTATAATATAATATCCCA
AAGGATAAAAATGAAAGGTAAAAATTTTAGCTTAAACTCAAATAAACGTAATAAAAATGA
CTATTACCAAACACCTTATAGTATGACTAAACAACTATTAGAAGTTGAAAATTTCGAAGG
AAGTATACTAGAACCTTCTTGTGGTGCTGGAGCAATAGTCAAAGTTCTAAAAGATTATAA
TAAATCTGTAGATTATTGTGATTTAAACAATGATTTTAGTTTAACAGGTATCTTCAAAGA
TTTCAAAGATTTCATTAATGATGATTTTGATAGATATGATAATATTATAACAAATCCGCC
ATTTAGTTTAGCAAAAGAATTTATATTAAAAGCTAAACAAATAGCAAATAATAAAATTGC
AATGTTATTACCATTGAATTATTTACACGGGGTTTCAAGATATAATGAAATATACAAGGA
TACTGATTTTCCATTAAAAACTGTTTATGTTTTTTGTAGATATGGTTTACTTGAAGATAC
TATTAGAGAAGATGGAACTTATAAAGCTGGTATGATGGTATATGCTTGGTATATTTGGGA
TAAATCTTATAAAGGAGAACCTATAATAAGATGGCTAAATAACAACGATTATATAGTCAA
ATCAAATAAAGGATCTTAATGGCTAAGTTCGTTACTCCCGCAGGGAATTTACTTAATTCT
TTAAATTCTAAGAACCTTAGAAATGTTCAAAATTATAGCCAAACGATAGTTTGGTCTTTT
GAAACTAATGAAGAGTTTATATCTGCTAGAATAGTTGATGAAGGTGTAGAACACGTCCCT
AAAGGCCTAAAGAAAACTTGGACACCCACTTCTTTAACTCTTTCTGGTCTGCCAGATGAT
GTTGATTTGTATCACCCAAAAATGATCACATATCTTTGGAGTGGCTTTAAGTTGGATGGG
ACTGAATTTAAGGATACTAATTATGAAGAAAAAGCTACTATAGAAGATATTAAAAATCAA
GATATGCACTATACTGGCAAATCCTGGGGAACTAAAGGTATTGCTGGATATTATAGGGAT
AATAATATACTAACATTTCCTTTTACTGTAGAAGTTACTTATTGGGAATATTCTAATTCG
GGTTCAAACTCAAGTTCTGGCTCTAAAAATATCTAAAAATACTCGTGAATCTGGTTCTGG
TGGACTTAAGGTTCAAAGAACTATAGCTCAAAATTATTATATTACAGTAGTTCCTAATAT
GGATCCAGCATTATTTTGTAAAAAATATGGCGATGCTCACGGATTTAAAGGGCCTAAAGG
CGAAGACTTTAATTACGATCAATATAAAGCTTATATGGTTTCTTTAGGCTTAGATTTCTT
AACTATAGATAGGACTCAAGCGACTTAATACATTGAAATATACTTAAATATTGCTTTAAA
TCTAAAATCGATTTAAGCCGGTTTTTGAGCCTCTATACATATATTTGAATTCTACTAAAA
ATATACAAAAAAATATCTGAAACTTCAATTTAATTTAAGATTATTATTATATAATTATAT
AAATTAAAGAGGAGATTCAGATGTTACAAGACAAAGTTTTAAAAAGTTACAGAGATTCTT
TAAATCAAAGATTGTCAATCTTGATCAAAGACCCAGAAAGTAACAAAGATATCATATCTG
ATATTAAAGTTGAAATAAAAAAGATCAATAATATATTAAAACGATCTTACAACCGCGGTT
AATTCAAACAAGACTAGTAATGGTTAGACAAAGGAAATATAATGGTAGATTTTAAAAATT
TTTTAACAGTAAACAAAGTTTATATCGATAAATCAGATATAAAACCATCGCAAAGAAATG
TAAACTCAGTTCTTTATAAGTTGCTTTTAAAAGGTTATAAACCAAGCCAGACATTGTTAG
AAGCTATTAATAATGCTTCAGATTCTGATCTTAAATCATTTGAAGAATCTATAGTATTAG
CTGCAGGCACAACATTCTATAAAAAATATACTCATAAATTAAGAGATATTTCAGATTATG
AAGATCAATTCTATCACTATGTCTTAAGATATATTTTTAACTTAGATACTCACGATTATA
CTCTAAGTATTAATTTTAGTGATCTAATACCAAACAAAGAACTAGTTGAATTAGATTTAA
TACAAGAATCTGAAATTGAAAAAATTACAAAAAACATCCTAGAATCTCAATTCAATCCTA
CGGATAATGAAAAAGATATCATAATAAAATATGGTTTTAAATATATGCCAAGTAAGATTC
CAAATAAGTTAGCTTTAGAAACTTTGATTTCTAATTTAAATCCTAGTGAAGCTCTGGAAT
TCTCTAAAAAATACAAACCAGAAAATGTTAATGCGGTCAGAACTATTACTAAATGCTTAA
TTAAATCTGAATACGATTTAGATATAGACAAATTAGATAGAATTTACACAAAAGAATTCA
ATTTACCTAGATATATTAAAACTTTGTTATGAATTCTATTAATGAATTAAAATTGGATC
GTGAAACTATATTAAATGAAATGTTAATATACAAGAAATTCTGGCAAAATATACAGTATT
TAATCGTTACAACACAAAAAAGATATAAAAATCTAATAGTTGCAAACTATGTTTTTAACA
AAATATTAAAAAGAGATTATAAACAAACGGGTACTTATAGAATCAGAACTTTACTAAATA
ACCCAGTAAAATTAATAATGCTTTTATTGAAATTTATAAGTATAATATAAATTTAGCTT
ATAAAAATGTTTTTAATTTAGCAGCTAAAACTAATAACAATGATTTAGTATTTTGTTGT
ATCATAGACCTAAAACACTCAAACAATTATTGGATTTAGTTCTTAATTATAAAAGAACTG
GTAAAGTTCGTATGTCTAATATCAAAGGAAATATTTTATATTTTGATGAAGCTAAAAAAC
CAAGCGGTAATCTTTGGGAAGTCTTAAGTAAATTATTTTCAATTTTATTACAATCTAAAA
AAGATTTAATTGATTTTGGCTCAGCTAAAAGAATAGCAATTTCTGATGATTTAGAAACTA
TGGTTCCTCCAATTAAACCTAAAGATTCTTTAAAAACTGATATATTCTTTCCAAAAGGAT
CCAGCCTTAGAATAGATTCTAAATTTCAAGTATTCGTTGCTTGGAAAAGGAAGGATAATT
CTAAAGGTTCGTTAGACTTAGATTTATCTTGTTATTCAGAGATAGTTCAGGTTCACTAA
AGAATGTTTGGATTATACAAAACTTGAAACTAGCATAGATGGTAAGATTCAAATACACT
CTGGTGATTGGACCAGTTCAAGAAGTTTTGATCCTAAAAATCCATTAATTACAGCAGAGT
TTTGTACTTTGACTTTAGATCCTAAATCAGATTTAGAAGTATATGTTAAATGTTCATAGTT
ACAACAAAGTTTCACTCAGTGAATATGATGTAATTGTTGGTGTTCTACCAGGTGATACTA
AAAATAATGATGGTGTTATAAATCTCCAAGATGCTATTTTTCAATTCAATGTTGATGTAG
ATTTCAAAGATATATGTACGTTAGAATTCAAAATGGTTTACTGCAAGTTATTGGTGAAC
CATTTAATATGAGAGGTTCTCACTCAGGGGGTTATGGTTTTAATCAAATTGCTCCAATAT
ATGATTATTATAAAGTTTATAATCAAATGAGTTTAAAAAGATTATTTGAATTAATTGTAA
TTCATAAAGGTTTAAAACTTGTCGATATCAACGACAATCCAGATTTAGTAGTTAGTTCTA
AACTAAGTTCTAAATACAGCTCTGAATATAAAGTTTATAATGTAAGTGAAAACGCAAACG
```

FIG. 16V. Continuation of (CJLB-14 [organism=Campylobacter phage CJLB-14] complete genome)

```
AACTCAAAGAGTTAATGGTAAAAGATTAACTCTTTGATTCTATTAAGTTTGATTCTGGAT
TTATAGGTTCTACCATTGGCTCAATTGGAATAGGTACTGCTGGTTCATTTGGTATACTAG
GAGTGTTATCATTAGGATTAGAATCAAACTCTAAAGATTCTACACCTCTTGGGTCTATAT
AATATACTTTAAAATGTCTATCATTTTTAACTGCTTCATTTAAAACATTAATCAAATCTT
TATTATTTTCTATTCTATCGTCTATCCCATTTTTATTAATATCTTTTTCTGGTGCAAACT
TACTAGCTTGATAAACAATTTTTTGACCAGAAACATATAAGATTATCGACCCACCAAAAG
ATACTAACAAAGGTTCTAATCCTAGATTTGCATCAAAAAATCTATTAAGAATTAAAGCCA
AAGAACATATAAAAAAGTTCTGTATTATAATATGCCTATTTCTTTCTGGGTTACCATAAT
TAGCAGAATCTTTAGTTCCTTTAAAAGTGGCAATAACAGAAGTTGTTCTGTCGACACCCA
CATATACACAACATAGGGTAGCATATAGTGTGGTTAGTGTTTCCATTGGGACTTGAAAGT
TTTTATTAAAGATACCCGAACCTGGTATATAATAATCTATGATATAATCTAAGCATTGAA
ATATTAAACAAACTGCTGTGAATATACCAAAGAATATAACATAGCCAGCAGTGCCTTTAA
TATTTTTATGTAATTTATTAGTAAAATAATCAGATTTAATTTCTTTTGCTGTATACGTAG
ATTCGTTAGTTTCTTTATTTAAATACATATGAACCTTTTATATTATTTATGTCGTTTTAG
AGTTTAAGTTTATATTAAGTTTCAGTTATTATAGTATATACTACTAAAAAGCCAAGCATT
TTTTATACTTTTTAATATTGCTTTAAGTTTTAAGCATATACTAGGATATAATACTATAGT
ATATACTACTAAAAAGCCAAGCATTTTTTATACTTTTTAATATTGCTTTAAGTTTTAAGC
ATATGCTAGGATATAATACTATAGTATATACTACTAAAAAGCCAAGCATTTTTTATACTT
TTTAATATTGCTTTAAGTTTTAAGCATATGCTAGGATATAATACTATAGTATATACCACT
AAAAACTCAAGCATTTTTTATACTTTTTAATATTGCTTTAAGTTTTAAGCATATGCTAGG
ATATAATACTATAGTATATACTACTAAAAAGCCAAGCATTTTTTATACTTTCTAATATTG
CTTTAAGTTTTAAGCAAGCATTTTTTATACTTTTTAATATTGCTTTAAGTTTTAAGCATA
TGCTAGGATATAATACTATAGTATATACCACTAAAAACTCAAGCATTTTTTATACTTTTT
AATATTGCTTTAAGTTTTAAGCATATGCTAGGATATAATACTATAGTATATACCACTAAA
AACTCAAGCATTTTTTATACTTTTTAATATTGCTTTAAGTTTTAAGCATATGCTAGGATA
TAATACTATAGTATATACTACTAAAAAGCCAAGCATTTTTTATACTTTTTAATATTGCTT
TAAGTTTTAAGCATATGCTAGGATATAATACTATAGTATATACTACTAAAAAGCCAAGCA
TTTTTTATACTTTTTAATATTGCTTTAAGTTTTAAGCATATGCTAGGATATAATACTATA
GTATATACTACTAAAAAGCCAAGCATTTTTTATACTTTTTAATATTGCTTTAAGTTTTAA
GCATATGCTAGGATATAATACTATAGTATATACTACTAAAAAGCCAAGCATTTTTTATAC
TTTTTAATATTGCTTTAAGTTTTAAGCATATGCTAGGATATAATACTATAGTATATACTA
CTAAAAAGCCAAGCATTTTTTATACTTTTTAATATTGCTTTAAGTTTTAAGCATATGCTA
GGATATAATACTATAGTATATACTACTAAAAAGCCAAGCATTTTTTATACTTTTTAATAT
TGCTTTAAGTTTTAAGCATATGCTAGGATATAATACTATAGTATATACTACTAAAAAGCC
AAGCATTTTTTATACTTTTTAATATTGCTTTAAGTTTTAAGCATATGCTAGGATATAATA
CTATAGTATATACTATGAAATATCCAAGCATTTTTTATACTTTTTAATATTGCTTTAAGT
TTTAAGCATATGCTAGGATATAATACTATAGTATATACTATGAAATATCCAAGCATTTTT
TATACTTTTTAATATTGCTTTAAGTTTTGCTTTAAGTTTGATAGCTGTATTAGTATATAA
ATAAACTAAAAGAGGAACTATGCAAAAATATGTAGCTATTGCTTTCATTATTGTTGCTAT
GCTAGGATATATAGGATGGCTTAAATATGATAATGCTCAATTGCAAACAACTATTTCGAG
CTTAGAAGCCAAAAACAAAGGTTTAGAAACTTCTCTAAACATCCAGGTCAATTTAAATAA
AATACAAGACCAAAAGAATCGAGAACTTATTAACAACATTAAAGAACTTGAAAATAAACC
TATTAAAACTGAAACAAAATATGTAACAGTCAAGGATTGTAAAGTTCAAATATCTAAAGT
AGACACCAATATTACCTCAGCTAAAGGTATACCTTTATTTTAGGAAATATAGGTAAAAC
TCAAATATCTAACCAAAAATAAGGAATCTTTATTGAAGTTTAAAAAGTTTTTATTGGCCTT
AATACCTTTTATTTTTATAGGCTGTACCACTGTTAGAACTGAGTTTGTATACCCAAAAAT
ACCGGATATTAAAGAACCGCCTATAACACAAGATTATAATCTAACTGTAATAAAAATAAA
TAACATAGAATATTATTCGTTGAGTGCTGAAGATGCTAAGATTTGTCAGAGAACTGGAT
CAAGTTTAAATCCTGGGCTGAGACGAATTATGAATTATTAAAAATAATTAAAAATAAGGA
CTTAAAATGAGTTTCAAAGACACATTATTAAACCTAGTTTATGAGAATTCTGGCTGTGAA
GTGCTGGATTATAAAGACCCTGAAATCAAAGAAACTGATTCTGGTGATATAGATACAACA
CCTACCACTAAAGCAGATATTGTTAAACGCAAAGATTCTAAAATTGATGAAGATGATTCT
GGTGATGATTCAGAGCTTGAACCACTATCAAAGGAAGAATTTGACGATATAATTAATTCT
TTAGATCCAGATACGATTGCATTAATTATAAGTATTCTTAACGATAATGGATATATAGTT
GCTTCCAAAGAAGAAATTTTATCAGCAGAAGATTTTGAAGATATTGGCTATCTTGTTTTA
GAAGTTCTCGAAGAAATTTCTGAGTATGAAGCTAACAATTATGAACAATATGGTGCAACT
CCAGTAGATGAATCATTTGATGATGCTGAAGTTCTTAAAGAAGCTGCTATGATTTTAGAA
GCTAATGATTTAAGTGATTTAAGTGAACAATTAGTAGATATTGCACATACTAAACAATTA
AGACGTGATAGAAAAGATCAGCTTGGAAAAGATCAGCAGTTTTAAGAGCAAGATTTAGA
AAAACTGGTGAAGGTAGAAGAGAACCGCAAAAAGCGCTTAAATACCTTAAAAAATATAGA
AGACAACATAAAGCTCGTATGAAGAGATATTCACAAAAATATACACAAGTTTGGAAAGGT
AATACTAAAAACTAATGATATTTTGTGAAGATTTAGAACCAATATATGAGGTGGTGAAAA
AACTACCTCTTTATAAACAGAGAGCTAAGGAAGAAGTGTTTTTAGGTATTTTAAAATCAA
AATCTAAGAAATGGATCGGATGGAAATACCTAAAAGAACTTAAAAAAGATAAAAGCTTTG
ACGACAGCGCTATTTTTATTGAGCTTTATGAGCTTGCGTTAAATTACTACTGGATTAAAT
CTCAAAACGACTCTATCAAATACGATAACTTAATGAAAAACTATAAATTTTAAATTTATT
```

FIG. 16W. Continuation of (CJLB-14 [organism=Campylobacter phage CJLB-14] complete genome)

```
AATATTCTAATTTAATATTAAAGAGTTTGAAATTTTTAAAAAATTTTACCCTTTAATAT
GATATTATAATATAAAAACTTTTTTAAAAATTTTTAGTAGTTTTATTGTCACTTAAAAA
ATGCTTGGCTTTTTAATAGTATATAACAATGCTATATATCCTAGCATATGCTTAAAACTT
AAAGCAATATTAAAAAGTATAAAAAATGCTTGGCTTTTTAGTAGTATATACTATAGTATT
ATATCCTAGCATATGCTTAAAACTTAAAGCAATATTAAAAAGTATAAAAAATGCTTGGCT
TTTTAGTAGTATATACTATAGTATTATATCCTAGCATATGCTTAAAACTTAAAGCAATAT
TAAAAAGTATAAAAAATGCTTGGCTTTTTAGTAGTATATACTATAGTATTATATCTAAAA
CTTAAAGCAATATTAAAAAGTATAAAAAATGCTTGAGTTTTTAGTAGTATATACTATAGT
ATTATATCCTAGCATATGCTTAAAACTTAAAGCAAATTAATAACATTTTAAGTTTTAATT
TTATATAATAACAATATTTCAAATCAAAAGGATTTATATGAAAGATACAGTTTTAAGTCT
AAGTGGTGGTTTAGACTCAAGCGCTTACTATTTGAGTTTAAAGATCGTATTAAGATTGC
TGTAAGTTTTAAATACGGTTCAAATCATCAAGAAAAAGAACTAGCAGCTGCTAAAAAAGT
CTTGGATGAAGTAAATAAATTAGGTGCTGAAATCGAACATAGAATAATCGATTTAACAGA
AGCTTTTGGAACTTTTAAAAGTGCTTTATTAAGCGGTTCTAAAGCAGTTCCCGAAGCTGG
TTCAACTGAAGTTTCAAATGTAATTGTTCCGTTTAGAAATGGTATATTCTTAAGTATCTT
AACGGGTATAGCAGAATCAGAAGATTGTAGATTTATTGCTATAGCAAACCACAGTGGTGA
TTCTAACGTATTTCCAGATTGTAGATATGATTTTATCGATGCTATGTTTAAAGCCATTGG
TTCGGGAACCGAAGACAGAGTTCAGGTATTCGCACCGTATACAAATATTACAAAAACTGA
TTTGACAATCCGTGGTATATCTAATGGTTTAAACCCAGATTGGACTTACAGCTGCTATAA
AGGTGGTAATAAACCTTGCAATGAATGTTCTGCTTGTGTTGATCGTAATAAAGCAGTGCA
AGAAGCTACAACAGTTTTAAAACATTTTAGTTCTTAATTTATTGTATATTGAGTTTTAAG
ATATTATAATATTTCAATAGTATTGACAAATAACACTTTAGTGTTCTAGCTTTACACTTT
AGTGTTAATTTTTAAAATTAGAACCAAAGGAGAATTATGAAACTATTCGAAGCTTGCTTC
AATTTAGGTAATTTTGAAACTTATGAAAGATTCTATAATACAGAAACTTAATAAGTCTGAA
ATTCAAAAAGTCTTTCTTAAGAATCAAGTTTTTATTGAGGATCCTAAAGGAGAATATACA
TTTTTATTAGATCCAAATATTAAACTAACAAAAGTTCAAGCTAATCAAGCTAAAAATTTA
GAAACTTATGGTAAGACTAATATTGCTGCTGAACATATTAGGCAGAACTATTGGAAACTC
AATGATTCAAAATATAATAAAAATATAAGTATTTTTTATCTGGATATAGAAACTACGGCA
CACTCACCTATTGACACCGAAGCTTGTAGAGAAAGAATAGTTTCAATTCAAGTATATCAT
AACTTAACGAATACAAATTATATTTTTACAAATGAGTTCTTTGACACCGAAGCTCATACT
AAAGATTCTAAATATATTTTCGATGATAGGACTTATGATTTTAAACTTAAATACTATCAA
GTAGAAGGTGAACATAATTTATTAATTGCTTTATTTAAACTTATAGAAGCTTTAAAACCT
TTATTAGTATTAGCTCACAATGGTGAAGGTTTTGACTTTGCTTATCTTTGGAGAAGAACT
GAAAAGTTAGGTTTAACTGAAGGATTTAGCCCATTTGGAAAATCTGAATTTCAAATAAAT
GAATTAGATAATGGAACTAAAAAATACAGTATAAAAGCGCCCGGTGTTTCTATATGGAT
ACTATAGATATCTATAAGAAGTTTAGACTTAAACCGAGAGAATCTTATTCATTAGATTAT
ATTGCAGAAGTTGAATTAGGCGAAAGAAAAGTTAATCACGATTGTTTAAAACTTTTGAT
GGTTTTAGAACAGGTGAAGGATTTATTAGACCAGAAGTTGAACCTAGTGAAGAATCTATT
TTAGAATATAAACTTTATAATGCTAAAGATGCTGAAGAAATAAAAAGAATTTCTAAAGAA
TATTTTATTCATTATAGTATTATAGATACATACTTATTATATAGAATAGACAATGCAATT
AAATTATCTGATATTATGATTAGTATTGCTTCTATTATGGGTATTCAATTACCACAAACA
CTTGGAACAACAACTCCTTGGAGTACATTTATCCGAAATTATGCAATGCAAGATAAAATA
GTATTACCAAATCCAAGTGAATTTAGTGGTGATGTAGAATTTAAAGGGGGCTTTGTAGCT
GAACCATTAATTGGTAGATATGATTGGGTTTTTCAGCGGACGTTACCAGTATGTATCCT
AGTCAAATTATGGCATTTAATTTAAGTTCTGAAACATTTATACCATTTTATAAATTGCCA
AATGATTTACAAGAAGCTATAAATGAATTAGATCTTAATGAAGATGAACAATATCATATT
AATAATTATTATAAAAATCCCGAAGCTTATAAAAAATACACGGATTTACTTATAAAGTAT
AATTATTGCGGATCATTAACTGGATCTGTGTATGACAAATCTAAAAAAGGTATTCTACCA
ATATTAACAGAATTAGTTTTCAATCTTAGAAAAGCAGCTAAAAAAGAAATGTTGAAATAC
GAACAAATGGCTGAAGATGCTAAAGATCCAGAATTAATACAAAAATATCAAGCATTAGCA
ACGGAATTAGATGTCAATCAATTGACATTTAAGATTTTAATTAACTCATTATACGGGGCT
TGCCGGAAATAAACATTTTATTCTATATAATAAAGAAATCGCTAAAGCTATCACAGGAAAT
TCAAGATTTTATATAAATCTTATGAGTAAAAATATCAATAATTTTTTGTGTGATTTATGT
GGTTCTGGAAATTATATAATTTATAATGATACTGACTCCGTGTACGTTCAAGTACCTAAT
ATTATAAACGAAAAATTACCAAAAGACCCACAATTAGCAACAGATATAATTGATAAATTT
ATAGAAACTAAAATACAACCGGTAATTAACACAAGCTCACAAGAATTAGGGTCTATTTTT
AATGCTTTAGATGCTTCAAGAATTTCTGCAAAGCGTGAAGCGATTGCAAGCTCTGCTGTG
TTTGTAGCAAAGAAAAGATATTTTATGAAAGTTATAGATTCTGAAGGTGTTAGGTTCAGT
GAACCTTATCTTAAAACAATGGGTATCGATATTGTCAGATCCAGTACACCAGCATTTTCT
AAAAAATATCTTAAAAAATCAGTCAATATTATATTAGAAAGTACAAGAAGAAACTTAAA
GAATGGTTAAAAAATATTAGATCATTATACCTGGGTCAAAATCTAATGGATATTGCTAAG
ATATCTTCGGTCAGTTCTAGCAAATATAAACTTGGTGTGGACAAATCCATACCGATTAAT
TCAAGAGCTTTCTTGGTATCAAATCATTATATAAATAGTCTAAATACAGGTGAGTTTCAA
CCATTAGAATTAGGCGAAAAGGTTCGTATGCTATATCTTAGAGAACCTAACCCATTAAAA
TCTAACATTTTTGCTTTTAATAATGAAAAATTTGCAAATGTATTTAAAGATTATATAGAT
TGGGATACTAATTTTAATAAGTTCTTTTTAAAACCACTTGAAATAATGACAGACCCACTT
```

FIG. 16X. Continuation of (CJLB-14 [organism=Campylobacter phage CJLB-14] complete genome)

```
AATTATAATTTACATAAAGAAACTGAAACTTTGGAGGAATGGTGATGGATATACTCGGTG
TTTACAATTATATTAAATCTTATATTTTAAAAGGATACAATTATTTAAAAAGTAATTATT
CTTTTATTACTATAATGATATTATTATTTGGCACTATTTGGTTAGCTTATAATTTATTAT
TTGCTGTAATTTTTATTGTTTTCTTTTTAATAGGTTCGTTTGTTTTATTTGCATATCTTG
ATTCTGCAATAGACGACATTAATTTTAAAAAATAATGATTAATAGGGCTGTTATAACTAG
GTGTTTCAAATATAATGGCTCTATGTTCGATGCTTTTGAATATTTTTATAGACTTTGGGA
ATTAGATCCTGATACTAAATTTGTTTCATTGTACAGTCATATCAATAAAGATTTTTTAAG
CATTAAATACAACGTAGATCCAAATGTTTTGATAATTTTATATATAAAGATCCATATGA
TTTAGAATTTAACAAAGTTTTATTATTCGATACTCACGAGTTTCTATAATATAAATCACCC
AAAATCCCTTAAATTAAATAAGTTATATGTAATCGCTAACAGCACCATAGGGTTCAAAGA
AAATACTGAATATTTTGATGAATATTTTTAAATAAAAATTATATTAATAAAATATATTA
TCAGATTCACAGAATATTTAATCATTTAGATAATGTATATGTTAATTGTATGGATAATTG
CTGCAAGAGTTATTTAAATATTCTTAAATGTATCCGAAAGCAATTATCAAAGATCCTAA
AAATAATTTTCAACATTACACAATGACTAAGAATTTTATACCGGATATTTACAAGTATTT
TAATAAGTACATATATGTTAAAACTGGTAGAACTTATGATAGACACCCAAGACAATTTAC
AGAATGTGCTTACCAAGGCATTGATTGTGAATATATTTCTGAAGGTTCTAAATTCACAAA
AATGATAATTCATATTATAGATTCGAAGATAGATACGATTTTGATAAGAGATTTATATA
CAATGATATAGTTATATCTAAAATGCTCGATTGATGCTAAAAATAAATAAGCTAAAAGGT
TTGTGATGAGATTCTTAGAATACTATAGATTGAAAGAAGCTGAAGAATTTAGTAGAAATG
ACATTAAAACCATTGTTAAACAATACAACAAAGTATTCGCAAGAATCTTGAATGCAAAAT
TTTATTTAGTTAATGAAGTTGAGCACTGCACTTCAAATGGTTCAAAATTAATAGGTATTA
GATTTGCCAGTGCTGATGGCTATATGATAAGATTTAATTACACTGCAAAAAACGCTAAAC
AAATTCAGAAAATTAACAAAGTTACTAAAGAATTTCACGTCGAAAGCATAGATTTTTGGA
ATCCAATAACTGGTCATTTAAATAAACCAAGTATCAGAGTTTCTGTAATTTCAAGTTTAT
CACTCAAATATTTTATAGAAGACATTACAACTTCTATTAAAAAGAATCTTTTAGGAACTT
TTTATTATAAAGATCTTAAATTTACAGACGATTTGCAAGTCGATACAAGATATACGATTA
ATCCAGATGAAATCATATTCATTAATACTAAAGGATTTAAAGAATCCAATGATTTTACAT
TAAGTTCGCAAGATCCTAATATTCAACTTATACTTAATAATATCAAAGAAGTTTATGGAG
AAGCTTGATGAAAAGAATCTTAACCTTATCAGATCTTAGGCAATATATCAAAGAAGAACT
TGGATATCCACAATTACAAGTAGAACTTACAGATAATCAATTAGATCACTGTATTGAAAA
AACAGTTCAAATGTTTTGTAATGTTGCCTATGATGGAGAATTAACAAGATATATAAAATT
TGAATGTCAAGGTCAAGGTAATTATTTTGTAGATCCTGAAGTTGAAGAAATATTACAAAT
ATGCCAAAGTGGTATTTTTGTAGGTTCTGATTTAAATGGATTAATAGATCAAAATCTATC
TAATTATATACTATCCACTTCTGGTGTTGCTTTAAGTTACTTAGTTACTTTAAGTTCTAC
AAGATCCTTAGTCGACAAATACTTTGGCCAACGTGTTAATTTCGAGTTTAACTCTCATAA
GGGATTATTATCAATATATCAAAATTACCACGGGCCTTTGTTAATTGAAGCTAAATGTAA
ATACATACCAGATGAACACGATAAAATATATGACCAAGAATGGGTCAAAGCAATGTCTGT
GGCTCAAGCCAGATTGATGCAAAGTGTAGTCTTAGGAAAATATTCAGCACCTTTAATTAA
TGGTTCGCAAGTTAATTATAGTGATATTAGACAATTAGCCCAAGATGAAATACAAAGATT
AAACGAGGAACTTTTCAATAAATTTACAGAACCTGCTGTATTTATCGTTGGCTAAATAAT
TTTATATTTAAGGAACTCTTAAGATATTTTATATTATAATTATCAAAAGGAGATAATATG
AGAGTTTCTAAATACAAAATGTTGAGTTCCTTAAAAGACTCAGAATACAACTTAGTTTTA
ACAAATTACAAATACCCACAATCTAAAATAGATTTAGAAGAATTTAACGAGTTTGGAGAA
CGCTTCTTAAAAGATAATGCAATTATCGATGTTAAAAAACTCAAAGATCCTGAATTAAAT
CTTAGATATGATTATGTTTTAATACTTAGATCGAAACTCACTGATACTGCTTTAGAAATT
ATAAAGAAGCTTATCCTATGCTAAAAACTATTGACGAATATAAAGCTTCATTAACAGGA
GATTTTAATGAATTATGATAAACTAAATAAAATTGGAATAATTTTGATTATTATTTTATC
AGTTGTTTATTTTATGCTTGATATTAATAATACAAAAGTTAAAAATTTAGAATTTAAAAT
TCAAGATCTCCAAACAGAACTTAATAAAACCAAAAAAGAATTAAATGATACCAAAATTAA
TTTAAATCATTTAAGTTCTAAAGTTCAAGATTTAAAAATATCTTTAATGAAAGATATGTC
GTCAATGTATCACTTAAGTGATAAACAACAATCTCTAATACTTGATGAAATATGGAAACA
ATCTAAAAATACAAAATAAATCCAGCATTCTTATACGCAATACTGTGGAAAGAATCAAG
ATTTAGAAACGACGTTATTCATAAACCTACTTATGTTAGAACACTTAAAAAAGAAATACA
AGCTCAAGGTATGGGTGCTATTGTTTGGGATTTCTGGGGAGATAAACTCAAATCTAATAC
AAGTTTAAAATCTAAAAAAGATCTTAAAAATTGGAAAAGAATATAGAAGGAACTGCATA
TATACTTAGTTATTTGAAATCTTTACCAAAGGTATCTAATACAAAAATAAGTACGAATC
CGCAGCTTCAAGATACTATGGAAAATATCAAGCAAATTACGTGAATAAAACAATGTCAAA
ATTTAATGAACTAAACTCTTAATGCTGAAATTAAAGTGGGTTAAATAACGATTTTGAAC
CGATATGATTGTCTAATAATTAAGTACATTTTAAGTGCTAATATGTTATAATATTGTTAG
ATTTCAATAGAAAGGAGAACTATGAATGAATTAAGTTTTGTACCAAAATCAGAAATTCTT
AATAAATCACAAGAAACTTGTATTAAAGAATGCCAAGATATTGTATTTCAAGAAACAAAA
GAAGTTTCTAAAGACCTCATATTAGATACATTATTAGGTATGATAGATTCTGTCAAGATT
TCAGATTCTGCAGTTCATATAAAATTCAATAAATCTTTAATCATACAAAGTGAAAACATT
GTTTTAGGTGCGGATAATTTAAATATACAACTTGCAGGAAACCGAGTAGAATTACAACCA
AGAATCAAACAAAATCCAAAGGAGATTAAATGATCACAAAAGATTTCATTAAAGAACTTT
CAAAAATGTCGAGTATAACTGATAAAGTTATTCTTAAGTATCCAATAACAACATTAAATT
```

FIG. 16Y. Continuation of (CJLB-14 [organism=Campylobacter phage CJLB-14] complete genome)

```
CTGAAGCTATAGATATGCTTGTAAATATAGATGCGTCTAAATTAGGATGCCAAGAATTCC
CAGATACTGGTATATATGAATTAAATAAGTTTGTTCATATATGTTCGCATTATTTGATAATC
CAGAAATTACAAGAACAAACAATGCAATAGAATTTGAAACACCGGGGACAAAAAGTGTTT
ATACAATTTCAGATTTGTCTGTAATGGAAAACTTTGATCAAAAAGCTTCAATTATTGAAA
GTTTAGATAATTTTCCAGAAGTTGCCAGAGTTGACATTAGTATTGAAGTCATAAAACAAA
TTAAACAAGCTTCAAGTATTTACAACGAATTAAATGTTTTAAGTATAGAAGGTAAATCAA
ATGATTTATATTTGTATTTAGATGCACATAATAGATTTAATTCTTCTAATAATACATTCA
GCAAAGAGTTTTTAAATCATTCAACTATGGATTTTAAACTGAAAATCAATATTGAAAATT
TTGTTAAACTGCCGGTAACAAATTATACTTTAAAGATTAAATATAATGAGAGTAAAAACG
CATTTAGAATTCTCTTTGAATCTGAGTTTTCTAAGATTTTGATCTCAAAAATTGCAGATT
AAAGATTTTACACCAAGGAACAATAAATGGATAATTTAAAACAACTTTCAGCTACGTGTA
TGCAAATCTTTATTAAATTAAATGGAATGCATTACTTAGCCAAAGGCAATCAATTTCACA
GACTTCACGAAATAACACAAGAATATTATGAATTTTTTCAAGAGTCGTTTGATACATTCA
ATGAAAGATTGGTTCAATTGAGTTTAACACCCTGTGTTAATATACAAGAAATCCACGATC
TGAAAAATCCATATATTTTAGATCTACAAGCTACAAAACTTGATTTGGATACTATAGCTA
GCGCATTAATAAATGATTTTAAATTAGTTGACAATTCAGTAGCAGTTCTTATTCAAGAAG
CTATTAAAATTGAAGATACTGTTACAGAAGACATCTTAAGAACATTTAGAATTCGTCTCC
AAAAATATATTTGGATGCTCGAATCTATGCAAAGTTAAGGAGGTATAATGTTAAAAGAAG
ATAAATTTATTTGGAGTTTATTTCAGAAAAAATTTCCAGAAGTTTCAAGAGAAGCTTATG
AAGATTTTGTAGAAGAATATTTAAATATCAAACCATTTAAAGCTAGCGAAAATATATTTG
AAACCAATCAAAGTATTTCAAACGAAGCTCATTTTATTATGAGAGCATTAGCTACTAAAA
AATTACAAGAAGTTTTTGAAATACTTAAAATTGATTTAGAAGACCCAAATGTTAAAGCAG
ATTTTGAAAATGGTAATTTAGGAACACCAGGCAGAGTCATTAAGCTAATGGCTGGCGCCA
ACACTGATGATGATACTGAGTGTGGCTCTGGTAGATTTATGAAACCTGTTAGAATAGCAA
CTTTTCCAAATAAAGACGCAGCTAAGATTCCAATTACTAAAAGGATTAACATAGCAAGCA
ATTGTAGTCATCATTTATTACCATTTAATACAGATTTTGCGGAAGATTCCTATGCAATAG
TTAGTTATATACCTAAGATTATGTTCTGGGTATTTCTAAGTTACAAAGATTAGCAGATT
TCGTCTCGAGACGTTATTGGTTGCAAGAAGATTTGACTAAAGAAATCTATAATAAAATTA
AAGAAGCAGCACAAACTGAAGATGTTTATGTCAAGTTATGTAATATTAAACATACTTGTG
AATGGATTAGAGGTGCGAGAAACACTGAGGGGGGATTTACTTCAGAATTCTACGGTGGTG
CTTTTGGTGATCCTGAATTAAGAAAACAGGTTCAAATCCAGTTTAATGTTAATACACTA
TAGATCTTAGCATTTAACACTTTAGTGTAATTAACACTTTAGTGTAATTTGCTAGATCTT
TAGTAAAAAATTTAATTAAATTTTAATCGTTCTTTATATAATATAATATTAAAAGTCTA
AATCAAAGGAGTTTAATTTGGATAATTTTGAATCGGTTCTTCTAAAAAATATTATAGAAT
CTAAAGATTTTTTTAATAAAGTAAGGCTAATCTTAAAACCTAGTATTTTCACAGATTTTG
GTAACCAAAAAATCTATGAATTAATAGATAATTTTTATTCTAATTATAATACAACTCCTA
GTATTCAAGAAATAGCACTTCAAATTAAAGATATTCCCAATAAAGAAGCAAGAACCCAGA
TTGCTACTAAACTTAATGATGCTAGAAACTCAGAAAATATCAATAAAGAATTCTTAGATG
ATTTAACTGTTAAATTCATTAAGGACCAAATGTTCACAAAAGCATTAATGTTAGGTGCTG
AGTTCATTGATAAAAAAGATGAAACTTATAAACAAAAAGCCAAAGATCTTATAGATGCTT
CACAACTTGTGAATATTCATAAAGATCTTGGTAATGAATATAATAATATAGAAGAACGCA
TTGATTATTATCAAATCCAAGAAAAGGTATCAAATATTTAAGATTCAATACTTTAAATG
AGTATATCGGAGAAGGCTTTCTTAACGGAACTTTGAATATTTTTATGGCTCCTGCAGGTA
TTGGTAAAAGTTTATTAATGAGTACCAGCATTGGTGATTTCTTAAACAAGGTTTAAATG
TATTATTAGTCAGCTTAGAATTATCTAATTTTGAGTTCTTAAAAAGAATAGATGCTGACT
TATTAGATATACAAATTAATGCTTTAAAAGACGTAGACCCTAGTGTTATCAGAACTAAGT
TTGAAGAACTAAAAAGATCTGGTATTGGTAGCTTATATGTTCAAAACTTCCCAGCTGGTT
CTTTTAGTTCAAATGATTTAAAATCTTTATTAGAAATGTATAAAGCTAATAATATAAAAT
TCGATGCAATATTCTTGGATTACTTAGGCTTGATGAAATCTGATAGAGTTTCTGCAAGTG
CAGGTTTATATAGTTATATTAAGGCCATTGGTGAAGAAGTTCGTGCTATTGCAGTCACAG
AAAATATTCCGATATTTCTTGTTCTCAATTAAATAGATCAGCTGTAAATAATACAGATT
CTAACAATGAAGCTATTTCAGATTCTATGGGTACTGCTATGACTGCTGATTGGATTTGTT
TCTTATTACAAACTGAAGATCTTAAAAAGAAAAATCTTAGATTTAAAATAACTAAGA
ATCGTTATAATGGTAGAACTTCAAGTTTTGATATGCATATTAATTATATGAATATGCGTA
TAGAAGATATAGTTTCAAATGATATACAAATGTTAAGTAATACTGATATTAAAAACGTTC
CACAATTAGAAATACAAAAACCTAAACTGATTGGAACTTTAATTAGTCTCATAAAGATT
GACACTACAGTGTTAAATGTTTTAAATTTAATTAAACTTTAAGTTTATATATTATATAAT
TATATTGTTTAAGAGATTTAAACATTTTACACTTTGGTGTTAATCGATAACTCTTAAGTA
AAGTTTAAAAGTTTTTTAAACGGTTAGATTCTAACCAGGATTTTCAAACTGTCAATGTAA
AAGTTGCAGTTTGAATCCTTTTTAAATTAATTAAACTTTAAGTTTAAATATTATATGAAA
ATTTATAATTTTCGGGGTGTAGCGCAGTCTGGTTAGCGCACTTGGTTTGGGACCAAGGGG
CCGAAGGTTCGAATCCTTTCACCCCGACCATTCTAACATTAGTAAGCATTCGGGTAATTG
GTAACTCACCAGACTGTAAACACATTTAAGATTTCAGTAGAAGTTTAAATGTGTTTATG
ATGTCAGCGTTATATTATATAACTAAAACTGATGATTGTAAACACAATTAAAAATCATTT
GTAAGTTTTACCCATGTTTATTAAATTGTGATGCTATATGTTTATATAACCAATAAATAT
ATTTAAATATATTTTGAAGGGTTAAAATGACATTTAAAGATTATTTAAACAATATTCCTA
```

FIG. 16Z. Continuation of (CJLB-14 [organism=Campylobacter phage CJLB-14] complete genome)

```
TAAATGAAGCGTTAAAGACGGATGTGTCTGCTATAGAGGAACTCAGAAATAGATATCAAG
AAGTAGCCAAAAAAAAGATGGAATTGCAAGCCGAAATAAGTAAACTAGAAGCTGCGCAGA
CTACAGCTTACTTTAAACTAGGTGGCTTAGCTGCACAGATTGCGCCCGATAACGTTGATA
ATGAAAAACTCAACAAAGGTTTAGAACAATACGACAGTGAAATTGAGAATATTGAGAAAA
AGTTAGAACCTCTTTATAAAAAACGAGAATCTTTACTAGACGAGCTTAAAAAAATAAGCA
GAGTTGCTAATAACTTAGTAACAAGAAATGCAAAAAAAGCTGGTGTAAGCCCTTTGAATT
ATGTTTTAAATATAATTTATCATTTTAATAAAGTTAAAGAGTCATCGTATAGAATTAAA
CTCTATACGATGACTGAATATAATGCCTGATTAGCTCAACTGGTAGAGCATTCGCCTTGT
AGCTCAAAAACCTTATAAATAGACATAAACATAATGAGAGCCATATAGCTTTATATGACC
CACATTTACTAATAAACTTAATTATTCCCATTTAATTTTATCGACAGATTTAACAGTTTC
AGATAAATTAATTTTTCTTTTAATGTATTCGCTTTAAATATTACTTCCTGAGTATATTC
GGTTACTTTTGAAACAAATGTTAAAAATTCTTGAGGTGTGAAATTAACCTTTTCGTCATT
CAAGTCAATCCAAGTAATCTCAGTTATTGAATTAGTACCACTTTGTATATCTAACAATAT
ATTAGCGGCCATTCCGTTAATATTAAGTTTATCCTTTTCCCTAGTTTGGAATGTATGGCC
TTTGAATATAAAACCAGATTCTAAAGCTGCGTCCCTTTTGTTTGTATTTCAAACTTCTT
CTTTTCTTTAATTATATTAAGTTTTTCAGATTCGCTTGCAGTATTTAGCACATATTCATA
ATATAAATCCATAAGATTATTAGCTAAACAGTATTCTTTAACTGCTTGCGTTCCTGCTTG
AATTTCTTCAGGCGTAATGTCATTTATTTATAATTGATATATGTATGCACCATTTGTTGA
TAGATTCTGTCAAGATTTCAGGTGTTTATAGTGTAGAGTATCTGTTATCCGCTTGTGTCA
ACACATCTTGCAATTTAGTATCGATTTCAGATTTATCATAAACAGATTCGGCACTTGCTT
TAAGTTCCATAAAAGAATCTATAGTAGATTTATTATAATATGAATTAAATTTAGTATTAA
TTTCAGATTTATTATAAACATTACTTGTGTTGGCTTTAGTATCTAATTTAGAATCTACTT
CAGATTTATTATAATAATTAGATAAATCTACACTTAGAACTGCATTTTTCCATTTTTTAG
TATTTGAATCATATTGTAAAATATGATTGTTTGTCGGGTCAACAATACTTGCATCAATTA
AGTTAGCAATACTTGTTTTATGTGGGTTATTAAAGTCTGTCTTATGAGTATTAATTAAAT
CTACATTAAAATTCTTTTTGGCGTAAGCTAAGTTAATAGCGTGCCAATCACTTGTTGGGT
CTGCAACATTAAATACTTGTGTTTCAGAACCACCCAGATTTGCTTTTGTATTTAAGTTAT
TATTAATACCAAGAATGTTATTTTCTATATTTTTTTAAATTGGGTATACTCACTATACC
TAGTATCTTCTAATTCTTTGTTGGTAGTAATGGTATTTTCAGCAGTTGTCACTCTTCTTT
CTAATTTATAATGTTTATCTTCTATATCTTTTTCATTAGTACCTACTGTAGTTTCTAATT
TGGTAAGCCTAGAATCATTAGCTTCCTTATAAGTTTCAAAAATTATTTTTCGAAGGAAAT
TATCTTCTATATATTTAGAACTGTATAATAAATCTTTTGAAGCTTCTTCTGGATTTTCAG
TTGTATGTCTAAAAATTGCTTGAAGGTCTATTAATTCGTCTGCTGCTTCCATAGTCTCTT
TAGTTTCAGAATCCATACAAATCCAATATTTACCATTAACTATATCGTGAATATTAGCGA
TATAACTAATACTAGGATTTGATTCTTTGCTTATTTTATTAAGTTCTGTTAGAACTTTTT
CTTTTAACTGTTCTTTTGTGAGATTTTCTGATATTAAAACATCAACTTTTTTAAATTGCA
TTTTTCACCTTTAAACTAAAGATTTTATAAGTCTATCTATTCTTTTATCCTGAACGATAT
TATTACTAGTATTATTTATGATCTTACCATCAGAGTTTATTAAAATAACTCTACCTTGAT
CTACGTCTGTTACTCTAACATATACTGGTGCACCATCATTTTTAGCAACTAATCCCTGCA
TTTCATCAACAGCTTCTTTTGTAATTTGACTTAATGTTTTAGTTGTTTCGTATACGAAAT
CTATTATTTTTATTTTAGATGCTTCTAATGCCATTTAATTTTCCTTGTATATTTTACCA
TTTAGATACTAAATTTTCAAAAGTATCTTGAACTGCATTCTGCGCTGTGCTTAATCCATT
TTTTAACATATTACTAAAATATGAACTTGCTTTAGATTGTACACTATCATTCCCGGTTGT
GTTGGAAGTGCTTGCTAATTGAATATTTTAATATCTGTATTATCGTGATTTGGTTGGTT
CATTTTAAAACTAACATTGAATTCTATAATTTCATTTGTCTTGAGATAATTGTATTTG
TGAAACATCTGTCAACAATGCATCCTGCGTCTCCATTACTAAGATGTTTTTTAGAACCATT
GCTTAAATAAACCTGAATTAGCCAAGCACAGACATCATTGTAGTTACCTTTTGAAATTTG
AAAAGCATTGACAAATCTGCGATACATACTGGCATTATCAAAATCTCTGAAGGTCATATC
CACTTGGTATACTGGGTCTGCACCACGTGCTAAAACCCAAGTCCCTCCAATTAATAATTC
TTCAAATCTACCGGTATATTGTGGTAAATTAATACTTTTTAAACAAATATCTATACTATT
TTGTGTTTCGGTAGGGTTACCCCAGTTTATAAGATTTTGGAAGGTAGCATTAATAGGTTT
CATAATAACTATAAATCAGAGGTTTTACTCCATTTGATAGTATTAATAACACTAGCAAG
TTTATTTAAGGTAACAGTTGCCATTTATCCTACTTTTTTGTATATTTATTCTTAAGTCA
AATATATTATAATAAATGAAATTCAAAGATTATAGATATTAATGATCCTTTATAATTTAA
GCTTCTTTTAAGTGGTGTTTAGTTATAATAACTTCAATTAAAAAGTTAAGGAAATTAAAA
TGATAATACTTTTAGAGAATACTTATATGAACAAGCTTTTAGTAAAGATGTAATGATCTC
TAAATTTACTAACAATTCAGACAACATTTTTAATCATATTTTAAAAGTCTTAGTATAIGA
TGATAATTTAAATAATAAAAAACATTTAAGAGAGATGTCAGGAATAGTAAGATCTTTACA
AAACAAACTATCAAATCAAAAATAACGCCGGAAGACTTGATTGTATCAAATTTAAGATTATGA
AATAATGGATATCATAAATATTTAACCAACGATTAAAAGGACTCAATTTGAATTTAGACAC
TATACATATTGTTAAAAATAACGGAGAACGTGAAATATTCGATGCTGAAAAAATACATAA
ACACTTACATTTTGCTTGTCAAAACCTCGATGTAGATATTATTAGCATTATTAAAGATGC
TAGATTAAAAATATTTGATGGTGCCAAAAGTGTAGACATACAAGATTCTTTAATTAAATC
TGCACAAGAAAAAATCAGTGAAGATTCTCCAGATTATGAGTTAGTTGCTGGTAGATTATT
AAATCAAAAACTCAGAAAAGAAGTTTATAAACAATACACACCATTAGATTTTAAATCACA
AGTTAAAGAACGTATTAAAAAAGGTTTCTATACTGAAGATCTTAATGCTTATAGTGATGA
```

FIG. 16AA. Continuation of (CJLB-14 [organism=Campylobacter phage CJLB-14] complete genome)

```
AGAGCTTGACTATTTTGGATCTTTAATTAATTATGAATTAGATAACGAACTACCTTACAG
CGCATTAAATCAAATGTATTCTAAGTACTTGATCAAACATAATAAAAAATGCATTGAGGT
TCCTCAAGAAGTTTTTATATTGATACCAATGGCTATTTTTTATAATACCGATATAGAATA
TAGAAAAAAATATGTTAAACTTGGGTATGAATTATTATCACAGCGTAAAATTTCTTTACC
TACTCCGATTATGAATGGAGCAAGAACAAGTTATAAGAAATTTATATCTTGTAATTTATT
AAACTTTGGTGATTCAGTTGAAAGCTTTGCTAGGGGTTTAGAAGCTGTTTTAAAATGCAC
CAGTGCTAAAAGTGGTTTAGGTATCAATACAAGTTTCATCAGAGGTTTAGGAGCTCCAGT
AGGTAAACCTTCAAGATTAGATCATACTGGTATGCTGCCGATCGTTAAAGCCATTGAATC
TGCTACGTCTGCGCTGATTCAGCACGGCAGGGGCGGTGCAAGCAATCTGTCAATGCCTTT
CTTTCACTACGAAATAGAATTATTTTCACAACTAGGTGATTCTAAAGGATCTTTAGAAAA
TAGGGCTAGACATACTGATCAAACTATTATCATCAATAAATGGTTCTTAGAAAAAGCTCT
TAATAAAGAGGATATATTTTTATTCCATATGAATGCTGTAGGTAATAAGGATCCCAAATT
AGATTTATATGATGCCTTAGGTGATTATAAAAGATTCGATGAATTATATAAACATTATAG
CGCTAAAGTTCCTAATAAAAGTAAAAAGAAAATTAATGCTTATGATTTATTATCTTTAAT
TATAAATGAGAGAATGATTACTGGTAGAGTTTATATTGTTTTTGCGGATAACTTCGTTAA
TTCAAGTTTTAAAGAAAATCTATATATGACAAATTTGTGCTGTGAAATATCTGTGCCTAG
TCATAGTTTAGATAATTATAGGGGTATACCAGGAGAACTCGGAACTTGTATCTTAGGTAA
TATAAATTTTGGACATTCTAAAGAATCTGACATTCCAAAAGTTGCTGATTTCTTAGTTAG
GTTCTTAGATAATATGATTGATATTTCTGATTTTGCTATGCCAGAAATTGAATACTCAGC
TACAAAACGTAGAACATTAGGTATTGGTGTTTCTAACTTATTTGGATATCTTGCTAAATC
GAATTATTTTACAATACAAAAGAAGCACGCGAACATATTAATGATTTAATGGAATTATT
TTATTTTAACTTAGTTAAAACTTCAATAGATTTAGCAAAAGAACGAGGTGCTTGTGAATT
ATATAATGAATCTTTTTATAGTGGTAATAAGTTTATATTCGAAAGATATTTAGAAGCTGG
GATTAAACCTGAATTTAAAACAAAATTAGATTGGGAGTCACTTCGTGAAGAATTATCTAA
ATACGGTATGCGTCATTCAAGCTTGTCAGCTGTACCACCCGCTGGGAATATACTTGTAAT
AGAGAATCAAATATATCATAATTATTTTAACAGTTCAAAGCCAAGCTCAGCAACACCTGG
TATCGAACCTCCAAGAGAATTAGTAACTATTAAAACAGAAAAAAGTTCTACTGTAAAACA
GTTGGTTCCTTTCTATAAAACAGCCAAAAAATATTATCGACTGCTTGGGGTGTTGACTT
TAATAATAAAGATTATCTTAAATTAGTGAGTACAATACAAAGATATGTAGATCAAAGTAT
TAGTACAAATCAATATTATAATATCGTAGAAACTAAAAAAGTTAATATTGAAGATGTTAT
AGAAGAATTTATAGAATGCTTCAATTTAGGTGTCAAATCATTGTATTATGCTAATTTTAG
AACTACAGATGATGCAGATGGTGATCAAGTAATTGAAGGTTGTGGGTCTGGAGGTTGTAG
CGTTTAAAAACTTTTAGGTTTAAGCTTTTAAGACTTTTTAAGCTTAAACTTTAAGATTCG
GTTTGTATTTCAGAAACTTTTAAGTTATTTTATATTATAATTATTTCATTAAAAGATAAA
GGAGATAAAATGAAACACATTACAAAAATATTTTTAGGATATAAAAACGACAAAGCATAT
TTCAATAGAACACAAAGACAAATTACGTGTGCTATCAAAAATCTTGAACGTTTAAAACCT
TCATTTAATATTAACGAAGCTAGATTTGAAGAAATCTACGAAGCTAAACAAATTGAAACA
AACCCAAATATACTTTATATTGCTGTTACAGACAAACAATATGTAATTGTAACCAATAGT
GATTGGCGCGGTAATATCACATTAGATTATAAAAATATTGATTTTGGTGTAGAAAGAAGT
CTACAAATATCAAGGCTTAAAGATTATTTAGAGCTGGTGTTAGAATATGGAAATGTAAT
ACTTACTTATATGATAGAAAACGTAAATCCATAGGTTTGAAACCTAGTCTTGAAGATCGT
TTAGCAGAATATAAAAAATCTAAAATCAATGATTTTAACAAATATTGCTTAAATAAATTA
AAAAGTGTTAGTAATTTAAATCTAAATGTAAACAATATTGAAGATTTAGATTTTAATAAT
TTAGAAAAACAAATTGATTTTATGAAAGAGTTGTTATATCATACTAAAAAATATGTTGCG
AATGAAAAATATAAATTTTGTGATGAACCTTATTTTGAAAGCACAAAAAGAAAAACTATG
AATGCTATTATAAATTTAAAGATTTGAAATACATTCATAATCACACAAAAACTGGGATTA
AACGATGATATTAGATACTAAAGCAGATATATTAGTAACTCATAGTTTTCACTTTAATAA
TACTAAAATGCACGGATTATCAGGACATTTATTTGAAGTATTAGATTATTACTGGTATTT
TAAAAATAAAGGTGTTAATGTTAAATGTTTAATTCCAGAAGTAGTAACTAAAGAAACTTT
TAATGATTTCATAAAAGGACACTATAGTGTAGATTTTGATTTAAATGATATATATTTTT
AGATACTAAGATATTAGCAATTAAAGCTAGAAATATACTAGTAACCGATGGTGGGTATTG
GTTTTTAAATCAATATAAGTCTAAATTACTAGGCAAAGTGTTTCGTTTGCTTGTGGTCC
TAGTTTTTTAGAATCCGGAGATAAGCCAGAATATGTGACTTTTTTAGCAGATCATAAAAT
ATATCCTGGTTTGGGAATAAATTATACTAAGAAGGTGTTACCACATTTAAATCATATACC
AGGAGATAAACCTTTTGCTCATATTACTAAAAATTGTAGGGCATTATCAGAATCTCAAAT
AAAAGATCTAATAAGAGATTATCCTGATATTGTAATGTATAGTGATTATTTGAATATACA
GAATTCGACAAACAAACCTATCAAGAATTTTAATTTTAGTAAGTATGTGTATACGCCTAT
TATGAGACATTTTGATTGTTCACCTAGACTTATAATAGAATGTAGAATATTAGGTATAGA
TTTTGATTTATGGAATATCAATTATAAAGATCCTGGTTTAGAAAGACGTTTAGAAACAGA
TCTGGATCAATTTATATTGGGTGAGTCTGATAATATAATAAATTATTTTAATTAAAATAT
TAAAGTCCACAAAGGTTTAAAATGAATAAAATAGACTTCTCGGGTTCTGAATGCTCATA
TGAAAAACTACTAAATGGAACATTAGAGTTTGAAGGTATTCGAGCTGCGATAATGACAAC
CGATAAATGTTGTTTAGTTGTGAATATTGTTGTAATTCAGGTTTTACAGATTTTAATGC
TGCTAAAAATACTAAAAGCGAAGCAGATTTAAAATGTTTTAATTTGGTTAAAGCTATATT
TCCTAGATTAAAATCCGCAGTTTTATGTGGTGGTGAACCACTAATGTGTGATTATCTTTA
TGATTATTTAGACTTATTTAAGGATCTAAAAGACGTAACAATTTTAACAAATCTATTATA
```

FIG. 16AB. Continuation of (CJLB-14 [organism=Campylobacter phage CJLB-14] complete genome)

```
TATAAAAGATCATTATAAACGTCTAAAAGAATATAGAAACCTAGATTTAGTTACAACTTA
TCACGCTTCTCAAATTAATTCTAATCAATATATTGAAAGACTTAAATATTTCTTAGACAT
AGATTTACCAAAAGAAGTTAAATTATTTTTTAACCATAAAAAACCAGATTTAATAGAAAG
AACTCAAAATGTTAAAGATTTCTTAGAATCTCAAGGATTTACTAATATTATTTGTACTCA
TATTTCAGGGTTTGGTTTTAGTAATCCAAATAAAAATGTAGCAGGCGTTGACCTTAATGC
AGATAGAGACTACGTAATGATTTCTCAAGGAACTAAGAAATATATGAATGAATCTGAGTT
TGCGAGTCAAAATTATCTCGGTATGGTCTGCAATGGTTTGAGACTTCACGTTTACCCAGA
TAGAATCATTGAAAATTGTTCAAGAAAAACTTTGACTGTAGAAGAAGTTCTAAAGTTAAA
AGATTATCAAGTTTGTAAATTCAAAAGTTGTAATGTTGGTATGTGTTTGAATTATTTTAA
TAAATACAATGTTAAATACTTAAAGTACCAACTAAACCATTATAAAATATTATAAAGAAC
TATAAAAATTCTTTACATTTTTAATAGTTTTTCTTGCTTCATAGTTCTTCTCAGACTTTA
TCTGAGTTTTCTTAGAACTCCACAAGCTTTAATTTTTTAGAGTGGTTCCAGCTGTTGTAT
CTGTAGCCACTATATTCTTTAATCCAAGATTTAATATATTTATACTAGCATTTAAATCTC
TATCAATCGTAAAACCGCATTCATTACAATGGTATGTTCTTTCAGATAAACTTAAAGTTT
CTTTAACACAACCACAATTAGAACAGGTTTTACTACTAGGGTAGTACGTATCAATCTTAA
TTAAACAGCCTTGGTTTTCGGCTACTTTATATTCCAACTTAGAAATAAAAGAACTCCAAC
TAACATCAGATATTACTTTAGCTAGTTTTCTGTTCTTAACCATATTCTTGACTTTTAAAG
TCTCAAGACAAATAGTTCTATACTTATCAGCTAACTCTCTTGAAACTTTATGTTGGTAGT
CATTTCTTTGATTTTTAACTTTTTTATGAAGCTTTGAAACTTTTAATCTTTGTTTTTCTC
CATTATTAGAACCCTTTTGTTTTCTACTTAGACTTCTTTGAGAAATCTTTAATTTTCTTA
GTGATTTTTCAAGAAATCTTTTATTTTCGAATACAACCCCATCGCTACAAATGCAAAAAT
CTTTAATACCTAGGTCAATACCAACAGCTCCATTTGTTTCTTTACTTTCTATATTACAAT
GAAAGGTGAAAGAGATAAAATACTTATTATTTTCTTTTGAAATTGTAAATCCAGTAACTC
TATCAAAATTATATTTTATTTTATGTCTTTTAAAACGAATTTTAAGGTCATCGTTTGTAT
ATCTGGAACCCCTTGGGTTTATCAGAATTATATAATCACCATCTATTTTTATTCTACAAC
CAGCATAACAATTAAAGCTTTGAGTACTATTCTTTTTAGCTTTAAATTTAGGATAATTGA
AAGTTTTATAGAAATTATTAAAACCTCTACTTAGATTTTTCATTACTGCTTGAGTATAAT
CGTTTGGAAGTAAAGATAAAAAGCTGTGCTCTTCTTTTAATTTAGGTATAGATTTATTTA
AATCAAATTCAGTTGGAATTCTTGGAACTATATTACCTTTGTTTTTACCGTTTTGAATTT
CATAAGTTCCAAATTTAGAATTTTTAATATTATAGAGTGAGAGGTTATAGATAGCCCTAG
ACAATCCAAAGAACGATTCGAGTATTTCTTTTTGCTTAGAACTAGGCTTTAAAATGAATT
TAACACTTCTAACAGTGCTATAAATATTTTTAGTTTTAGCCATATTACACCTATGTTTAA
TATTTATTTAGTTTAATACACTTTTAAGTCCAGAATATATAATATTTGATATAAATTATA
TAGTTTTCTCAATTTCTTAAGGTTGTCTTAGTAACATATATAATTTTAGAAAATTCTCCA
ATAATATACATTTAAAGTCTTTTTAAGAAAACTTATAATATAATTATAGATATTTATATA
TTCTTATATATTTCACAAATTATATTAAAAAATAAAAACCAAATTCATAAGCAATGATGT
ATAATTTTAATCTTATTTTAAGATTATTATTATATAATAACAGATAAAAAAGGAGATAAA
ATGATTAAAAACACAAAAATACAAGAAATAAAAGATTTTAACAATGATTTAATATCTAAA
ATGTTAAAAAATAATCCACATTTTGACTTAAAAGTAGACTATAGAACTCAATTTGTAGTT
TTTAAAGACAACTCGATAATAGAAAGTGCTTATTATCCTACTAAAATAGCTACTTGTGAA
GATGGTGTAATTGAAGTAGATGAAGATGCTTCAGATGGCATCTCAATATCTCACAATAAA
ATAGAATTTTTAGAAATGGTGTACCTAATGGTTTGGCAATAGAACTTATTGAGGATAAT
GAAACCAGAATCAAAATTAGATTTGATTTGCAAGATCGTAATATTTCTATGAAAACTAT
TACGCTTGGGATTGTTTAGGAAAAAGAGCTTTCACTTTTTGAAATGATTTAAATCGTTTT
AATGATCGTTTTATGACTAAGATTAAACTTAAGAATTTTTTAACAAAAAACTTTGATTTA
TTTAAAGATTTTATCAAAAGTTCTAATGAATATTTAGATTTTATTAATAAAAGTTTATAA
TTAATTATAGTCAAGGAGCTTAAAATGGAAATAATTAAATCTGCAACTTCAGGTTTTAT
TAAATACACAATAACGTTATTTTTATTAGGATTTTTTCAGGTATAGCTTTTACATTTTT
TATGACTAAATGGTATTTCGAAGATCGTGGATCAACTATAGGTTATGAAATTCAAAGAGC
CAATATGATAAAAATTGTATAAAAGAAGTTGATGTTTCCTTAGAAATAATGAAAGAAGA
AAACTCGGTCATAGATGCAACGCAACCATTAAACTAAATATAGGATTTAAGATGATTATT
GAAATAAAAGATTTTCCATTAAATGTTAAGAGAGTAGTTTTAGAATTTGATGATTCTGGT
GCTTGTACGATAGAACCAGAAACAAAAGTTAAAAAAAATCTAAGATTTCTAAACCTATTA
AAGAAGTTGAAAATGATTCAGCTGATATGACTGAAACTGAACCTGTTTTAGATATTAATT
TTGGTTCTAAACCAGTAAAAGCATCAAACACAGAACCTATTGATAAAGTTGTAATCCCGG
ATATAGAAAGAGAAGCTAACGTTTCAGCTACAATGCAAAACTTGAAACTATAAAAGTGTT
ATGTGTTAACACTATAGTGTAAAACTTAGAAGCTTAAGAATCTCTTAAGCTTCTGTAATT
GCAAACTTATATAACATCGGAGTAGTTGCAGAATGTAAAGGGTGTATTGTATATGCATTT
CTTGTAAATATACCTACAGTTCTTTCACCGGATTTATAATTATAAGCAGTTGTTAAGTTC
ATACAATATGGGCTATAAATCAACGAATTAACACCCTTTTCTTTATGAGATTTTAACCCG
ACATAAGCATTTTTATCGTCAGGGTTTGGATTTAAATAATATCTTGTATTATTAATCTTA
CCTAAGAAATAATCATTCGCTCTATTTTCATCTGTTGAGTCATCTATTCTTGAATAAGTA
AAACTTAATGATAATATACCACCTACACCAGTTTGCGGAAGTATACAAAAACTATCGTAT
GTTCTAAAATTAGGTGAATTCATTTTAATAACTAAATCATTTACCTTTTTAGATATATGA
AATAAGTTTGTTCGGCATTTTGTTTAGAATCGTTGTTATCATCTAACGTAATACCTTCT
GATTCAACTGCATTTTCTTTAATAAGATTTATAATTTTTTCAGTTTCTTTGTGTGCTGCA
```

FIG. 16AC. Continuation of (CJLB-14 [organism=Campylobacter phage CJLB-14] complete genome)

```
GAAGACTTGACCCAGTTAATGAATAATTCTGGTGTTTGTTCATTTCCGGCTTTATTAAGA
TTACTTAAATTTAATAAATCTTCCCAAGCTTCCTGTGATATTTTGATAATAGATTTATTA
GTATCAACATCAATTTGTTTTTAATAATTTTAAATGTATCTTGAGTTTCTTGTCTTGCG
AAAACATATCCAGATGGTTGCATCATAGGTTGAACTTCAGCAATATGATGACCTATAAAC
GATTTGATTTTATCTTTTAAGATATCACCTAACATAACTTGGTAAAAATCTGCATCTATA
CCTTCGCTAATTAAGTTTGTAGTCTCCTTAAGAGAATTTTCTAATAATAGTTTATACATT
TTGGCCTCTATGTATTTTTAAGTTATTTATTATCTTAATTAACTTTAATATTTAGATTAT
TTAAGAAACTTTTAAGTTATTTTATATTATAATTATTTCATCAAAAGATAAAGGAGATTA
AATGAAAAACTTTAAATCAAAATTAGGTGATAATAGATTTACATTTGACTTAGTTTACAT
AGTTGTAGCCGTAGTAATGATGATAGCATACCCAGCTTATTTTATTTGGGGTTAAAATGA
ACTTCGTAACCAAAGATTATATGTTAACTGCAGAAATAGCGGATAAATTAATATAAGTA
TGACTAATATTTCAAAATGGTATGTAAAATTTCCAGAGTCTGTTACTAATAAACATTTAG
TAAGAATAGGTAATTGTGTGTTTGTTCACAGAGACTTTCCTAATTTAACTAAGAATATGA
AAATTATTTTTAATGAACCCAGAATAGATTGGAGTAATAAATTACCATTGAATTATATGA
TTAAAAATTTTAAAATTAATGTTACATATTGTGAAAAATATAATATTGGTTATAAAACAA
GTTATGATTTTAAAACACATAGAAATCGAACAATTCAAAAAGATTTTTTTGCATTTGACC
CTAGTATTTTAAAATTATTAAAAGCTACTGAATTAGAATCAAGTAAGGTTGCTAGCTTAA
ATTCAATTCAAGTTTCAAAGAATTACTTCATTTGTTTTTGATTATTTAAAGGAGTAAAAA
TGGATTCAAAAAGCTTTATTAAAAAACAAGTTCTAAAAATCTTAAAAGTAACTAATATAG
AAGAAGAAATTCTTCATAAAATGTTCGTAGATGAAGGTGTTGATGCCGATTTCTTGATAC
AAGTTCTGAAAGATCTACATAAAGAATCTAAAATTAAAGTTCTAATTAAATCTGATAATT
GCTTGTTTGAATGGGATTCTCACAAGCCTTATATTAAAGGTGTTTATTGACTATAAGTCT
TCTGATACAGAAAGAATACTTGATTGTATCAAAAACTACAACTCTCTTTTTAGATCAACA
TATTCATTTTATCAGCAAGTTCCTGACTTAAAACAAGCAGAAACAACAAGACTTCAATCT
AGATATGAAAAAGTTATATTTGGTGGTAAAAAGAATTTCTTTGATAGATTAAAAGGAAAA
ATTTCAAGAGAAGAATACCAACTAAAAAGACTGCTTCCTCTATATAGTGTAGGTGAAGCA
TCTAAGAATGGAAATAGAAAATTCCAAATAGAAGATGAAAATACAATAATTTTTAAAGTC
TCAAGAAAAGAACATATCACTCTAAAATATATTCAGTAGTAGATTGGAAAAACGATGGAT
CTTATAAAATCATAAAAACGGGGTCTATTTCTTTAAAAGCTCTAAATGATTATGATGATT
CTTTAAAAGGACAAGGGTATTCTGGACAAAGTAAAGAAAGAAAATACATTTCAAATAAAA
GAAATCACGAAATCATACAAATAGTCCATCAGCTATCTAAGTTAGCAAATCATTTTGGGT
GTGAGATTTTTAGCTTAGAATACCTTAATACGAAGCAAGGAGATAAAGAAAAAGGAACTA
AGTTCAACAAACTCTGTAATAACTCTAGAGGTTCAACCTCAATATAGTTCATTTATTGGA
AATCTTGAATTCAAGATAACTTAAAAGATAAAAGATGGAGAAGAATAACATCTTTGGAA
ACTATGAAAAAGATAAAAAACTATATCATATATCAATGGAAGAAATCGGTAATAAAGAGT
CTTTTAATAGTTATATAACTAGTAAAATGTAAACAAAGGTTCTAAATGACAAGATATAGT
TTTTCGAAAATAGATACATATAAAAAATGCCCAAAACAATATTATTATAGATATATTGAA
AAGGTTCCAGAAACTCAAAAGAACCCAGCATTAAAAAAAGGTTCTGATATACACGAAATA
CTTGAGTTTCATAACACTGAAAAATACAATGAAGTTCTTAATTCAAAAGATCCAGAAATA
CAAAATATTGCATTAAGATTTATTGATTCTGAATTAGGAAAAGAAATACTATCCAGAAAA
TCTTTAAGAGAATACGAATTATTCTTAGATTCTAATTATGAACCTTGTAGCAAAGATACT
GCTATTTTTGTAGGCTATATTGATAGAATTAATACGACTGAAAATGGATTAGAGCTTATA
GATTATAAAACAGGTAAATATAAAGAACCATCTTATCAAGATTTTACACAATTAATTTTA
TATAGTTTATATATATTTAAAAGACTTAAACTAAATGAAATAAAAATAAGATATGTTTAT
GTTGAACATCTTTTAGAAAATACTTTAAGTTTGTCTCAAGATTCTGCAATTTATTGGCAA
GATAATCTTAATAATCAAATAAAATCTATTGAAAATTCTATTGAATCTAATACTTGGAAT
AGCAAACCAAATAAATTATGTCCTTGGTGTCCTTATGCAGGATTATGTCCAGATTTTAAA
GGTAAACCTAAATGTTAAAAAATAATTTTAAAAAATTAAACGAATCATTTAGTTTAATAT
CTTTAACTGATGACCAAAAAGCTAAATTAATATATTTAAGAAAGATATTCGTTATAATATAT
GGGCTCAAATGAATCCAAAATTAGCTTATGAATACTTCTATAAAGATTTCAACAACCAAC
AAATTGTACCAAACGGTGTTTTAGAATACCTGGGTATAACAACTAAACCAGAAATTAATG
AAAAATTAGATTCGCAATTGGAAATAATTATAAAACATTTAGAACCATTTCCAGTTTATG
ATTATCAAAAACAAGCTATAAAAGATGCTATGCAATTTCATAAGTTATTCATTAGAGCAG
CCACAGGTGCTGGTAAAAGCGTCATTATTGGATTAATTGCTAAGATTCTAATATTAAAAA
AATTAAAAGGTTTGATACTTGTTCCTAACATTTCACTGACAAATCAATTTAATAATGATT
TAATAAATTATAAATTGGATATAGAAACAAGATTAATAGGTGGTGAAAATAAATATTAAAT
CTTTTGATAAACCATTAACAATTAGTACTTGGCAATCTGTTAAAAACTTTAAAGAAGCCT
TAAATGATTTAGATTTTATTATTGTAGATGAAGCACATACAGCCAAAGCAGATCAAATAT
TTGATATTTGCAATAAGTGTATTAATGCTAAGTATAAGATAGGTTTGACAGGGACTATTC
CAGATAATGAAATAGATGCTATGAGATTAATAAGTATTTTTGGTTTACCAAGAACATATA
TTACACCCAGAGGTTTAATAGATAGAGGTCTGGCTACAAATGCTATTATTAATATAATAG
ATCTTAAATATAAATTTAATTTTGAAGGTAATATTCAAGCCAATTGAAACAATTAAAAG
AATACGACCCAAGAAATAATTTAATTCAAAGAATAGGCGATACTGTAGTCAGCAAAGGTA
ACACTTTAGTATTATTTTCTCATACTGAACACGGTCTAACTTTATTTTATAAGTTCTTGA
AATCCAGAGGATTAAACTACGATAAAAAGACTTATAAAGATTTGGCGTTTCAACAAAGAA
ATAATGTATTTTTATTAACGGAATGATAGAAGGTTCACAAAGGGAAACTATTAGACAAT
```

FIG. 16AD. Continuation of (CJLB-14 [organism=Campylobacter phage CJLB-14] complete genome)

```
TAATAGATTCAGTAAACAATGCTATCGTAGTTGCTAATTATGCGACAACTTCAACCGGAG
TAAATATTAAGAATTTACATAATTTAGTGCTTGCTAGTCCACTCAAAAGTTATGTCACAA
TAACTCAAAGTATTGGTAGATTATTAAGACTTCACGATTCTAAAGATATTGTTAATATAT
ATGATATTGCTGATCACAATGGTTTTTTTAAGAAACAAATAAATGCTAGAATAACAAAAT
CTTATGAACCTGAAGGTTATGAAATAAAAAGATTTACTTACAATATATAATATTTTAATT
TTAAACTAAAGTTCTAAAATTTCAGCAAGAATTAAGTTCAAATATATTATAATTCTACAT
AGCTGTTTAAAAGGGGATTGATAGTCACGGTGACGGTAAATACAATAAGGGTATTGTAGA
CCTAAGAGCTTCCTAGTAGCTCAAACCTTTTTTACGGCTTAGATTAATTTTAAACTTAGA
TCTAAACTTGCTGCTATAGTGTTAAATCTAAAAGCTTCTAAGTTTTACACTATAGTGTTA
AATATGTACTTTAGGTTTAAACTTAGAATTAATTTTAAAAGGAGATACAATGTTAATACA
AGTTAACGAAAATACAACTGTTAAATTATCAGCAGTTTGTAATATTAATGTTTTGAAAGA
CAAACAAGTTTTCAATATGTGTTATACTTTCACAGATAAAAAAGGAGCAATGAGTGGTTA
TTATTATGTAGATAATAGTAATATAAACTATCAAAATTCTAAATACTTCAAAGAAAAATT
CATAGCAGTTCGTGGTATTGATAGATTAATATATATTAACACAGATTTTGTAAGCTTTAT
TAAAAAAGATTACGCAAATTACCCAAAAGTGGTAATTGGTTTTAGTCATAGTGTATTAAG
ACACAATGTCGAATCTTTTGCATTTGCACCCGAATATATGTATATTAGAACCAAACCTGA
AGATTTAGATTCTACTTATGAACAAATCTTAGAAGCTATTACAAATATTTCAAAATAAGG
AGGTAAAAATGAGAGATGAATTTGATGATTTGTTAGCAAGCTTGTCAATAGAACCTGTTA
AGAAACCTGAAATAGAATATCAAGAACCATTAGTTGTTAAACCTGCAAGCAACATAGAAG
TTAATGGAGTAAACGAGCAAAACGCAGATTTAAATGATTTTGGTGATGTTCTTAACAGCA
TCGAATCAGGTGTTAGTAATACCAGCAATAATAACGAAAATATGGTAGCTAGCTCAGATT
CAGAAGCTTTTAAGGAATATATAGATCTCAGAAATATTAAAAATGAATCAGATATTGAAG
TTCCTGATTTAGTGGATACAATGCATTTAGAAGAAGCGCCAAGTTTAATACCAGAAGCAC
CTAGTGAACATACAAATCAAACACAAGAATCAAAACCAAGTGGTTACGAAGTCCCAGATA
TCAAGGGAACTATCAAAAGGGTACCAGATGTTGACGATTCTGAAAATAATGTTTATAAAT
TAGAAACTGAATATATTGATATTATATTAAGTTATGAAGAAGAATTAAAAGATCTTAAAC
GTCGTTTTAAACTTAATACATTAGAATATCAAGCAAAAGGTGTTCAGACTAGGTTAGTTA
TTAAAGCAGTTAAACAAGCAGCCAAAGACGCTAAAAAAGAAGGTTATATTATTAAAGATG
AAAATAGAATCCAAGAAAGAATTAATAATGATTCTAATTTATTAGGAAGAATTTGTTCAA
TTATTAATTCATCAATCTAAAAGTTTAATAATATTTTAAGATATTTTATATTATAATACA
CTAAAGTTTAAAAGGAGATATATGGTTCACAAAAGTGTTCAAGATTATTTTCTAAATGAA
TTAACTAATTATTCTTGTTATAGTACTTTAAGAATGATAGCTAGTTCTATTGATGGTTTA
AAAAATTCAAGCAGAAAAATCATTAACACAGCATTAGACAAAAAATTAAATACAGAAACT
AAAGTTAGTATATTTGATAATATGGTTCAAAGTTATACACAATACTTGCACGGTTCGTGT
TCAGGTGTTATTCAAAATATGGCTGCAAGCTATACTGGTTCTAATAATATTCCATTGCTT
GAAGGTAAAGGTAATTTTGGTTCGAGGTTTATTAATGAGCCAGCAGCACCAAGATATGTT
TATGTTAAAAATAAAAAATATATTAATGATTTATTTGATATATTAAAGATGTCTTGATTTCT
CAGAATTTTGAAGGTTCAGAAATAGAACCAGTATTTTACGTTCCAAGTTTGCCTATACTA
GTTTTAAATGGTTCAATGAATGGTCTTGCTAGTGGTTTTAAACAGAATATTTTACCAAGA
TCTTTGGATTCAGTAATAAAATATATTAAGACAGGTAATAAAGTTGATTTAAAGCCGTAT
ATTGCAGGTTTTAAAGGGACTGTTGAATTAGTAGAAGATACCAGTTCTAATAATACACAA
TGGAACTTTATAGGTGTTGTTGAAGTCAATAAAAATAAAGCAATTATAACAGAAATACCA
CCATTTATCGAGTATACAAAATATCTCGAAATATTAGATAATCTTGTAGAGACTAAAAAG
ATTAAAAATTATAAAGACTTTTCAGACCAAAGAAACCAAGATTTAAATTCGAAGTTATA
TTTTTCGATAATATCTCTAAAGAGAAAGCTATCGATATATTAAAATTATCTAAAAGAGAA
ACAGAAATATATAATGCTTTGGATGAAAATAATCAAGTCAGAACTTTTGAAAATATTGAA
TCTATAATTGATTATTACATAGACGTTAGAAAAGATTTTTGGTTAAACAAAAAGATTTT
GATTTAAAAGTTCTTGAAAATGATTTAAATATTAATATTCAAAAATTAAGATTTGTTAAA
TTAATCATTGATTCAGAGTTACAAATTATGAAAAGATCTAAAAAGGATATTGAATTGGAT
CTTGAAAGTAAAGGGTTTATTAAGTTTGAGAATAGTTATGATTATTTGCTTAAGTTACCA
ATACATTCGTTTACAAACGAAACTTTTGAAAAATTAGTACAAAATGCTAAAGAAATCAAA
GCTAAATTTGAAACATTAAAAAATCTGGATACATTTAAAAATTATGTCGAATCTTTAGAT
TCTATTAAGAACATATTAACTAAAGCTTAAGAAAGCTTAAGAGGAGTTAAAATGAGATAT
GAAGCTGTAAACAATAAAACAAAATGGAGGATTCTGAATTGGGTATTATATCTACAAAA
GATACAAGGCATTTTTTATACAAAAAAGTTTTAATTATACTAATTATACTTTAAATATC
AATTCATTTGATCACGAAGAAGGTGAATTAGAAAATATTTTTGCTGATCTTAATGACGCT
AATGAAGGTGATTCTATACAAATCTTTATAGCCAGTGTGGGTGGTTTTGCTGATGAACTT
AATAGATTTACAAATATAATTAGAACAAAGTTCTATGGTAATGTAACAACAGTATTAAAC
CCATTTGGATATTCTTGTGGTGCTATGATGTTCTTAATTGGTAATTCACGTGTAATTTAT
GAGAACTCAAGTATTATGTTCCATTCAGTAAGTTTTGGAGTTTCTGGTAAACATTCGGAT
GTTAAAACGCAATTTGATTTTCTAATAAGTATTGGAATGAATATATGAAGTCATTATTA
AATCCATATCTTACCAAGAAAGAAATTGAATTATTAATAGATGGTGTTGAGTTTTGGTTC
GATGCTTATGAAATGTGTAAACGTGGTATTTGCTACTCATATTAATGTTTTTGGTTTAAGT
ATGAAAGCAGATGCTTATTGTGAGTACATAGATAATTTAGATTATAGAATAGAGTTTCTT
GAATATATTATTAAGAAGGTGATCTTGATTCTATTGATTTACAAAGGGCTGAAATTGAG
TTAGAACAAGCTAAAAAAGATGCTAAGAAAGCCAGCACTACTAAAACTACTAAAAAAGCT
```

FIG. 16AE. Continuation of (CJLB-14 [organism=Campylobacter phage CJLB-14] complete genome)

```
GTAGAATCTAAGCCGAAGGCTAAAACCACTAAAACCACTACTAATAATGAAATTGAGTCT
AAAGATCTTAGCTAAGATCTTTAGGCTTTAAGAATCTTTTTAGTTCAGCTATATTATAAT
CATATATAACACCTAAGGTAATAAAATATGAAAATAACAATCTTTGGAACTGCAAGTAAA
AATGAAAAGTTTGCTAAGTCACCATACGATGACAATTCTTTTATTTTTGAAACAATTGAA
GTCCAAACGACTTACCAAGCATTTCAACTACTTGTTAATAATTTTTGTTTAAATATTGCC
TTAGACTTAAAAGGACCTGGCAAATCCAGAAGATTAAAAACAGATTTAGAACCTCATATA
ATTAAAACATTTGATCATTTATTATTTGATTTTGAATGTAAATCAGAGTTTAATAAAAAT
ATGGCATTAGACTATTTTAAGAGCACACAATGCACTATCGGTCAATCCAGATCTTATGAT
GGTGTTAATAATTTTAATTTAAAAGGTATTATTAAAACAGCTCCAATGAGCTTAAAAGAA
CTAAAAGTTTTGCAAGCTAAAATTCAAAAAGAACTTTCTGAGTATGGTAAATATACTACT
GATACATTAAGAATAACTTATTATACAGCGCCTTTGAATAAAGATAATATACTCTTGGAT
AACCCAAACGGTTCTATGTTAATGCCTATAGGTACGAATGTTACAGATTACTATAATAAC
ATAGATTTAGATTGTAAATTTAATATTACCTCTAAAGAAACTACTGAAATATGCAAAACA
ATTTTTAAGAACCTGGGTTTTATCTTAGTAGATATCAATGCTAATGGTTCTATAAAATAC
ACAAAAGATTCTGAAAATTATATTTGGTACCCAAATAATCCATATATTATGAATCATACT
GAAAGTTATATGTCAGTAAATATTTGGAAAGAAGCTATAAAATATGAACCTACTTTTGAT
ATAACTCCTTATATAGATTATAAAGCAGATATTGTAGTTGATAGAAACTTTACAGAAATT
AAGTCTGAATTAGATTCAATTGTAGAAGCTTTTTTGTTTAAACATAATGGTGCTCTGACT
TTGAGAGCTCCTATGGGTTCGGGTAAAACAACTTTTATAGATAGAATTATAGAAGCAGCA
CTAGAGAGAGATTTTAAGGTTGCAATTATAACCAATAGAGTTACGTTAGCAGAAGATTAC
AAAAGAAAATAAGAAGTTTTTATATTATAAAGATTATACTGATGCTATTAAAGCCAAG
AATACTAAAAAATCAACAAAAAACCAAAAATAGTTAGATCAAAAGGTAAATCCTTAATTT
GTCAATACGACAGTTTTAGACATTTTGATTTAGATGACTACGACCTAATTATACTCGATG
AGTTTATGAGTTTATTAATGCATACAAGATCTGCATTGAATAGTAAAACAGAGAACTTAA
TAAAATTCTATACTGCTTTAAATAAAAAAGTTGTTGTAGCTGATGCATTTTTAAGTAAAT
ACATTGTGGACAATATGTTTACTAAACCTTTAAATGTTGTTAGCTATACAAAAAATAATA
CAGAACTTTATAGTTGCAATGACAGCAATACCTTTTATACATTAATTAAAAATGCTTTAG
ATTCTAATAAAAAAATAACTATTTCTACAACTAGTATAAAAGTTGTTGATATTATTAAAG
AAATGTGTTATATACTAAATAAAAAAATAATTATTTTTAATAAAGAAACCAGCTCAATAT
CAAAAATATTATATATGATAAAATTAGGTCTAAAGAAGCACTAGATTGTGATGTCTTTA
TTTACACTCCAGTGTTAACTGTGGGAGTCAACATTCTGAATGATGTTGATATACATTTTC
ATTATGATAGTGCGAGTTCTACAGACGTTATTAGTTCTTTACAAATGTTAGGCAGAGCAA
GATTTTCCAAAAAGATAATTTACTATGTTATGAACAAAAAATATAATGCTTGTATTAATT
ATGATTTATTAAAAACTACTGTAGAAAAAAAGTCTTATGAACATACTGATGATTCTAAAG
ACAGAAATGTTGAATATAAGAGGGGAACTGTTAAAAATCTTTTATATCATTTCACGTAC
CACCTGGTAAAGATTACCAAGAATTAGACCATATTGGTAAAGCTTGTCTAAAAGTAGATG
TTTTTAACAATATGACTTTATGTGACTATAAAAAATCTTTTGATATTTTATTAAGTTTA
ATTTTAGTAAGATACCTATTGAATTGAGAAAAATAGGCGGTGATATTTTAAAATTAATGA
ATATTAAAATTCAGGATTCAAAAGATTCTGATACTTTTTAGTTTTGTTTAATTTTAAAAT
CAGTCTAAATATATTATAATATATTATGATTTTTAAATATCAAACATATAAAGGAGTTAA
AATGCAATTAATAGATGGCTATTATATAGATTCTGACAACAATAAATGGGATGCTTCTAT
GTATACTGAAGAACAAGCGAAAGAAGCTTCTGAGTCTTTAGTAGTTTGTAAAGATTGTTT
AAATTGTTTCAATTGTATTGATTGTTATAAATGTATTGATTGTATTGATTGTTATAAATG
CCGCGTTTCTAAAGATTGTATTGATTGTAAATCTTGTATTGATTGTATTGATTGTTATAA
ATGCCAAGGTTGCTTTAAATGCCATAAATGCGTTTATTGTTTGGATTGTCACGAATGTGT
GAATTGCAAGAGATGCCGAGCTTCTATAGATTGTTTGAATTGCATTGAGTGTGCGAATAC
TTCGAATGAATCACATACTCGAAAATCACATACAGTATTAAAAATATATAAAATCTTAAA
TGCATAAAATCACAGATTCATAAATAAACTAAAAGGTGATAATGATTTATATTACAAGTG
ATTTACATATATCTCATCAAAATATTATAAAATATACTGGTAGGTATATTGATGATGCTT
TAGAATATTCAAAAGAAGTTCATAAGTATTTTAAATCTGTTTTAAAAGATTCTGATATTT
TAATGTTTTTAGGAGATTTAGATTGTGGTCCTAATAAAAATATAGAATTCTTAAGACACT
TTATTAGTTCATTACCAAGCAAAAAATTTTTGTAAGAGGTAACCACGACAAGTGGTTAG
ATACTGAAAGTATTTTATATATTGGATTAGTGCAGTTTCTGATATCATTAGATATAAAG
ATACTTTGTTTTGTCATTATCCGTTAGATTCAAAATCAGTAATACCTAAAGAAGCTCCAG
AGTTTTTAAAATCATATGATTTAACTGGTATTAAAAAAATATATCACGGCCATACTCACA
ATAATTGGATAGTGGATTCTAAAGATGGTATTGAAAGAATTAATTGTTGTATAGACAGAA
ATCCAGAAGTTATTGGTGCTTTGATACCATTCGAGCCGAAGACTTAAAAATTTAAACAAA
AGGATATTAAATGAATAAAGTTTCTGAAGTTAAAAAAGTTACAAGAGTTTTCCAGGGAAA
ATCTGTGTATGATTGTTTAGTTCGTTGGAATGATACTAATAAATTTGTGCCTTGCACAGT
TGATATTCAAATCCAGGTGACCTGAAGCCATTAGCAGATTACTTACTTAAACATAATCT
TATCTCTGGTCTTTAATAAAAGACCTTACCAAGGTTTGTGATGCATAGTGATGTTATTCA
AACTCTAAGTTCAGCAGGTGCTTACTTACCTAATGATACTATATGCCCTAGGGCAAAACT
AGACACTGGCACATACTGCAACTATCGTTGTTATTTTGCTATTACCAAAATGAGTTAGA
TAAAAAGACACCATTTGAAGTCATTAAAAAAGAATAGATACTTTATATAATATAGGTTG
TAGAGATTTTGATTTAAGTGGAGGAGAATCTTCCATACACCCAGATTTCTTTAAAATCCT
AGAATATATTAAATCTTTGAATCCAGATAATAAAATATCTTGTTTGACAAATGGATCTAA
```

FIG. 16AF. Continuation of (CJLB-14 [organism=Campylobacter phage CJLB-14] complete genome)

```
ATTTCAGAATAAAGATTTTCTTAAAAAAGCAAAAGATCTTGGGTTATCTGAAATATTATT
TTCATTACATAGTGTTAATGAAACTCACGATAAAATAACTGGGATAAAAAATTCTTATAA
TTATATAATTAAAGCTATTCATAATGCAAAGGATCTTGATATTGTTGTTAGATTAAATTC
AACTATTACTGATGTAAATTATAAATTAGTTGATACTGAATATTTCGAAGTTGTTGAAAA
ATTAGAACCACTTGAAATGAATTTTCTACCATTGAATTATTTTAGTCAGAATTCAAAATC
AAAAGGTGTTAATTATTCTGAGATTTTAGAACCTATAAAAAGATTTATAGATTCATCAAG
TATACCTTTGATCAATGTCCGATATGTCCCGTTTTGTTATATGACTGGGTATGAGAAATA
CGTTGTAGGATATTATCAGCACATCTATGATATTTACGATTGGAATATTGCTATGTATGA
ATACTTAGAACCTAATTTAGTAAATTTAGCAAAACAAGCTGCATCTAATAGACAAAAAAG
TTATAGGAAATGTGATGCTTGTAGAACTTGTAAGTATTTTTATATTTGTGATGGTATTGA
GCCTCAAGTTCTTAAAGCAGGTTGTGAGTTTAAACCTATTCAAGGTTCTAAAATAAAAGA
TGTTAATACGTTTAGAAAATCATTCTTTAATTTTTAGTTTATGGTTTTAGATCTTAAACT
TTAGACTTTAGTTTTAGATCTTAAACTTTAGACTTTAAACTATAGTTTTAATTTTTTAAC
ATTTTAAAAGGAGTGTAATGGATATTTCATTAATTATAGGACCTATGAGATCTGGAAAAT
CACTTGAATTGTTAAGACAAGCAGAGAAACTTCATTTTAGTAACAAACCTTATGTTTTAT
ATAGACCCAAAACTGACACAAGGGATTTTATATCAAGAAGTTTTAGACCTAGTTTAGACT
TAAATATACAATACTATAACAATGAAAACTTCAGTGAATCCAAATATGATTATATATTAT
TAGATGAATTTCAATTTTTTGAACCTGAAATTATTAATAATATATTAGAATCTAATAAAA
CATTTGTTTTATGTGCTTTACAAAGTGGTACTAATAATATCAATGAACCTTATAATGTAG
AAGTCTTTAGAAATGTCAATAGAATTATGCCATTTTGTAGTGATATTAGATTGTTAACTA
GTATATGTGAAAATTGTGGCAGTTCTTGTGCTACACACAGTTATACCGATGTTATCACTG
TTTCTGATAATTATAAGATTCTTTGTAATAATTGTTTAGATTTTAAGATTTCAAATGCTG
GTATTTTTAAGAGATTAAAAACTTGAATCATTTTAAATATCTTAAACTATTATTAAAAAG
TATAAAAAATGCTTGAGTTTTTAGTAGTATATACTATAGTATAATGTCTAAAACTTAAAG
CAATATTAAAAAGTATAAAAAATGCTTGGCTTTTTAGTAGTATATACTATAGTATAATGT
CTAAAACTTAAAGCAATATTAAAAAGTATAAAAAATGCTTGGCTTTTTAGTAGTATATAC
TATAGTATAATGTCTAAAACTTAAAGCAATATTAAAAAGTATAAAAAATGCTTGGCTTTT
TAGTAGTATATACTATAGTATAATGTCTAAAACTTAAAGCAATATTAAAAAGTATAAAAA
ATGCTTGGCTTTTTAGTAGTATATACTATAGTATAATGTCTAAAACTTAAAGCAATATTA
AAAAGTATAAAAAATGCTTGGCTTTTTAGTAGTATATACTATAGTATAATGTCTAAAACT
TAAAGCAATATTAAAAAGTATAAAAAATGCTTGGCTTTTTAGTAGTATATACTATAGTAT
AATGTCTAAAACTTAAAGCAATATTAAAAAGTATAAAAAATGCTTGGCTTTTTAGTAGTA
TATACTATAGTATAATGTCTAAAACTTAAAGCAATATTAAAAAGTATAAAAAATGCTTGG
CTTTTTAGTAGTATATACTATAGTATAATGTCTAAAACTTAAAGCAATATTAAAAAGTAT
AAAAAATGCTTGGCTTTTTAGTAGTATATACTATAGTATAATGTCTAAAACTTAAAGCAA
TATTAAAAAGTATAAAAAATGCTTGGGTTTTTAGTAGTATATACTATAGTATTACTAAAA
GAACTAGAATCTAAATATCATATTTTAAATTATTCTTATAAAACTTAAAACTTAAAGCA
ATATTAAAAAGTATAAAAAATGCTTGGCTTTTTAGTAGTATATACTATGCTAGTACTGCT
AAAACTTAAAGTAATATTAAAAAGTATAAAAAATGCTTGGGTTTTTAGTAGTATATACTA
TAGTATTACTGCTAAAACTTAAAGCAATATTAAAAAGTATAAAAAATGCTTGAGTTTTTA
GTAGTATTATATCCTAGCATATGCTTAAAATTTTAAGTATATTTAAGTATTTTCATAAT
ATAATACTATCAATAGAATAAACAAAGGTTAAAAAACAATGAATAAAACCGATAAAATGA
TTGAAGCTATCGAGGATACACTATTAAGTCCAGAAAATTTAGGAACACATTTCTACGTTT
TAGAAACCATAAAAGGATTTGATTTCAGTATTAAGTTCGATAAAATAAATAGCTCTATTA
AATATTTTACTAAAAGTAAACCAATTAATTTTGAATCTAATAAAAGTCCAAAAATTAAAA
CACTTAATGATACTATTAGTGAAGTTAGTTTAATTAACAAATTAGTAGAATTAATTAATA
TCAAATACCCAGAAGATGACCATATTGAGTTCTTTTTGACATTATTTCCTATTGGAGTAA
GCAAGTCTAATGATTCTGATACCGCAGGATATGCAGTCATAATGTATGACATTTTAGTCG
GTTCAAAACCACTAGAATCCAAATATGAAGATTTGATAATGTTTTAGATTATTGCACTT
TAGCTGGTATCAAAACGAATCCAATTATTAGAATTGCAACTGATTTAGATTCTGCTTTAA
GTGTTCCTGTAAATGGTGATTCTATGATTCCATATCTTTTCAATAATAGTTCGGAGTTGA
TACCTATGTATGGCATCACCATCAGACCTTATAAGGAATTACAATACAAATTAAGATCTA
AAACTCATAGACTTATTATTGATCTTGATGAGTCTAATATGCCAGTAGGTTCTAAAACTG
AAGATTCAGAATTTCTTAAATTTTTAAACATAGAATCATTAAATGTTGTAAAATCTCAAA
ATCCAAAAAATTTAGAAACAGAGCTGATATATTATAATAGAAAAAATAAATGAAATAA
AACACTTGAGTGTAGAAGAAATTAAAAATCTAAATCAAGTACTCACAAAGAGTTAAAG
ATTTCATCTCTGTGAACTAAAACTAAAATGTTAAGTTTAAGACTAAAATGTTAAGTTT
AAAGAACTAAAATATAAATCAAAGAACGAAAGGAGTAAAATTGTCTATGAAATTTTTGT
AACCGGATCCAGTGGTTTCCTAGGATCTAACTTTATTAAAATACTATATTCATTGGATTC
AAATCCAAGAGTAATTGGCTTAGATGTAAATCCAGGCGAATATACTGATAGTACACAAGG
TATTAAAAATGCTAAGAAATCTGGGTTGCTTAAAAACTTAATTAAAAATAGTGATATAGT
TGTTCATTTTGCAAGCCATTTAGGTGTTCAAAATATTGTAGATAACCCAAACTTACCTTT
TAAATCTTTTAAAAATGATAAAATTGTTGTAGACTTAGCCACTAAATACAATAAAAAGAT
TGTATATTTTTCTACTTCTGAAGTATATGGTGATTCTAAAGATTACTCAGAATCCAATGA
TTTAATTATAAGTTCTAAATTAAGATCTAATTATGCTTTAGAAAAAACTTTTTATGGAAAG
ATATATCCAATCAAAAACAAATAATTATTTAATAATAAGACCTTTTAATGTTTACGGTCC
```

FIG. 16AG. Continuation of (CJLB-14 [organism=Campylobacter phage CJLB-14] complete genome)

```
TGATCAAAATCCAAATAATGGATTCATTGCTAAAGTATTAGCAGCAGCTTTCAATCCTAA
AGAAGTGATTAAAATCAGAGTCGATGCTGAGTCAAAAACAGGGACTGAAAGATGCTATTG
TTATGTAGATGACTTTAATAAAATTCTTTATAAATTAATTAAACAAAATATCAGCGGTGT
GTTTAACATAGGAAATCCTATGGCTAGAGCAAATCCATTAGATATCATAAAAATATTCAA
TGATTTTGGGTATAATATAAAATATAAATTCGAAACTATTGAAAATGAAAATGATTATGA
AATACAAAGACGAGTTCCTAGTATTGTTAAATTAAGCGAAGTTGTTCATATCGATTTTAC
AAATTTAAAAACTGGTATTAAAAATATTTTGTATTATATTGACCCACCATTTTGAGATAA
AATTTAAAACCTAAATCAACAAGGGGTAAATATGCTAAAACATTTAATAATTGCGGGCC
ATCCAGATGACGAGGTAATTGGTTGTAGTTCTATACTACTAGAAGATTCTGTTGGTGTTC
TATACATCACAAATGATTATAGTACTGCTAACACAGAACGTAATAAAGTCAAAGATAAAT
TAGCTTTGGATTATCAAAAATGTTTAAAATATTCATTTTTTAAAATGCCTGATATTAATG
AATTAGCTGATAATATTAAAGACGTTTTAGACTCCATTAAACCAGAAAATGTTTACGTTC
ATCATCCAAAAGATTTGCATCAAGATCATAATACTATTACAAAAGCAACCCTAATAGCTG
CTAGAATGAATAGAAATGATTATATTAAATCTTTAAGTTATTATTATGTTGAAAATCCAT
TTGAATTAAAAGCTTGTGAATTTAAAAAAATAGATAAAGATGAAAAACTTAAGTTTTTAT
CTAAATATAAAAAGTATATACCGGAAAATCATATCAAAACTATTTTAGCTTTTAATGAGT
TCGTAGGAATTTATAGCAATTTAGGTTTTGCTGAGCCGTTTGAAGTTGTTTATAAGCGTT
CTTAATTACATTAAATCTAAGAAAACCAAGGAAAATAATGAGTGAAATTATAATGATTCA
CGAAGTAAATGATAAAGTTCTCAAAGCTGTAGAATCTTTAGACCCAGACAGCATAATCAC
ATTTGATGATGGTTTATATACACAATTTCATTATAGAAGTCATTTTGCGTTATTTAAACG
TGTTATATTCTTTGTAAATCCGTCCATAATTTGCGAATCTTCCGAGAAACAATCTAAAGA
GTATATACAGTGCTATAACGCCCATAAAAAGGCATTTAAAGGCTGTTTTGAAAATTATAT
GACATTAGATCAAATTCAGCAAATTTCAAGGGAAAATATGTATAATTTTGAAATAGGTTC
ACATTCTTATAATCATAAATATTTTAAAGATTCTAAATCTTTAATAAAAGATATTCAAGA
TTCTTTAGATTTTTTTGAGAATCATAATATACCTATTAAATCATTTTGTTTTCCGTATAA
TCAAGATTCGAGAAACCCACATTTTACCCAAGCAGTTAAACTAAAGTTTAAAGATTTGGA
TATTTTTGGTAATAACAGAGTACCTATTGAATCTAAGTTCTAAATGTTAAATATTAGACT
AAAGTCTTAGATTTTAGACTTTAACAATACACCAAATTAAGGAGCTTAAGTGAAAAATAT
TAAAGTTAAATTAATAGCAGATTCTGGTATCAATGTTTTTATTGACGCTGTCAGAACTTG
CTGGGATAGTCATAGTAAATGCGATACTAATGGTGATAATGTAGGAGAAAATGATAAAGC
ATTAATAGATAGAATAGTACACAAACATAAACACCATTCTACATTAGAACATTTGTTTTA
TAATTTTGAAATCACAGGAATTTCAAGACTTTGTTTGCAAGAGTTGGCAAGACACAGAAT
GGCTTCATTCAGTGTTAAGAGTACAAGATATACACTAAAAGAACTTAGAGGTGCTGATAT
TTCTACATTAGAAGATGCAAGTAAGTTTATTGTTTTAACTGATAATGAATTAGTAGATGC
TGCAAGCCACAAAAACTTAAAAGAACTTCATAACATAGTCAATACAAATGGTATTACCCA
AGACTACGCCAAGTATTGTTTACCAGAATGTTATAGAACTTCATTAAGATTTTCTTTAAA
TGCTAGAAGTTTAAGAAATCTATTAGAACTAAGATTATCTAAAGGTGCTCATTTCGAGAT
TCGGTATTTGGCTAAATTGTTGTTTGATGTATTACCAGATCTACACAAAGAATTAATTTT
TAATGATTTAGAATATTCAGAGAATTAATTTTTAATGATTTAGAATATTCAGAATAAACA
CAAGGAGTTAAAATGTATGTTACAAAAGAAGTAGACGTAGAAGTTGAAGTTGAAATAGAT
GAATTTAGAGACTGCGACGTCTTAAGCACGCCAGGGATTTAATTGAAGATAATAAATCT
AACCTAGAATATTTCGAAGGTTTATTAGAACCAGAATTTAAATTTGATTTTTTAAATGAT
TTATATAATATAGAATACAAAAAAATTATTTTGAATCATTTCCTGAGCATAAAAAATTA
ATTGATTTTATAAAGATAAAGAAAGGAGTTTAGAATGTTATCTAGAAAGATAAGAATTG
ATAGCTTTATCTCTGATAAAGAAAAGAAGAAATTCTTCTCAAGATACAAAAAATGAATA
TTACTTTGTAATATTTGATTAAATTCTTATAGATTCTTATAGAATTTAAAAATCATACTT
AAGAACCAAGGATTTTAATGAACGTTTTATATAATAATGAATATATTGATTTTACAAAAG
AACCTTTATTTTTTGGAACAGGTAAAAACTCACAAAGATATGATGTTATAAAATATCCTA
TCTTTGAAACTTGTTTAAGAAAATGGCTGGTTTTGATTGGCAAGAAGATGAAGTACAGT
GCACTAAAGATCAAGCAGATTTCAATATCTTAAATGACAAATGAAACATTCTTATACTA
GAGTGTTAAACAAGTTAATTTTCTTAGATTCTATTCAAGGCAGGGGTTTATTACAAACTA
TTGGATCTATTGTTACTAACCCAGAACTAGAAGTTTGTATGACAGAATGGCAAAGATTTG
AAATTTCAAGACATTCAAGAAGTTACACCCATATTCTTAGATCTGTTTATGCTAACCCAA
GTAAGATATTTGATGAATCTTTTGAAATACCAGAATTATTAGAACTTGCAGATAGTATTT
CAAAACCATATGAAGAAGCTTTTGAAGCTGTAACAAAGTATCATTTAGGATTAATAGATA
CTGAAGAAGTTAAAGTAAAAGTTCTTAATATGTTAGTCGAAATTAATATATTAGAAGGTG
TTAGATTTTATTCTGGTTTTGCGACAATTTGGAGTATGCATTATAGCCAAGGGTTAATGG
AAAGAACTGGCAAGATTTTACAATTAATTTGTAGGGATGAAAAACCTACACTTAGCAATAA
CTCAAAATCTAATTAAGATATTATCAAGATCTCCTGAAGAAGGCTTTATAAATGCTGGA
ATTCTATTAAAGATAATATAACTGATAGATATTTAGAAGCTGCTGATCAAGAGTTTAAGT
GGATTGATTATTTGTTTAGTAAAGGTGCTTCTTAGGTATGACACCAGAATTAGCCAAGA
ATTATATTAAATATCTTATTAATAAAAGATTAAAAGCTATTGGATTCAAAGAAGTTTTTG
CTGGGTTTAATAAGAACCCTATACCTTGGGTGGAAACATATATTAATTATGATAAAAATG
AAGTTCTCCCGCAAGAATCTGAAATAACAAATTATAAAATGGATATTTTAGACACTGAAA
TTAAAGATTCTGCTTTTGAAAGACTTAAGAAGAAATTAAAAATCTAAGCTTTTAGATTTT
AACACTTTAGTGTTATTTGCTAGCTCTATAGTGTTAGCTTTCAGTTCGTTAACACTATAG
```

FIG. 16AH. Continuation of (CJLB-14 [organism=Campylobacter phage CJLB-14] complete genome)

```
TGTTTTGTTGTTAATTTTATTTTATTTTAAGTTTATTATTATAAAATTATATAAAATTAA
AAGGAGCAAAAATGAAAGATTTAACAACAAAGTTTATTAATATTATGTTGAATAACAGCT
ACGATGAAGCTCTACACAACAAAATACGAGAAAAATTATTTAGTTCCGATTTACAAGGTT
CAAATTGTGACACAGGTTTTGAATCATTTAGACTTGAACTCAATTGTTCAATTGATGAAC
TCAAATCAAAATTATTAGGTTGTGGATACCTTGACGACACTGACGAGGATTTGTGGGACT
TTTTTAAGTTAAAAGATTCTGATGGTGATTCACAATGGGATAATTACGTTTACAGTTTAC
CTTCATCTACAAGAGAGTTAAGCAGCACTACATTTAGAATTAAAGACGGAAATACTATTG
TTTTCTACGATATGGTTTGGGGTAACGAACAAACTTGCCATTTGACTTTTAAGAACTAGT
AAATATTACACTTTAGTGTTAACGAACTTAAACGACACTAAAGTGTAAACTTCTAAGCTT
GCTAGTACTATTGAATATCAGTATCCTTGAATCTTGATAAAATCAATTTTGTAATATAAA
ATTGTGAACTTTCTATTTTATCTATAAACCCAGTTAAAATATACTCACCAGAAATTTTAG
TGTCTCCTTCTTGTGTTTCATTAGTATTTTCGTTAGATTTAAATAATACTTTGTATTTTG
TGAATATTTCTGGTGCCTTAACAACTCCAGGTACTACTAATTCTAACTTAGAATAATCTA
AAAACGATTTATATGTATCAGCAAAATATTATCATCGTACAAATATTCTTGAGCTTGAT
ATTCAAAACCATCGTGATCTTGAGATTCTACTGGAACATCGAAATCTAAATCTTCAAGAT
TAATTTTCATAACTTTCATTGTTTTAGTAGCTTTATCAAATGCGATTATTGTGATTTCG
GTAATTTCAGAGCTTGGTTTGTGTTTATAATCTTCCTAGATAAAATATCATAAGGGTTGT
TAGGATCTTTTTTAAAATCATCATATTGTATACTTTGAAGTTTTAAATTATTTGGTTTGA
GTTCTTTATAAGGTTTCATAACAATTTTTGTTTATCCTGAAATAATATTAATCCTTGTC
TATCACATTCTTCGAATATGAAATCCAATACAGATTTTCGTGAAGTTAAAACGAAGTTTT
CAATTACGATGTTGCTAGATAATTCCAATTTAACAGAATCTGGATTATATTTAATTTTG
GTTTAATATAAGTATCATATATATCTTTAAAAATATCTGAAAGTTTTTTATTTTTATATG
TTTTAGCTATATATAATTTACTAAACAAATAAGATACCAAATCTTGACCTTGTATTGTAA
AACTGGATTTATCAGTTGTTTGAGTTTATTATTTTTAACAACTTGAAATTCTCTTCTAT
AGTAACCTTCACTAGCATCTAATATAAAAGGAATAAATCGCATATCACCGGATTGATCTA
AATAGTATTGTAAATCCGTGGTGCCATTGACTGTAAAATAAGACAAGATGATAAAACCAT
TGAATGAAATTTCACCAGATTTTGTTTCTCCAGTTTTTAATTCAAGTGATTTACTTGATT
TATTATTAAGAATAGATAAAGTAAAATCTTTGACATCACAAGCGTGAGAAAATAGACTTT
GAGTTCCCGGATTCATTAGAACCTACCAAATACATCATCAGAATTTGTATAAAAATCTTT
TGTTTCTTGTTGTTGTTTATCTTTAATAGAACTCAATTCATCGAAATATTTTCAAGCTC
GTTATGCATATCTGTATTAGGTGTTTGCTTGTCTAATAATTCGTCAGATCTAATAACAAA
ATCACTTTCAAGTTCATCAGATTTTTTAAATACATAAGTTTTACATTTAAATTTATAAAC
ATTTTTATATTGATTATAAAGAAATACGTTATTTAACCCAAAACAATCTAACGTAATTTC
GGTAATTTCAAGAATCTTTCCACTTGGAACGATTATTAAAGATCCTATTAAATCGTGAAT
TCTGGAATCTGGTAAAGTTACATCGTATTCATTCTTAGAATTCATTGAAGATTGAACTAA
ATTAAATGTGGAAATTTTAGAAACATATAAACCTATACTTGTATCTAATGGGACACCAAA
TTGGGTTTGTAACCTTTCATATTGGTCAAACTCTTCTGAATTTTCTGGCATACCAAATAT
TTCAAAACAAGCTCTATTATCCGCTTTAAAATGACTAAAATCACCAAATGTTAAATCCCT
GTTAATTTTTTGGTAATGATTAATTTAAGTGGAGCACCATAAAGTCTAATGAGTTCTTC
GGTAACAGATCCACTCAGATCATATTCATTAGTATGCTGGTTAAAATTCAATTTTAAAGC
CTCATTTTTGATATATTTATTTTAAGTAATCAAAATAAATAAAATCAAAAGGTTCAAGAT
GGACAGCACAGATAATTCTAAAGCTACAAGTATTGAAACAAATCAATATATAAAAAATCC
AAAATATACAACAAAAGAAGCTATTGATAAATTTGTTAACCTATTGATCCTGGGTAGATA
CACTGAAAAAGATTTATCAGATGCTTTGAACTATTGCTTAATACGTAGCACAGAAAGTTT
TGATAATATAGATTCTATAAAAGAAGCTATAGAAGAACTTAAGAAAGATTCAGAAGCTTT
TAAAATATTCATAGATAATACAAATAAACTTTTAGATGCTATTCAAGATATTAATAAAGA
ACAAACTGCTGAAATTGATAAAATTAATGAATTCTTAAAAACAGCAGTAACTTTAGATAC
TGAACAAACTATTACAGGAACTAAAACATTTAATAAGATTTATGTTCCAAATCCTACAGA
ATCTAAACAAGCTGCTAACGCTCAGTATGTTATAGATTATGTTAAAGAACAATTAAGTAA
AACTATTGGAGATTTAAATAATTTAAAAACTGAATCTAAAGATTTAATTATTAATGCTAT
TAACGAAGTTCTTGACAATTTAAATGCTTATAAAGAAACTATAAATGAAACTACTATTAA
TCAAATGATTGATACTAAGTTAAATCCATTAATAGAAAGAATTACAACAATTGAATCTAC
TGCGGATTACACCAAAGAATTAGCAGAAGCTAATAAGCAAGCTATTGAAGATTTAAATAC
AAAAGTAGTTGATAATACTAGTGATATAACGGATATCAATAGAAGACTTGAAGAAGCTGT
TTTCTATAGTAAAATTGATGATACTCGCAAAACTATACAACTTAAAAATTATGATAGCAT
TTCCGGAGTTAGTACTACTGGTGAAGGTATCAATATTGCTATGGTTTCTAAATGGGATAA
AGTAGATTTAGGATCTAATCAAATTCCTATTAACTTAAATGGATCGGAAACTAGACCAAC
TTATAATGATTCCAAAGAAATAGCTTTAATAGATGATGTTAAGTTGAAAGCAGATGCTAG
CAATGTTTATAATAAATCTGAAATTGATACTAAATTAGATACTAAAGCAGATTCAAATAC
AGTTTATAATAAAGAAGATTCTGACGCTAGATTTGTTAGTTTAACTGAGAATCAAAACAT
TCAAGGCAATAAAGTTATAGAAGGTATTTGGGAATTTAATGGAATATTGTCTAAACCAAA
ACAATTAGCAACTACTGAAATGTGGTAAATTATGCTAAAACATATGCTAACCAAAAAGT
CGGAGATTTGGCAAGTCTTAAAACAGAAGCTAAAGATACGACAGTGTCTGCTATCAACGA
ATTATTTGATAAGATTGAATCTGGTAATACAGACAGCAAACAACTAATACATAAAGAATA
CCTAGATAAAAATATTGCAGACAATGTAGCATATAATATTAGTAATACTCCATTAGTACC
TTACAATGATGTTAGCTCTTTAAACACAAAAAATATCGGTGTAAGAATATCTGCGACAAC
```

FIG. 16AI. Continuation of (CJLB-14 [organism=Campylobacter phage CJLB-14] complete genome)

```
TAATAACTCTAGTTATTCATCTGGTGATACAGTAGTAGTTAGTAATTTCAAGATAAAACT
TAAAGGAGATGATGAATACCTTAAACCTTATGGGGTTGAAGTTGTTGATAGAGAAAATAA
TAAAATAGGTTTAAATTTAATAGGAGATGATACAGTATATAATGATAATGATGCTTTATT
ATCTACAAGGCCTTCTGATTTCAACTCATCTAATGTAGATCTTTCTAGTGGTAGTAATGC
TGTAGCTGCAGTAAAAACAAATGGTGCATACGATTATAGTGGAGTATATGAGATTTGTAA
TCCTTTCAGAGAGTATAATAAAAAATATTGCGTATTTTTAAGTTCTGATGGATTAAAAAA
TCCTTACTATCAAGTTGATATAAGTAGCTCCAAACAAGTTGATAATATATCTTTTCAATT
ATTTGGAACTAGTGCTACAAATCCTTTTTTATATTCTAAAGACTGTAAAATTGAGTTATT
TGTAGAAAATACTGTTGTAAAAACCTTCAATGTTAAAGGAAGCTCTGAAAATAATAGTCC
TGTAAATATTAATATAGATTATAAAGATGGTATGTTCTTAATATCTGTTCTTGATTCTAT
AAATTATATAAATAATAGAATCAATAAAAATGCAGAGTTACTTACAGGGTTAGGGAAACC
CAATTTTTCACTAAACCCTAATAAAATAGGCTCTCTATACTCTGATACAACAAATAAAGC
TGTATATATGTATAGACAATACTTTTGGTGCTAATAAATGGGTGAATATAGTAACAGG
TGATGAAATTAAACCAAACCTTAGAAAAATAGAAATCACTTGTAATGTAAACTTAACAAG
TGGCCAATACGGTGGTTGTATGAGTGGTGTAAAACTAGGATTTGACAACGGGTATGCTTC
TACAAAACAAATCGTTAAAGGATTAAATAATGGTCAGATATTATGGTCATTAGACGGTTT
AGGTAATCTAGCTAGTTATTCTGAAGTAGGTTCTTTATCTCCTAGTGGTAATGATATCAA
AGGTGATGTTACTACTACTGGAATATATAACGACCCTTCATATCATTGAGTTACTAATAT
ATTCAAAGAGTATCTTGGAAATGCTGACCAGTGTTCATTATGGTCTGACGCTAGCACTAA
ACAATTAAAAATAACATTAATATCTGAAAAAGTCCCTAATAAAATTACTTATGTAGGTAA
CGGATATTATGGTCAGACTTCTGTATCTGATGTAAAAGCTATATGGTATTATGTAAATGA
TGACGGTATGAAAGTAGAAGAGTCTGTAGATAATGAACTTGAAGTTAGTGTTAATAGTTC
AGAAACAAACGATAGTTCTTATATATATGCGTTCAATATAAATTAGATATGTAAGACTGT
ATTAATGATAGTGCCAACTAAAGACTTTTTAAAAGATATTATTTGGAAACATCATCATTA
TTATTTTTTGATTCATTTTATTAAAGAAAACAGAGATATTTATATTGTCTTTATAATTAT
AAATAAAGTTCGATAAATAATTTATATCTAATAGATATATCATAAGAATAATTTAAATTT
AATTTAGTAGAACATTTTAATTTAGGTGTTTCTACAAATATGATCAAATGAGGTATTGAA
GCCGAGGATTCTTAATGGCTTTCTTTCATTTTAATACCCTAAGAAAATATACTGGAGCTT
TGATACATTTATTTTCTAATTTAGAAATACAAACTATTCAAAGTAATGGTAAACCATTGT
ATTCTATAGTTCCTATTCAGTATGCTAACAGGGAAAGATTTGATATTTATAGTCAATTAT
CTTATAATCAAATGTTTAATGGTAATACTCAAGTTTTACCTAGAGGTATACTCTTGTTTA
CTGGTATGAATGCTAATATCAATAGAGCAAAAAATAAATTTGCTAAGATATATAGAAAAT
CACAAATAATTAAAGGTGAAACTAAAAAATTAAATTATCAATTCAATTCAGTTCCTTATG
ATTTTACTTATCAAGTAATTATACAATGTCGTGGAATGAATGAAGCTAGTATGATATTAG
AACAAGTCGCTAGTTATTTTAATCCCAGTTATTGTTTAAGAATTAAAGAAGTAGATTTAC
CAGATTTTGGAGATACCTCTTGTATATTAGAATTAAACTCGACTAGTGTAGATCAAGAAT
CTATGGATGAATTAAGTACTAATATTGTAACTTGCACTTTTGATTTAACCTTAAGGGGTA
ATATATACCCAGCAATAAAAGACAACATTTAATAGAATTAGTTCAATTGTTTATGAGCA
CTGATTTGCCAGAATCTACTGAAGCTAATCCAGTAGTCACGAGAGTTTATTCTGAAGGTT
CTAAAGAAACTGAATCTGGTATCCAAACTTTTATAAATCAATACAAAGCGGTTATTAAGG
ATATAGAATTCAACCAAGATTATTTACTCTGTAAAATAGATTCTGAATGCGAGAAACTTA
TTAAATTTAAATTTAATTGGTGGGTAAATGACATCAAACAAGACAGTGAAATTGAAAAAT
TACATTATGCACCACGAGATGATGATATTGTAAAAGTTCAAGCATTTACTGATATTGTTG
AGAGTGATATCTTTGAAAAAGAATTCTATTCTGACGAACCAAGATATGATTTAATTATTA
ATGATTTAATTAGGGATGAAGAATTCTTAGAATGTGATTTTACTGACAGTAATCCATCAA
ATATTAAATATACATTTGAATGGTTTATAAACGGTGAAAAATTAGATTTAACACAACGAA
TTATTAAATATAAATCTAAAGTTAGCTTTGATTGTGAATGTATTATTAGAAGCTCTGATG
GTAGAGAAGCTAAATATTTTAAACATTTTCATAATAATGAAATAATTTTTAAAGATTCTT
TTAAAATAAAAGATTCTATGAAACTCGAGCTCAAAACAGATTTGAAATCCATAGCCATTG
GCTACAACGATTCAATGGGTTTCGATACTAATAATGATTCAAATGATGATTCAAATGATA
ATTAAGGTTTAGAATGGGTACTTTTTCATTTTCATTATCGGATATAAAGAAACAATTAGG
TCCTGGTTTAGGAGTTAGATCAAATGCTTACTTACTAGAAGTTGCTGTAGTAGGTGCTGT
TTCTAAAAAATTAGCAGTTCTTTGCCAAAGCACAGCATTACCTGAAAGAAATATTGGAAC
CACTGACATATTCTACAAAGGTAGAAAATATAAAATGCGTGGTGAAACAGACTTAAGTGG
TACTTACACTATTAATATAACTGATGATTCTGAAATGAAACTTAGAAGAATGTTCGATAG
CTGGATGAGAGAAGTAGATAATACCACACCTAAAGGGACTAATGCTTTAGCAGGCTTATT
TGGTGGTGCTATGGGTGACTTAATGGAGGTAGCTAATGGAACTTTGAAAGCGGTTAATGA
AATTAAATCTGCTTGGGAGTTTGATGGTGGAGTTTCTTGGCTTAAAAATATGATTATGGG
CAAGCCACTACCAGCAAATTATCAAACAACTGTAAACATTTGGCAATTAACTAAAGTCAA
AGAAAAACTATATGGGTATGCTTTGACTAATGCTTTTCCTATTGAAGTAGGTGCAGTAGA
AGTTTCTGATGAAAATGAAAATCAGTTATCTATGTTAGTGTAACTTTTGCATATTCAGA
TTTTGAACCTATTGAAGATAAAGGTGTAATTGGACAAATAGTTGATACTGTAATAGGCCA
AGAAGGTCAAGAAATTGTACAAGGTGTTGAAAATCTATTGGATTAAATATTCTTTAGATT
TAAAAATTTTTAAGTTTTAATATTATATAATATATTAAAAATTTAAATTTAAAAGATTTA
ACACTACAGTGTTAAATGTTAGCTCTACAAAAAACTGCTAAAATCACTAAAAATTTAAGA
ATATTTTAAGGATTAATATATTATAATTACATTGTAAAGGAGATCAAATGGATATTTCAA
```

FIG. 16AJ. Continuation of (CJLB-14 [organism=Campylobacter phage CJLB-14] complete genome)

```
TTAAAGAAATACAACCAAGTCCTGAACAATTGAAGCAATACAAAGCTCAAAGAATAACAC
AAAGAAAACGCATCATAAAAGGTGGGTTTGAGCACGTTCTCGTAACTTCGGATTCTGACT
TAGATGGTATTCATATAGGCGCTTTATTGATGGGGTTTATAGAAAGATTTAGGCCGGAAT
ACAAAGGTAGATTTGGTCGGTTTAACACGCCTGTTAAAATGGTTTTAAAAGGTGAAACTC
CTATTAAATGGACTTATGACATCACAGAAGAGTTACCGGTTAAATCCGGTGAAAATGCGA
AGTATTTCAAAGGTTTAGGATCTTGGCAAAAAGAATTATTAGATTTTGTTATTAAGAAGG
ATGGGTTAGAAAATATGATCGATGTCTATGATTTCGATAATATTAATATAATTAATGACT
TCTTAGGCTCTGAAGAGAGTGATAAAAGAAAGAATTATATTAGAAATCATTCTTTTAGTA
TAGCAAGTCTGTAATTATTTGATTGTTTTACATTTTGGTGATTTAATTTGATTCTAAGTT
TTAAACTTTAGTTTATAATTTAAAGTTTATATTATAATATAGAATTAATATTAAATTAAG
TTTTTAATTTTTTATAATTGGTTTTAATATAATAGATTAAAACTGATTAATTTTTTAAA
GGATATTTATGGATATTAATTTTGATTGGAATTCAATGAATGCGGGAGCTAACCCATTCG
AATCTAAAAGTTATGAAAGTGATACTCGTTTTTATACCTTAGCAAAAGATGAAAATGGTA
ATGGTGCAGCTTTAATCAGATTCTTACCTAGCGAAGTTCACGAAAATGGCTCAATGAGTA
CCATTATGAAAGTATTCAAATACAATGTTAGATCTAAAACTTCTAAAAGATTTATAGCTG
AGTGGAGTCCGAGTACAATTGGTTTACCTGACCCAATTCAAGAAAGTGGGCGTCTCTTT
GGAATGCTGGCAAACAAGATGAAGCAAGAAGATATGCAAGGTCTACAAGATACATTGCTA
ATATTAAAGTTATTAAAGATCCAAAAAACCCAGCAAATGAAGGTAAAATTTTCTTACTTG
ATATGTCACAAACACTTGGTGAGAAAATTAAATCTATTTTAACGCCAAATGAACAAGAAT
TAGCACTAGGTGCTGTTGCTAAAAATCTTTTTGACCCTATAAAAGGATTTAACTTTAAAT
TGATTGCAACTAAAGGGGCCAATGGGTTTATAGAATATTCAAAAAGTGATGCTGAAGCAA
ATCCAAGTGCAATTTATAATAGTGTAGAAGAAGCAGTAGCAGATATTAAAAATAATGCTT
ATAAATTGTCAGATTGGCAAAAACCAGAAAGCTACAAATCTTACGAAGCATTAAAAGAAT
TACTAGATGGTTTGGATACACCAGTAGAATCTAACAATTTAGATTCAATGGTTCAAACAG
CGCCAGTAACAAGTTTACTGAACCGGAAGCACCAACAGCACCAGCACATCATCGG
CAGCAACCCCAAAAACAGAAGCACCAAAAGCTCCAAGTGCTAACCAAGCAGATAATCTTG
ATGATTTGATGGCCGACTTATTAAAATAACTTATAGAAGCTCTGACGAGCTTCTTCTCAA
GGAAGAATTATGATTGATATCGAAAACTTTAAACCACTTCAAGATTTTGTTCTAATAAAA
ACAGAACCCGTTAAATTTGAAACTGAATCTGGCATCATTACAAAAATACAAAAATCAAAT
CTTTACGATCGACCAACCAAAGGTGTTGTAATTAAACAAGGGCCTAAATGTCAATATGAT
TTGGTTAATAAAACAGTTCAATGGGATATCACAAAAGGTCAAGATATTGAAGAAAATTAT
ATTCTTTTGACTGAGGATTCAATACTAGGAATTATAGAGTAAATGAGAGCTCAGCTTTTT
GAATTGCACCAAGAACTCAACAATATCAAGGATAATATAATCTTGTTACATTGTGATATG
TTTCCTTATGCAGGAAAGAACATCATAAATTTACATATACAAGAACAAACTATGATTAAT
GTAGCAGCTGGTATTGCATATACTGGCAAACCAGTTATAATCTATGGAGTTCTTGGATTT
GTTTTTCTTAAAGCTCTGGAGCAAATTAAGTTTAGTATATTAGATTTTAGTGCGAAATAT
GCTCCAATAATTATGTGTAATGCTGGATATACTAGGTGTTATGAAATGTATGGCAAAGGC
CACATTTTCAAAGAAGAATTAGATCTTTGTAAAGTTTATAATATTGAATATTTCAAACCT
AATAAAGAAAATTTTAAAGGTTTGATAAAAGATTGTTTAAAAACAAATGGTTTCAAATAT
ATTTTGATATATTAAACATAGGTGAAATATAATAATTTAAAACTCAGGAATTTTAATGAA
AGAATTAGTAGCATCGTGGCTAGCACGCAGATTTACAGATAATGACTTTAGAAGTGTTCT
CAAAAATGTCGTTCTAAAAGATGGTATAGGTAAAGGCACCAAACGCCCAGATAATGCTAC
CAATTTTGTGAATACAAAAACTGGTGAATTAATAGAACCTACTAAAATTCGTGAATTTAT
CAAAGCTATGAATGTGGAGGTTCAAACTCGTAATAATTTTTATAAAGGTAATACCGCTTA
TCAAAATGTTTCACAAGTTCCCCAAAGTGGTATTTTACAGGGGTTCTGTGGTTTCAAACAC
ACCTTATACTGCTATGCAGGTTGTTTTAGAATCATTTGTAGGTGATGGTATTAGAAATTT
TGGAACCGCAGTTCAAGCAGATTTTAATCAAGTTAAATTAAATCAAAATCTTTATTTTT
AGCGCACGGTAATTATTTTGCAAGATTAGAATTTACAGCAAGTGCGATTGCTAATATTTC
TGGTGGTGTAAGATTAACTTATAATCAGTCACAACTTTGGTATGATCAAGGTAGATCAGA
AGTTAATATTAATTATGATGCTTTAACAAAAAATATTAGCTCTTGAAAATTTTACAGATGT
AGAAATTGGTATAGCAGATTTTAGCTCTAAAAAAATTAAATGGTTTAATAACGTTAAACT
TAAAGCAAGCACATTAAAATTCACAGTTTCGCAAAATACAGAAAATGCTAATAAAACAGT
GCAAAAACGTATAGTTTCTGGGTATTTAGATTTTACAATTGATCAAACTATTGAGGATAC
AATATCTGAGAATTAAGAGGTGCTTTGATCACAGCTGCTAGATTTAATAAATTCAAACA
ATTATTAAATAAAGCTGAAGTTGCTTGTTATGTGATTGTAATTATTGTACTTGTGATTG
TAATTATTGTACTTGTGATTGTAATTATTGTACTTGTAATTGTAATTATTGTACTTGTGA
TTGTAATTATTGTACTTGTGATTGTAATTATTGTACTTGTAATAATAAAGAATACAC
TGATAGTGTTAATTATTGGAATGGTGTTGTTTGTACTTGTAATGCGAATATTACTTGCCA
AACTCAAGGTCCTGGATATACACCAGTTTATGAAAACAGATATATGACCGAGTGTTCTTG
TCAAGGTGATAGAAGTGTTCCACAATACAACCAATACGGTCAAATATATGGTTATGCGTG
TAGATGTAATGCTAACTGGATTAATTCTGTTAGACAACACGCTACTGTAACTCAAGTATG
TTCTTGTAACGTTGATAAACAGTGGACTAAAAATATTACAGGTAAACCAATTTGGGATAA
AAAATCTACGGGCCAAATTGATAATATTGTCAACAATAACACTTCAAATTCTCAAACAAG
TACTACTGTAAGAGTTTGTGTTTGTGATACAAACGTCACAGTACGCCACAATGTGCTAC
AAATAGAACAATGGCTTATGTTGATGGATCAACTGGAAGTCAAGGCGGTTACAGATGTGT
TTGCGATATCAACACAAATAGACAAATTGCTTGTTCTGCTAATAGAGAATATAAATATGT
```

FIG. 16AK. Continuation of (CJLB-14 [organism=Campylobacter phage CJLB-14] complete genome)

```
CACTGACTATACTCAATTTCAAAACAAACAATACAATTAAAACTCAATTAACATATAATC
AGCTTGAAGTTCTTAAAAAGAGCTTCAATGCTTTTTAAAAATTTAAGATCAAAGATTTAA
AACTAAAGTTTAAATTTTAAAATATTTAAGACGCTTTTAAGTCAAAATATATTATAATTA
TTTTATCAAAGCTGTATATAAAGGAGATATAATGAATTATTTAGAACTTAAAAATATGGC
AGAGAATTTAAAAGATTCTAATTATAGGTCAACAAAATTAAATGATTTTAAATTCTATAC
TTATATATTGTCAGATTATAAAAACTTCAAAGAAAATAATACTTTTTTCATAAGAGGTTT
AATGATAGATTCTAAATCTATATTAAACAAAGATACTTTAGCACCTGGTATATCGATACC
AATACCAAAATTCTTTAATATTAATGAAAATGAAGATTGGATATTACCAGATTCTACAAA
TCTTGAAGATTTCACTATAGTGACAAAATACGATGGTTCTTTAATGATACCTTATGAATA
TGATGGTATAAAATTTAGAACTAAAATGTCTATTGACAACGATCAAACTAAATTAGCTAA
TAAGTATATCAAAAATAATCCAGATATATTAGATCTAATAAAAAATAATCCAGGTACCCA
GTACTTTTTCGAGTTGATTTCACCTTTAAATAGAATAGTAGTAGATTATAATAAAACTGA
ATTAAAATTAATAGCTGAATTAGATCTTAGAACATTAGAATTTAAAATTCACGAAACTAA
CGAGTTTAATTTTAAAGATTTAAATATTAGGACTCTAAAAGATCTTAAAGATTATATAAA
CACCATATCTAATTACGAAGGTGTTATATTACAGCATAAGTAACTAAAAAGTCTACAA
GTTAAAAACACAAGAATATTTAGACTTACATAATACTGTAACTAATTTAGATTTAAAAGT
GATATACAAAATGATATTAGAAGAAACTATAGATGATGTGTTACCAAAATTATCGCCAGA
AGCTGTGGCTTATGTTGATTCTGTATCTAATTCAGTAAAAGTTAAGTTAAATGAAATATT
AGATTCTATAGATTCTAATTATATTAAGGCTAAAGATCTTGAAACTCCAGCTTTATATAT
AAAAGATTTGAATATAGATCCTATAGCCAAAGATTGTTTATTTAAATTATGTAGAAATAA
ACTTAATTTAGACAACGTCTTAGATCAAGTTAAAAAATCTATGTTAAAATATAACAAATT
GCGAGATATTAAGGTTTTTTTAAATGAATTCATTTATATATTATATTGCAGTTTACGGCG
GGATAAGTGTGATTTTGAGTGTTTTTGCAGTATATATTTCTCATAAGTTTTAAAGGTATA
AAATGAACACAATTAAACTAACTTGGAATGATGTTCACCAAGCTTTGCATAATCTTACAA
ATGAAGTAGATCTTAAAAATTTTGATTGTATAATAACTCCCAATAGAGGTGGATTAATAA
TAACTAGTATGTTGCAATACACCCAGGGTGTTAAATTACCTGTTTATGTAATTAATAATT
CTGATGTAATCAACATTCAAAATCATAAAAAATTTTGTTTTTAGATGATATTAATGATAC
AAGTAAAACAATATTTAAAATACAAAAAGTTTTTAATGGTCTCATAACATTTAAAACATT
ATTTGAAAGATATAATAGTCCATTTAAAACTGAGACTATCAATATCATCTTGAATGATGC
CTGGCTAATTTTTCCTTGGGATGTTGAACCAGAAGTTTTAAATCTAAGAAAGTGAGTAAT
TAATATGCTAGTACCAAAAATAATCAGAAATTCAAAAGTTTATAGATTTATAAAAAATAT
CATTAAATTCAGAAATGAATTAACAATTTGGGGACCTTATGAGCCAATATTTGATTTAAA
ATTGATTTATAAAATGCTTAAAATCAAAAGAGAATATTGGCTTGATGATTGTGGTGGTGC
AGCTTATGAAGGTATGGAAAAAGAATTAGATACTTTAAATAGACTCTTAAATGAGTTAGA
CTTAGTATTTAAATATTCACGTGCTGGCGACGACGAAACTGCTATGATCCATTTTGACAT
TTTTATGGAAATTTATAAGAAAAATGCTTTTAAATTGTGGTGTTGATACAAAATAGCGTG
TAGAATCTAGAATCTAAAATACTGAAATATTTAAGTTATATTTAATCATAAATACGATAT
AATATATCTAAAGGAGAATTATGGAATATTTACCAAAAACTCAAGGACCTAAAAAACTTT
ATAATTTTGATATTAATATGACTCAAGCGTGTACACTAAGATGTACATACTGTATTCAAG
ATTTTAATAAACAAAAATTTGAAAAATTATCACCAGAACTTACTAAAAAAATGATAGAAA
AGTTTGATTTTCTGTTGAATTCAGTGGAATTCAATAAACATTATGATGGTATTAGAATTT
CATTCTGGGGTGGGGAACCCACAACTAACCTAGAAGGTGTTAAAGAGTTTGTAGAATACT
ATAGACACAACCCAAAAGTTTGTTTCTTTATGTATTCAAATGGTTATAAATACAACCACG
TTTTTGATTACTTAGAAACATTTAAGTATATGCCAAATGTGGGTAGTGAACCAAAATTCT
TGACTCAAATATCTTATGATGGAATGGCAAGTCACGATTCAGATAGACTTAATTTGCAAG
GTAAAGGTTCAGCACAACAAGTTAAAGAAACTGTTTTTGAACTAGCAAAAAGAAATATAC
CTTTTATTGTACATCCTACGATTGCAGCCAAGAATTTCGATAAGATTGCTATTAATTATT
TCGAATTTAAAAGAATGTCCGATGTCTTAGGTATTGAACTTAATTATAACCCTACGATAG
ATTATATGTCTAAATATGATTTTACAAAAGAACAATTAGAAGCATTAACAAATACTTTAA
AAGAAGAATTCTTAAAAATACGTGATGCTGAAGTTGAGTTCTTTAAAAGAAAGGATATT
TTAATTTTGGTTGGATGAATCCAAATAGAAGTATTTGTACAGCAGGTGATGGCTATTCTG
GTATTGAATTGGATGGTAAAATGTATGCTTGTCACGGTGTTTTTAGTGAAGAATATAAAC
CAAATAATGTTTAAATGATATTAATTTTGAGAATGTAAAATTTACTGAAACATTGATTA
AGAGCTCACAAGATCATAGAAAAATATTAAATGAAAATATGCCCAAAGCTTGCCAAGAAT
GTTTTACACATTATTGTTTAAATGCAATTCTACAAAATTTGGTATTTCTAATAAAGAAA
CCTACGCAGAAAGATGGACTGATTATAGTTGCCAACCTGGTTTATGTTATATGTTTAAAT
TCATAGGTAAATATAGAATAGCTTTGATGAAATATATTCAAGCTTCTTAGAATTCTAAAA
TAGTTCTAAATTGACACTATAGAGCTAGAAGTTAACACTAAAGTGTTAACACTAATAGAA
GTTAACACTAAAGTGTTAGATGCTTAGATCCAAAATAAATATACAAAAAGTAGGATTTAT
TTTGAGTATAATAAAATCAACTGCTAGGAGTATTAGAGGGTACTTATAGAGCAGGTAAAAA
TGCAGTTAATAGTGTTAATTCTGCTTATAATAGTGCTGTTAGTGGTATAAACAAAGTAAA
TTCTGCTTTAGATCCTATGAATACAGTTAGAAGTGCTACTCAAAGACTCAATAACTGGAT
GGATTCGGATTCTAAAGTATCTAAGACAACTCAAAAAAATAATGATTCAATTGTTAGTGA
ATTAAACAACGTAGCCAATGAAGTTGTTAGTGCAGCCAAAGCTTTAGATCCTATGAATGC
TAGAAAATTAACAGAAATTTCAGAATCTCTTAAAAATATTTCAAAACAAATCTCGGATAT
TAAAAAAGGATTAATAGATAATCAAGATACAGAAATAAGACACCAAGGTTTTGATAAAAA
```

FIG. 16AL. Continuation of (CJLB-14 [organism=Campylobacter phage CJLB-14] complete genome)

```
CGTTCAAAATGTTTCAGAATCTAAAGTAAATGTACCTCAGAATAAAAGTTTTTTTGATAA
ACTTTTAGGTTGGTTAGGAGGTTTATTAGGTATATCGGCAGGTGCTTTATTACCATTATT
GGGATCATTAGGAAGTTTTTTAACAAAGCCTTTAGATTTCATTTTAGATCTATTAAAAGG
TGGTATTAATAAATTATGGACTTTATTTGAGCCATTATTAGGCCCTATTATAGACCCTTT
AAAAAATGGATTTGAATTCTTAAAAAATAAATGGAACTCATTAGTAGATTTTATCAATAA
AAAAATTAATATTGGTGATAAATGGAAAATCTCAGATAATGATAATCCAAAAAATCCAAA
ATCACCAAAAGTAAGTTCATCTAATCCAGCTAAAGAACAATCTTGGATGTCTAAGAAATG
GGATTCTTTTAAAGGTGCTATGCAAAATGGATATGATTGGGCTTCACAAAAGTAGATGA
TTTAAAATCATATGCTAGTAAGAAATATCAAGATATTAAAAATTCTAAAGTAGGTAAAAT
TATATCTGCAGGATATGATAAATTAAAAGCAGCACAAAAATATATTGTAGAAAAAGCTAT
TGAAGGATTTGATGCTGTTAAAAATATGGTAAGCTCTGCTTGGGATTCAGCAGTTAAAGC
AGCACAAAAAGGCTTTAATATGCTTAAAAAGTTTGCTTTAGCTCCTATGGAGAAATTTGT
TAGTTCAGTAGGTAAGAAACTATTTGGAAGTTCTAAGTTATTTTCAGTTCTACCTAGTAT
ACTTGGAAATCTTGAAAAAATAGGAGCAAGATTAGCTGCTAGTGGTGCTAAAATAGCTTC
AAAAGCTTTACCAGGTGTTGGTTTTGCTGTAGGTATATACCAAGCTTGGGATTTCTTTAC
TCGTGGTAGATGGGTATTGGGTTCAATAGCAGCACTTAGTGCTTGTATTTCATTATTACC
AGGTATTGGTGGGATCATATCTATGTGTTTAGACTTAGGTTTATTTGCTACTGATATTAT
AACAAGTCCAGATGATGTAGATAATCTTAATAAAGAACAAATGATTTAGTAAATACAGC
AAATAAAATGGTTCAAAATAATGATACTGGAGGTATTTTAGAACCAAGTCAAGTAGAAAA
AGATAAAGCACAATCTGGAGTTCAAGATTCAAGTTCTAATTCAAGTTCAAGTAATAAAGG
ATTAAATGCTAAAGTACTTGATGGTAAATCTGCTAACGATTTTGCTGCTTCGTATACACC
ACATAAAGTGGATTCTAACGGAACCGTTATAGCTGCTAAAACAGGTTCTATATATAAAGG
TTTGACCTGGGTAGAATCTGAAAAATATGATGCTGAAAAGCAAGCTTATTTTAAGAAACG
TGAAGAAAAAGAAGCACAATTAGATGCGCTTTTTGAACAAGGTCAAAAAGCTATGAATTC
TGGAGATACTGAAACCTTTAATAAATTAGTTACACAAAGAAATAAATTATCTGATGAATT
ATCTAAAATGAGCTTAGATTCTATCGATTCTAAATATCAAGCTATTGGACAAGCAAGAAT
TAAAAAATTGCAAAGCCAAGGAGCTAATGCAGATTTATCGGTATTTAGAACTAATGGAGA
TTCAAGTACTAGTTCAGGGGGAACTGATACAAAACCAGATTCTACAAATGCTAGTGCTAG
TGTAGCTTCGCAAGCTTCTGGTTCAATCTCTCCGGCGCAAGTTCAAGGAGCTCAATCCAC
AGAAGCCCAAGGCTCGAGTTCAGGAGGATCTCCAGGAGCAAGAGCTGCAGCAGAATTCAG
TAAAAAATATAACTTAGGAACTAGAGCAACAGGCGCTTGTGCCAAGTATGTTAGATCTTA
TTTGATGGCAGCAGGATATCCATTATCTGGTTGGCCAGTAGCAGCTGCAGATTATATAAA
TTTCTTACCTAAATATGGTTTTACACCAGTTCAAGGTAGAGCTTCACAAATAAGCCCAGA
AGTAGGTGACATTTCAATAACCCAGAGATTTGGAAATCACAAATATGGGCATATTGCTAT
TTGGAATGGTTCTAATTGGGTTTCAGATTTTAAACAAAACTCAGTTTCAATTTATAGAGA
CGTAAATGCTTTCGGTGGGCCGGATGCTAATATAACTATTCTAAGAGATACTTCAGGTCA
AAATCCATCTCAAGAACTTGTAAATCAACAATTATCCAATATGAATAGTTCTTTTAAAGT
TGCATTAGGAGGTGGAGGTGCTAAAGGTGCTGTTTATAGTTTGGATTCTGGAGTTTCAAA
TGTTGTTACAAATACAGCAGGCGCTGCAGCTAGTGTTATAAGTTCTGGTGTAAGTAGTAT
CCAATCTTTTGCTAATGCTAATTCTATTACAACCAGAAAATCTTTAACTCAAATGTATAC
AGAATCTGGATTAAGTACTAGTTTTGGGTCAAGTTCAGTCCCACAAGCTGCTAGCCCAGC
TGCAAATTCAACACCAAAAGAAACAAAAGCAGATATTAAGCCAGCTTCAAAACCAGTTCC
TAAAGCTGCTAGCTATGGTACACCACACAGAGGTCAATATGATGCAGAAACAATGGAAGA
CTTCAACAACTTAGGAGATAACTTTAGTAAATCCAAATCACAATTTCTTTACCTGGAGA
TTCGAAATCTAACGTTCAAACTAACAATGCTGGCTCAGTAGCACCAGTAACTCCTGTAGT
TAATATAAAGAATAATTCATCTCCAAGTGATTATTCTTGGGCTTCTAAAAACAGTTTTAA
AATTGCTAGAATGTTTGGGTTAGATGGCATCAGCGATTACGAAATACTTAATGAAGGTTC
AGAATCTGACTTTTTACAATCTTATGGTATGTCTAAAAGACAAGCAATTCAATCAGCAGG
GTTAAACAATACAGTACAAACCAAAGTTGCTAGTAATGTTAAAACAAAAGATGTGATACC
AGCTGTCAATAAAACCCAATAAATAATACCAATATACAGACTAAAACAAAAGAAACTTC
TAATAAAGATTTGACTGATTCTTTTGTTTTGAGCTAAGGTTCATTAAATGCAAAGGATTA
AATTTTGGGATTATTTGGTTCTGTCAGTAGTGTTATTTCAGGTGTTGATTTACCAAAAGC
TACGAAAATTTTCTCGGCCAACAATGGTGCTGAAATTCTAAAATTTACCAAATCTTTAGA
ATCTGATAATTTTAAACATAAACAAATAATATTAACTGTTTATGACCCAAATGATTTCTA
TAAAAAAGTCAAAGATGCTATTGGTCAAAAAATGTCAAGCCTGATGACAGCAGGAACTTC
AGCATTTTCTGGTGATGGGTATGATTCTTCAGATGCTAGCCAAGCTCTAAAAGATGCTGG
TCAAGACATTGTAGATATGTCAGCTGTCAATATATTATATACACATTTACCATTAAT
GAATGCTTTTCAGGAACAAAATTCCCATAATTATTCTGAAGATACTGGTATTTTAGGTTC
TATGTCAAATGCTGCTAATGAATTATCAAGTACAGCTAGTTCTGGCATAATTGAAGCTTA
TGGTAGATTTGGAGATTTGGTGGAAACACAGATAATATGGCATTTGCTCCGCAACTACC
ACAAGTAGATCCATTAAAATGGCAAACTTTAAAGGTTCCAACTTAAGAACATTTCAATT
TACTTTTAAAATATCTCCTAGAAATATAGATGAAGCTTCTAATATGATGAGAATATTTG
GTTATTAAAAAGAAGTTCATACCCTAAAAAGAAGCTGGTGGTGTCTTATTGATACCGCC
TGCAAGAATAGGTGTCCAATTTTCAAACCCACTGCTACATAAGTTGATAGCTCCTGGTAT
TTGTGTAATAGATGGTGTTTCTATGGTTTATGAAAACGGTGATGATATTGCTGTAACATT
AGACGGAGTTCCAAAGAAAATAGAGTTTACATTATCATTAAAAGAATTCCGTCAAAAATA
```

FIG. 16AM. Continuation of (CJLB-14 [organism=Campylobacter phage CJLB-14] complete genome)

```
CCAGGATGATTGGAATTTTGAAAATGCTAGTCTATAGGAGTTAGAATGTATATTAGTAAG
CAACTTACAAATTATTTAGATAATTATTCGTTCAGTGAAGCTAATAAGACCGAAGCAGAA
GTTTGTAATGTTAGAGATTACAGGTCTATGGATTATAGCACTATAACAAATATATTAAT
GATTCTAATACTATTAATGTTAAAATAAATGCAAATGATTTCATTGAAAGTGTTTCTAAT
AGATTGTATAATGATCCTAATTTATGGGATTTATTAATGCTTATTAATAATAAAGATGCC
TTGAGTGATATGCCTTATGATAATGATAGAATAGCAGATATGGCTGACGAATTGATAGCC
AATTATTTTAATAATCCTGAGAAACCATACCAAGGTAATGTTACTGAACAATTAATAACC
GAATACAGGGAATATTTGATAGATTTATTGACACAAAAGAATTATCAAATATGATTATA
AAAGCTTAGACCCTGCTTATTTGGGTGACTTCTTAAGACTTTTTAAGTACAAGTAATAC
ACTATTAAAAAGCCAAGCATTTTTTATACTTTTTAATATTGCTTTAAGTTTTAAGCATAT
GCTAGGATATAATACTATAGTATATACTACTAAAAAGCCAAGCATTTTTTATACTTTTTA
ATATTGCTTTAAGTTTTAAGCATATGCTAGGATATAATACTATAGTATATACTATGAAAT
ATCCAAGCATTTTTTATACTTTTTAATATTGCTTTAAGTTTTAAGCATATGCTAGGATAT
ATACTATTGTTATACACTACTAAAAAGCCAAGCATTTTTTATACTTTTTAATATTGCTTT
AAGTTTTAAGCATATGATAGGATATATAGCATTGTTATACACTACTAAAAAGCCAAGCAT
TTTTTATACTTTTTAATATTGCTTTAAGTTTTAAAATCTAAACTAAAATTTTGGTTTTAA
AAACCCGAAAAAACTTTTTTAAAATTTTTTAAAAAGCTTTATATTATAATATATCATATT
AAAGAGTAAAAATTTTTTAAAAAAATTTTCAAGGACTTGGAATCTCACATTAAAATACA
AAACAAATCTTAAAGCAATATTAAAAAGTATAAAAAATGCTTGGCTTTTTAGTAGTGTAT
ACTATAGTATTATATCCTAGTATATGCTTAAAACTTAAAGCAAAGCTTAAACTAATATTA
AAAAGTATAAAAAATGCTTGGCTTTTTTAGTAGTGTATACTATAGTATTATATCCTAGTA
TATGCTTAAAACTTAAAGCAAAGCTTAAACTAATATTAAAAAGTATAAAAAATGCTTGGC
TTTTTTAATAGTATATAACAATGCTATATATCCTATCATATGCTTAAAACTTAAAGCAAA
GCTTAAACTAATATTAAAAAGTATAAAAAATGCTTGGCTTTTTAGTAGTGTATAACAATG
CTATATATCCTATCATATGCTTAAAACTTAAAGCAATATTAAAAAGTATAAAAAATGCTT
GGCTTTTTAGTAGTGTATAACTATAGTATATATCCTAGTATATGCTTAAAACTTAAAGCA
AAGCTTAAACTAATATTAAAAAGTATAAAAAATGCTTGGCTTTTTTAATAGTATATAACA
ATGCTATATATCCTAGCATATGCTTAAAACTTAAAGCAAAGCTTAAACTAATATTAAAAA
GTATAAAAAATGCTTGGCTTTTTAATAGTATATAACTATAGTATTATATCCTAGTATAT
GCTTAAAACTTAAAGCAAAGCTTAAACTAATATTAAAAAGTATAAAAAATGCTTGGCTTT
TTTAATAGTATATAACTATAGTATTATATCCTAGTATATGCTTAAAACTTAAAGCAAAGC
TTAAACTAATATTAAAAAGTATAAAAAATGCTTGGCTTTTTTAATAGTATATAACTATAG
TATTATATCCTAGTATATGCTTAAAACTTAAAGCAAAGCTTAAACTAATATTAAAAAGTA
TAAAAAATGCTTGGCTTTTTAGTAGTGTATACTATAGTATTATATCCTAGTATATGCTTA
AAACTTAAAGCAAAGCTTAAACTAATATTAAAAAGTATAAAAAATGCTTGGCTTTTTTAA
TAGTATATAACAATGCTATATATCCTATCATATGCTTAAAACTTAAAGCAAAGCTTAAAC
TAATATTAAAAAGTATAAAAAATGCTTGGCTTTTTAATAGTATATAACAATGCTATATAT
CCTATCATATGCTTAAAACTTAAAGCAAAGCTTAAACTAATATTAAAAAGTATAAAAAAT
GCTTGGCTTTTTAATAGTATATAACAATGCTATATATCCTAGCATATGCTTAAAACTTAA
AGCAAAGCTTAAACTAATATTAAAAAGTATAAAAAATGCTTGGCTTTTTAATAGTGTATA
ACAATAGTATTATATCCTAGTATATGCTTAAAACTTAAAGCAAAGCTTAAACTAATATTA
AAAGTATAAAAAATGCTTGGCTTTTTAATAGTATATAACTATAGTATTATATCCTAGT
ATATGCTTAAAACTTAAAGCAAAGCTTAAACTAATATTAAAAAGTATAAAAAATGCTTGG
CTTTTTAATAGTATATAACAATACTATATATCCTAGTATATGCTTAAAACTTAAAGCAA
AGCTTAAACTAATATTAAAAAGTATAAAAAATGCTTGGATTTTTCATAGTATATACTATA
GTATTATATCCTAGCATATGCTTAAAACTTAAAGCAATATTAAAAGTATAAAAAATGCT
TGGCTTTTAGTAGTATATAACAATGACTACATTTCAGTTAAAATTCAGTTATATTTTAA
TATAATACCGTAAGTATAAAAAAATAAATACTTGAATATAATATAACAAGCAAGGAAATA
TATGACTAGTAATAGCTATTCACAATCTAGTAATTATAAAATATTTTTACCTTTTCTAGG
CGATGAATGGATATATGCTCAAAATATAGCATTACCGGGGTTTAGTCTGAACCCAAGTCA
AGCCAACTTCGGCGGTAAAACTATTTATGTTGGTGGTGACCACATAGACTATGACCCAGT
AACTGTAGGTTTCCTTGTGGGAGAAGATTTCAAAATATATACAAAATTAATCAAATATAT
TTTCGATAGAGTTCACCCAAATAATGGTAATATCGAACCATTAAAAGAATTTACTTGTGG
TGTGGAAATAACCGACAATAAAGGAGAATCGTTAGTCAGTATGACTATGTATGGTTGTAA
AATCACAAACTTAGGTGCTTTACAACTAATATCGAATGCTGATGATGCTGAACAAACTTT
TGATCTTACCTTTAATTTCGATAATTTCGAATTGATCGATTTTGAATCTATTAAATT
AAAAGAAGCTGTTATAAAATCATAAAGGGTTCTAATGGAACAAGTAATAGAAGCAGAAAT
CGTTGAGTTCGATTCTGCGAAAGCTAAAATCAATAAAACTCAATTAAATCCAGATGAAAT
AATTCAATTGGATTTAGTAGTAGACGATTATAATAAATTAAGACAAATTATTTTAGCTAA
TGTAGCACAATTAAAAGTTATGAGTGACAACCTAGTTCAAGAAATGGAAATTGAAGGATA
TAACCCAGACTTAGTAACTGCTTATAGTAAACTAATTGAAACTTCAAACAAGTCTTTAAA
AATTCTAACTGATTCTTATAAAGGAATATCCGATATTTTAATTAATTATTAATAAAATTAA
TGCATTACACCCAAGTACAGAAGTTAAAGAAGATTTTGAAGTTATTTCAACTGCAGATGT
TATTAAAAGAATCCGAGATTCGAAACAGGATTAAATATTGAAAACAAAGTATTTCAGATA
GGACAAATCAAATGCCTTAAGTGTAAATGAATTTATTAAGAAACCAAATATTTTAAAC
CTTTTCTTAATAAATTAGAAACAAATGATTTTTTATTAGAAGGAGATCTTGGTGTTTTA
```

FIG. 16AN. Continuation of (CJLB-14 [organism=Campylobacter phage CJLB-14] complete genome)

```
GTTTTGATTTAAAAGACCCTACAAATATTAGATTGTTTGAATTAATTAAAAGTATGAATA
TTGATGCTGTAGAACTTTTAATATATGACAAAGCTACTAAAAAATATAAAAACTTTAAAG
GTTCAATTAATCGAAAGAAAGGTGAAATACCTTTTAGTAAAATTCATAAATCTAATGTAT
CTGGTTTAACATTAAAAGGTCAAAAAAGTGATAACAAAGACGACTTAGCAGAGTGTGGTG
TTGTATACTATTTAGATATGTTTTTAAATACTAAATTAACCGATATTAAATTCTATAATG
AAACTCAAGTTAAAAATACTAGGACTAAGACGCCATTAGATTCTGTTAAAACATTTTTAT
TTGAAAATCCAGATTGGGATAAAGCTTGTAAAGATGCATCTAAATGTATTCTAAATGAAA
TTATTTTAAAACAAAACCTTAGAAATTATGAATTTCACCACAAAACTGATGTTTTTAATG
ATCTTAAAAAGCAAGGTAAACAATTAACTAAATTAGCAGAGGATAAATGGAATCCTGGAG
ATTTCTTTTTGGTTAAACCTACATATAAAATCAAATCATACAAAACTTATCAAGAACTTA
ACAAGAAATTAATGATTTTGATAATATAATACCTATAAGTCTTAAGAAATCTGCTAAAG
AAGCTTTAGGTGGTTCCTATGCTTTGAATAATTTATCAGGTAATTATGGTTTACCAAATT
TTAAAAGTATTAAATATAAATCATTCGATAATAATTTTTTTAATTTTTTTAAAGAATGTA
TGGTTGAATTAAAGAAGCATAAAAATTCAGATATCATTAGAGTTAGAACTAATAACATTA
ACTTAGCTGACATTTATGATGAAATTGCCAGCAATGCTAAGCTGCTAATTTTTTCGAAG
GGTTTCCACCGAGTTTAGCATTTATATCTATGAGTTCAAAATATTTTAATGATATTATAT
TTGAAGTTGTTTGTAATTGTTTAAGTAGATCTCTATTAAGTTCTAATTTTTATAAAGTTT
CGGGAAATCATTTAGAAGTATTTGATACATTGCCTTCAGATTTAAAAATCGAATACTGTG
TTGTCTCCTGTGATGGTAATGCTGATATCAAATGGAATATTAAAATAGACGGTAAATTAT
GGAAATTGCAATTAAGATCTAAAGGTTCTTTACCACAATTTATGTTGGTGCCTCAACCGG
TAAGTGCTTCAAGTCAAGACAAAAAAATTCAAGCTATTAATGTTTAAAAATCTACACTCG
AGTGTTAGATCTAGCACTATATTTAGTATCCAAATAAGTGAATAAATACATAAAAAGGAT
CATAATGGCAAAATTAATCTTACAAAGAATACAAGAATGTACCAATGTTAGAAAACCAAG
TAAAGAAAAATCGAAGGATCTACATTATCTGATTTAATATTGTATGATGATAATGGTCA
AATTCTTTGGAAAGGTGCTGCTTGTGAAAATGCTGGACCAAGCACAGAAGAATCAGGAAC
TGATAAACGTATAACAGCAGGTTCTTATAAATTAGAATGGTGTGCTAGTTCTAAAAATGT
TGGATTAGCTAAAAAATACCCACAATGGTACAATAAAGATCGGTCAACCATAGCAATTTG
GGTTAAAAGACCAAACGATGCTAATTTTAACAATAGATTAATCAGAATACATATTGGAAA
TTACCCACAAGATACAGAAGGTTGTATTTTACCTGGTAAAACCAGAGGTGCTGGTATTGT
TTCTAGTTCAGCAGATGCTTGCAACGAACTCTATACTAAAATAAAAGAAATTGGAATTAA
AACTGTAGATTTTATTATTAAAGAAATTGAAGCTTAAGGATTAAAATGAGGGGGTTAGTT
TATAAATCACCACTTAAAGTTGATTTAGATTTAGCAGAATCTTATAAAGGTAATATATTC
TTATATAATGAACCAATAAAAAATGATCCAGAATATAGCATACAAGATTCTATTAATTTA
GTATCTAAACCAGATCCTGCAACTTTTAGTGAATCAATATCTTTAGATGATACTAACCAC
TTCAATATTGATTTCAATTTTAACGAAACAGCGATATTAAGAGAATCTGTCTTTGATATA
ACTTCTAAGACTATTGATTCTGATTTTAGTAGAGATCCAGATCCTGGATTTAACTCTGAT
TCAAAACCAAGTGTATAAATAAATACAAAAAAAACAAGGATTTTAAATGTCAGATAAGTT
AAAATTACTTTATGAATATCACGATGCTAATGTACTTATCGAAGAATCAGTTAACGACAA
AAAAGAAAAAGTTAAAAAATATAAAATTGCTGGTATTTTTCAACAATAGGTGAAAAAAA
CCGTAACGGTAGAATTTACCCAAAAGAACTCTGGGAAAGTAATGTTAAAAAATACCAAGA
CGTTATAAAAAGCGGTTCTATTAATAGACTTTGTGAGTGGGAACATCCTGAAAGAGGTAC
AGTTGATCCTATGGAAGCAGTTGCTGCCATCAATAAACTTGAAATCAACGGCAAGTATGT
TATGGGTGAAGCTACATTGTTAGATAATCCAAGAGCTAACCAATTAAAATCCTTAATAGA
TAATGGTATTAAATTGTCTGTATCTAGTAGAGGTTCTGGTAGAGTTAAAAATGGTATTGT
CGAATCATTTGATTTAATTACATATGATTTAGTATCTGCACCAAGCGATTATAATGCTAC
TATGGAAGGAACATCTATATATGAATCACAAAAAGAATTTGTAATGGTGGATGGTAAATT
AGTAGAATCTAAAGATTCTGACAGTGCTAAAGATTCTGACAGGCGATAGCAAAGCTGATAC
TAAAGATTCGAATACTGAAGATTCGAAACTAAAAGAATCTATTCTTAAAGAACATTTCTT
AGAGTTTATTGAAATACTTAAGAACAAAAATAAAAACAAATAATCTATAACAGGAGTTAA
AAAATGTATGACGATATTGTAAAGAATGTAATTCAAAATAAAGGGCTGGCTCAAGCAAGT
AATGATTTCAGAGCTATTCTAATTGATAAGTTCGACTATATGCCAGAAATTAGATCAAGA
CTAGCTTCTATTGAAAATATAGGGATATGAGAGCTTCACAATTTTCTGCAAATAATGCA
TATAACCCAGATCGAGATTCGATTTCTTAAACATTTAAAATCCAAATTTTACTCGAGAGC TAACATTTTAAAATACTAAAATATTAGCTCT
```

FIG. 17A. (CJLB-15-1 [organism=Campylobacter phage CJLB-15] partial genome contig_1)

```
TTTTTTATACTTTTTAATATTGCTTTAAGTTTTAGATTTAATACTATAGTATAAACTGTA
AAAACTCAAGCATTTTTTATACTTTTTAATATTAGTTTAAGCTTTAATACTATAGTATAA
ACTGTAAAAACTCAAGTATTTTTTATACTTTTTAATATTGCTTTAAGTTTTAGATTTAAT
ACTATAGTATAAACTGTAAAAACTCAAGCATTTTTTATACTTTTTAATATTGCTTTAAGT
TTTAGATTTAATACTATAGTATAAACTGTAAAAACTCAAAAAAGTTCGTAACAACACAA
TTTAAAAGATCAAAAATATATTATATAATAAAAAACCTTATTTTGTACTTATAAAATTT
TCAAATGAATCTGAAACAGAATCCAATACAGGTGAAACTAGGTCGTCCAAAGCGCCAAAA
ACAGCATCCTTTAAAGTATTGGTAACACTATTAATAGTATTCTGTATAGTATTCTTGATC
AAACTCGTGACTTCAGAACTAGTTAACCCTTCCCTAGAAATTGTATTAATTTCAAAATGA
GTATATGCAAACTCAACTGTAAAAGTTTCAATTTGATTTAATCCATCGTATTGAACCGAA
ATTTCTCCTACATTTGTTGGAAATACATTCATCATAGTATATACAACACAATCTTTAGAC
ATTTCAAAATCTAATTGATATATAGAAATGCTTGGTAATATACCTTCAAAATTACCTTTA
GTTTTATCCTCAAATTGGTGAGCTTGATCATAAGTCATCCAATCTAAAAATAACTTTCTA
ACTGCGTGTTTTCATCATTATAAAAAGTTGCTGTCCATTTTTGTTGATAAGTTTGTACT
GATTTGACTGGTAGGGTTCTACCTCTATATTTAAAATCTATTGTTTCTACAGTCAATCCC
GGAAACTTGTAGCGTGACAAAAATAGTCTAAATATTGTCCTATTTCAGAAGTACTGGAT
GTTGCAGAAGCTCCTTCATTTAAAATACTTAATTCACACTTAATTTCTTTAGGTGGAAAT
ATTTGACATTTAAACTTAGTGGGGCGAGCTAAATCACCCATCACTTGATTCATTTTATTT
TGAATAATATCAGCCATCTAAATCCTTTATAATCAAGTATTTGTTTTATTAATTATATTG
TCGGGTTCTCTATCATATTTTCCAGTATATATTTTATTAGGTGCCACTGGTTCAGAGACT
TGACCATTTCTTAAGAAACTATCACTAAATCATTTGACTTACTAGTTGGATACCATTTA
AACATATAATCTTTTGTTATATCATTAGATCCTATAACAATATAATCATCCATTTGGTAT
ACGCTGGCGTGTTCTAATCTTTCGTATTTTTCATTAAATCTTTCAAGATCCCTAGTAGTT
TTATAAACGTCAACATATCCCGATTGCCAACCCCATTTATTTTGATAGAATCCTGTATAA
TCATTTTTATAGACTTCTGTGATTTTTGGCCAAGAATCAATAAATTCAAAATTAACATCA
AATCCATCATTTGCAGCAGTTCCTGTTAATTCAAATGTATCTATGGCTGTTAATCCCCAA
GGGTTTGTTCTCTGAGTTCATAATCTAATTTGTTCGACGTACCAGTAAATACCTGAGTT
GGCTGAACATTATTAGCTGCAAAATATCCTACATAATGATTATGATAAACTGAACTTTCT
CTATACCACAAGGATTCTTCATTAAGTTTTATTTTCTTTGAATTTAATCTTATTAAAATCT
ATCTCATAGAGATAATCACCAAGTGCTTTAAAGGTATATTGTGGTGCCAAATTAAAATCT
ATTTGTTCCAATACTTCAAGATCTTTATTAATAGCTCTAATTGTTGAATTTCTATTTTA
ATATCTTGATTGAATTTAAGATCTAATGGATTAACATCTAATTGCATAGATTCCTTATTT
TCAAACTCAACAAAGTCGTCATTTAAATAAATTTTAATTGGAAAATCAACATCCTCAAAG
TTTGCGTTATTAATACTAAGTATTGTTTTCTTATTGTGTTTATTCTTTAAGAAAAACAAT
TTGACAATATCATCGTCTTCTTTTGTAAAAATAATTCTATTATTTAAATAATCATATTGA
TAATCTATTAAATATTTTATAGAATCTTTTTGCGCATCTATAAATAAATCATCATCTTTT
CTTATACTATAAGTATATAAGAAACTTTCTTCGTTAACTTTTTCTGCGTATCTAATATTA
ATATCTTTTTTAGTTGCTGTGTAAATTGTTATAGAATCTTCATTAACTTTGAATTTTAAA
TCATTGTTAAAACCGGCCATAACTGGCAAACCATATTCAATATTTTTAATAAATTTATAT
TTACCTAGTTTTGAATCTGGGTCGTTACTTTCCACAGCTTTTAAATCAGCTTTCTTAATT
TTAAGAGTTTTTAATCTTGAAAATGAATAAAAATCTTCAGTAGACACTGTATTGATATCT
TGTTTAACTATGACACCATTTTTAACAGCATATAATAATTTTGTGGAGTCCGGGTCTCCA
GCTTTATTATAAGTAACATCAGCCCTATTTTTAGTATCATCTAAATAATATATTCTTACT
TTTATACCTTCAGAATAAGATATTTTAAATCCAGTAGTTAAAATACCTATTTCAACGTCT
AAAACATTTCCATCAGTATCCATAACAACTAAAGGATAAGTTTTCATTTCGTTGTGCTTA
TAAACATATTTGTTTGTACTAGTATCCATATTTAATAATATATCTTTATATTTAAATATT
TTTGCGTTATAATTAATGTAACTAGTATCTAATTTAAATTCAGCATCTATTGTATATGTT
CTTGGTATACCTTCATCTATATTATCAAAGTATTGTATTGTAATAGCTTCATTTGTATCA
GTATAAAAAGATACCCCAGTATTTTCAATATCATAGTCTAATTGTATTCTTTGATTATTT
TTATCGAATATATTAACAATCATAATATTTTCGATTCTAAAATTATAAAGGAATTTACCT
CTTTTATCATTAACTTCTGAAAAATTTCCAGCAATATCAAATGTTGTAGATTTAATAGTT
ATTGGATTTTTAATACTTGCAGAATAATCTAAGTATAATAAACTTAAATTATTTGTTTTT
GCATTACAATCTAATGTTGCTAATTTACCTTCAGAATCGTAAACTATTTGTCCTTCAACG
TATTGGTTATCAGCATTGATTAAACCTAAGAATATACTATTTTCTTTTGCTTGTATAGTT
TCATTAGTTGCACTCAGTATAGTTATCGGAAATCTTTTAGAAGTATTATCTATAACATAT
ACTCTTATTTTTTGAGCAGTGCTTGAAGTTATTTTAAAACCTTTTTGTAAACCAGCAATA
TACATAATGTCCAAATCTACATTGCTAATACGATTAGCTACGCTGACAAAATAGTATTCT
TTTTCTGGTGTAGTATATTCATATAATTTAGAATCTTTATTATAACTTAATTCGGCATCA
ATAATTTGAAATGGTCTTGAATCGTATTCATAAGTATCATCAATAAATTGAATAGTTACA
GGATCTTTTATATTTAAATAAAGCCTATATTCAGAATCTACAAGCCTATAATTACCTTTA
ACTATATAACCATTAGAATCTACAATATTCAAGTAATTACACACCTTTTTTAAGGACTGTA
TAATATTGACCTAAAGGCTTATTCATAGATTCTTTAAAATCTTTGTAAACTTGTGAATTG
TATTTACTGAATAATGTTTTATCTATATATAATAATTGTGTATTTTTAAGTTCATCTTCA
```

FIG. 17B. Continuation of (CJLB-15-1 [organism=Campylobacter phage CJLB-15] partial genome contig_1)

```
GCTATAACTTCTAATGAATCTTCGTTATATTTTATTTTAGCGCGAACTCTATACCCGTAA
GTATTAATTAATTCAAAAAATATTGCATTTGGATTATATAATCTATAATGATATAAATTG
TCAGATTCTAAAATAAAATTACAAGTACTTGATTTTACGTGATCATCAAAACCAGAATAA
ACTTTATCAAATACCTGTCTAATAGAATTATCATTTTTCTTATATAATGCTTTAAAGTCA
GAAGTTTGTAAAACTTTATTACGAACTCTAGTTCCATAAGTTACTGGTGTATTTGCATTG
ATTCTATTTTTACCAAGAACCCAAGTATCTGAACCTAGATACATATTACCAGCGCCAATA
GCTGCAAATTTACCAGTAGTGCTAGCTAAACCAAAATCTACTTGAAATTGATATTTGTCT
TTAACTGTGGTTACAACTCTTCTAACATAATTAAGTTCCAAAGCACATTTGCTTAAGAAA
TCAGTATAATCTTTTTTAATTTCTTGATTTAATGAATTAATACCTTTATAATAATATAAT
ATTAAATTCTTAGGGTTTGAATTTTGTTCTAATCTTTCACCAGATTCAAAATATACAATT
AATTTGTCATTACCTTTTATGCTGGATTTTTCAATAGTTCTAATAGTAGGATCTTTAACT
AATTTTAATTCAGATTCTAATGTTAATTCTGGGTAATTGACACCAAATCTTGTAACATTA
AATACTGGATTCCATCAGCTTTATACATTTTTGGTTTATTATTTTCATATATTATATTA
TTATTAATGTCAGTTTCAAAAGATATCCGGTATTTGTTTTAAAATTATCTTCACAATCA
GAATCTTCACAAGTTACTCTAAAAACATTTACATCGTAAACTTCTTTGCATAAGAAATAA
TCTTCGAATTTAAGAACGTAAGTTCTTGTAAATAAGTAAGTCCAACCTACTGGATGTGCT
AAAGGCTTAACAAATGCTTCGAATATTTCTGGTAACATAGATCCGTAAACGCGGTATTCA
AATATATTTTCACCGGGCTCTATTGTTAATTGACCGTCGGTTTCTAATACAAAACTTTCA
ATATTTAATTGTTCTATAATACGATATATAAACTCAATAGATCTTAAAGTTCCTTTAGAT
TGTTGAAAGTTTTTAAATAATTCTAATTGTTCTTGTGATAATAAGTGTATTACATTTATA
TCTAATTGCGTTTCACTAAAATCAAAACCATATTTTTTGTGCGCTTTTCTAACAGCTTCT
GCAAGTTTATGATTTTTTGAACCATCGGTTATAGTCTTATAAAGTTTGCAGCATATGTT
TTAATAATTTCTTCATATAGAACTTCATTTTTAGAATTATATAAATTATTGATGTCAATC
GCTAGGCTTGAATTATCATAGATATAATCTACAAAAACGTCAAGGACGTCCATAATAAAT
TTATTAGATTTGTAATTTTCTGGTACTAAGTTTTTAGCTATACTTTTAAACACAGCAAAC
CTTTAATTATGCTTTTAGTATATTTATTTGGTTCTTAGTCTTAAATTAAATTATTTTAAT
TTTTTGACTTCTACCTTAGATTCCATATGAACACTTTTAAGAACCACTCTATGTAAAGTT
CCTACTTTATCGGGTGTTGTACTCCAAACTCTTTCATCGTTGTGATCATTTAGATTTACA
TTCTTTGCTAAGATACCTTGATCTAATTTAATTATATCCACTGTAAATCCTGGGTTATTA
CTAAAAGAATAATATATTCTCCTAGCATTTTCATATTGTTCAGAATCACCTAATAAAGTA
TATTTAAGAACGGTAGTTGCTAGATAATATAATAATTTGCCTAATCTGATACCTCTATGG
TCTCTATCAACTTCTACAGCACTAACTGTATAAACATTTTTATAATCCATTCTTTTAATT
TTATCTGTAGGCAATAATCTAATCATAGCTATAGGACTAAATCTATCTTTGGTACCATTA
GGGTTATCTTTAGTCGGGTAATCTTCAGGTACTTTAGTAGCTAAAATATGGTAAGATTCT
CTACGATAAAAAAAATATTCTTTACCATTATAATAAACTTTATATACAAAAGGTGATTTA
TCAAATGTATATTCTATCGAAGTCAGACCATACTTATTAATATAGTTTAAATTCCCAAAA
TCATAATCACCTGATTTAGCAATTGCTTGCTCTTCTAAAAAATCTGAAAACTTCAATTTA
GCTCCTTTAATTTGTAACTTTAGTTAATACCAATCTATTAAATCTACCACGTATTCTTTC
TTCTTTAGTTCCTGTTAAAAATAAATCTTCATCGGTCCAAATTCTTGGATCTAAAGCATC
TTTTAATTTAACATTTTTAGCAATAATTTTACCTGTTGCTAACTCAACTATATCAACGTT
AAACCCAGGTGATTTAGACAAGAAAGTCCATAAGTTTCTTGCACCTTCATATTGTTCAGA
ATCACCCATCAATACCCATTTAAAATCATCCACTAAAATAGTATATAATTTTTTACCTAT
CCCACCACCTCTGTATGATCTTAAAGTTTCGACACCTTTAACTATTCTAAGAGGGCCATA
ACCTAAACCTCTGTATTTGTTGTATATTCCAAAAGTATAGCAGCTAATATCTTAAATCT
TGTTGTATAAGGTTCAAATCTTTTATCTATTTCTTCTTTAGCTACACAATAATATTTTTG
TTTAGGATGGTTAGCATTACATTCAATAATGAATAATTCTGTATTATCACCATTTATATC
AAAATTGAACTTATGGAGAACTTTCACAACTTTCTTTGATATCAAACCTCCAGCGCCTAT
GTAATCCAAGTTACCAAAATCATAATCACCTGATTTAGCAATTGCTTGCTCTTCTAAAAA
ATCTGAAAATTTCATCATAGCCTCGTTATTTAATTTGCATAATTATATCATAAAATAAC
TTAAAATATATTTAATTAGATAATTAAACACTCATAGTGCTCATATCAATATCACCAGCT
CTTAAACTATCTCTAACTTCTTGATAATCCAATAAATCATCAAAAACTACAGATCTAAGT
CTAAATATTGAATTTCTTATTAATTTAAAATTATGTGATGGATAATTTAACATAAATTCA
TAATTATATCCAGGTTGAAAAATTTTTGTTTGGAATTTAACTCTAATATAAGGTATCCTT
GAATTAAATATTGTATAAGAACCTACAATTTGTTCACCTTCTTCTGGCGTAGCAGCACTT
CTATTCATTAATTTAATAGGTATTCTTATATAAGCAACTTTAGATAGATCCAAATTAATA
TATTCTTCAACTGTTGTATAAAATGGTAACATAGTCTTAACAGATTCTTCATCTATAACA
TAGTTAGCAACTATTTTTGTTCCGCCACATAATTTGTTAAATTTGCTGGGATAACTTTA
TGTGTTTTGCTAGGTTCTTGTATTTCCTCAAAACAAATAGGTTCATTATCCTCACCTTCT
GCAGGATTAGCTTTAGCAAATAAAGCCCATTCTATTGTGGGTATATTTTCTGGTATTATT
TGACCCTTGGTATCATATATACCTTCAATTGGTAAATCTAAATATACATAAGCTCCTCCT
GGGCCTTCATCCACTGATAAATCTACCGCAGCTTCTTTAACATATACTATTTGATTTTGA
TATAATAAATCACCACGTTTTACTTGAACGTCTAAATTAAAATTAAAAGTTCCTGTTTTT
CTATAATTATTTAATACTACGTATGGCGCTTCGTATTTTAATGGAGAACCTTCCGGTATA
CTGACTGTATATGAATCTAATGCATCATCGTGATTTGCAATTAAATTCCTGACGTCGAAT
TTATTATTATAATTAACATAAAATGTAATTTTTCATTAGATTTTAATTGAACTTCTCTA
TCAAATGTGGTTGTGGGCGCATATTCTGTTATATTTTCAAACTGTTTAGCAACAAATTGA
```

FIG. 17C. Continuation of (CJLB-15-1 [organism=Campylobacter phage CJLB-15] partial genome contig_1)

```
ATTCTATCATCTTCTACAGGTGTTAATTCATTTTGTCTTTCTACGTAAGTAGGATATATA
CCGATAGAACCATCAGCACTACCAAATGAAATTTTTGTAACATCTAATAATATACCATCT
ATTTTTGTATCAAACTGCCTTTGAGCTATCATAGCGTCTGTTATAACAATACTTGTAGTT
TTTTGAGCATAATCTATTAATAATGTATCATTGGCTTTTACTGAGCTTGGTATCCAAACT
CTAATATCTATTTGACCGTCAGAATCTTCATACCAGTTATAATATAAATTAGAAGTTTCT
ATATCACCAAAAACATTATCTTGACTTTCAGTTGGTTAACTGCAGATTCCCAAGAACCA
CTGGCAGTTCCTAATAGTTGATTAGATTTTAACCCATTGCTATCAGGTTCTTCACTATCA
CTTGGTTTTAAAGATTCTCTATTACAAGTATAAACAACTTTATAATCACTTGCTCCTACA
AGACCTGCATATTTACCCCTTTGTAAATCATCACATTGTAGATAGCCTTGTGAAAGTATC
TCTTCAGTAATATAGAAATCATATATTAATTGTTCTGCTTTGCGAGAACCATATAAACCG
TAAACTTTAAAACTATCACCTACACTAACAAATCTTGGCAATGCTATTTTAATAACTGAT
AATTCATTACCTATATTAACATTAAAAAATACGGTTTTATTTTTTAAGTTGTATAAATTA
ATGTCGTTTCCCCCATAGGTGGTCAATCCATCGTATGATATTATTCTAACATTTAATGAT
TCTTCATCAAATCCCACATCCTTAAAATAAAAAGATTTGTAAGATTGGTTGATATCAGTA
TCCGTTAATTCATAAGTATAATGATCTGTATTGTCTAAAATAAACGGCAAACTTTCTTTA
TTAAAATAAACTTCTAATTTATCACCCACACTAGCCAATAAACTAAAATAAACACTAAGA
ACTAAATTCTTAGATAATTTGTCATATGATTTAGCATAAAAACAATTTACTTTACTAAAG
TCTTTATTTTCTTTAAATTGTTTTACACAGTTTTCTTCACTTAGTAATAAACTAAAATAT
GGATTTACTTCTATACCATTACCCAGACCCAATTCATTGTCTAAATGCCTAACTAAGTTA
GAATGGATAAATTCACCTTCAAATTTTTCAATTTCTGCCATTTTTTCACGAATCTTTGCA
TAGATTTTTTTACGAATATCTGATTTTGGAGTACCAAATGGATATTGTTTAATAAGAACT
TGTAAATCTATATTAACATATGTTGGATTTTTAAGATTATTCTTAAGTGCTGGTAAATTA
TATGTATCTACTAAGTCAAAAATACCTGGGTTTTTATAACCGTTAGCATCTTTTTCTGCA
GAAACAACTTCACCATCATTTAAATATAATGTGTCAGGATCATTATAAGATTCTTTTATG
TAGTATTGATTGGTACTCATTTCAGTAGTATTCAATAATTCACCGTTTGCTAAAGTAGAG
TTTTCTTTTTTGTAAGTATATGTTCCATCACTTTGTTGAACTTTTTTAAAGATTGTAAAT
TCTGGTTCTTTTCTTCGGGGTTCAGCTGAAAATACAAATTACCTGGAGCAACTGGATAT
TCATCTTCGCCTCCCCAAGTCACTACATTTTTAACACTAGAGTGTGTTTTATAACTGAA
TTATAATCGTGTATAGTTACTGTTCTTGAAGCACTATTATAAAACATTGGTGCATTTGTT
TTAATAGACTCTATACTTTCTTCATCCTGAGCTTGGGAAACTAATACAGGTGCATCTTTA
CCAGAAGTCAATATTTTACAAAAAGAGCCAAGATCACCGTTAACGGAAGCTGAATCACAT
CTCTCATAATATGCGTCTATTCCAGAAGTTCTTAAAACATTAATATAAACTCTCGTATTA
GAAGGCAACTTAGTACCAGCAGTCCCTAGTTGAAAATATATCCTAGCATTGCCAGTATCC
ACATCATCTTTTCTAAAGAACTTATTATTGGTACTATCCTTAATATCAATTAAATTAAAA
GAAGATTTTACAAAAGTTGCATTATCCGATAAATTTCCAAAAGTATCATAATAAGTAACA
TAACATTCCACACCATCATCTTCTACATCATTCCAAGGTATATCAATGTATTCAAATTTT
TCATCTATTTTATAAGTTAAAATATCAGGATATTCTTCGTTTTTAATTAATGTACCTTCT
TTTACTTGTATTGTAGTTGTAGCTCCTATTTTATCTATATTAAATTCTAAATCATCACCT
AAATAATTGTAAGTAAACCCATTTATGGTAAATGTGCTATATTTTGGTATTTTAAAATAG
CCAGTTCTGGTAAAACTTAATGTTATTTCGAGTATTGTAGATTTTTTATGAGAAGGTTCA
TAAGACAAAACCCTAGCATCTTGTATAACATTTTTACGTTTAGTCGCCAAAGTTAAAACA
TTCTCATTAACATTTACTGCTGTATTGAAGTTCAAAGAACTTACGATATAAGATAAAACA
GATGCTAAGATTGCTCCATTAGAACCTTCATAAGCTCCTCCATCCCAGCCTTTTTCAATT
AATCTTTTAGCTATATCTTGATATATTTCATCATATGTAAAAGGTAATGTTTCTTTTATA
ATAGCCATTTTGAAATCCTGATTTTTGTAATATTTATTTGATTTTTTACGGCCAATTTTTG
TTTAATAAATAATAAAAAATTATTAAAGGATTATCAATGTTAAGTATTGCTATTTACGTT
GCTATATTCGTTGTCGGTCTTGCTGTAGGTTATTGTATTCGCGTCAACGGCTCTAAAAAA
GCTGAAGCTCTTTATGAAGCTCTTAAAAAAGAATACGATGAATTAAAAGAAAAATATGAC
AATAAATAAGGTTTAAAATGAGTGGTCAATCAGAAGATTTAAAAAAGAAACTAAAATATT
ATTGGTTTGTTTTCAGATGGTTTTTAATAGGTAGATATCATTGTTCTGGTGGCGAACATT
ATACCATTTCATTAAGAACTGTTTGGAAAATATGTAATAGAACCATATGGGGTGTCATTA
CATTTCATTAATATATGCAATAGCTAGTTTTTTAATTATATTGATTAACCCATTGCTT
ATCAATATTTTATGTTAATAAATAACATAAATTTTTTAAAGGGAGTAAAATGTTGAATAT
TTATGATGCGCTGTTTAGCTCCCTTCCTATACTACTTATAGGTGCTGTTATAGGTGCTGT
ACAATCTTGCATATAGATAAAGCTGCTAAATCTAAAACCAATTTTTTAACGAGATTCAA
ACTTTTTATAAAAACCTCTTCAACCTCTGGTATTTTAGCGTTATCTTCTTTTTTAATAAC
TGATAATTTTGATTTAACTTATTCGAGTAGAATAGGTGTATCGATTTTTATAGCATTTGC
TGGGTATGAAAAAATACAAAGTATAATTGATAGATTATTAGATAACATATCTCCCAAAGA
TAAAGATTCTAAATTGTGACATTCAAATATTTTAAATATACTTAATGTTAGTTTTAAAAC
ATATAACATTAGAATGTAAAATAAATATTTAATAATTATGAAAGGTATTTTAT
GGCATTAGAACATATTACTGCAGATCCAGTTAAAGTTGACATAAATGGTTCAATCTATGA
AAAATCACAGGCGGAGGTTAAAGCTATTATAGCTGAAAGAACTGAAGCAAACTTGGCTGA
TAATGAAGAAAGTGATCCAGAATCACCGTCAGTAGAAACTACTTTATCTTTAAATCCAGC
TGATAAACAAACTATTGAGAAGGGTCAGACTAAAGATATTAATGTAACTACAAATGCTAG
TGATTTCACAGTTGAGTCTAACAATGCCAATGCTACAGTTAAAAAAGGTTCAGGTAAATT
CACTATAACTGCTGCAACTAAAGGAACTTCTGAAATTACTGTAAAAGCTACAGCTAAGGG
```

FIG. 17D. Continuation of (CJLB-15-1 [organism=Campylobacter phage CJLB-15] partial genome contig_1)

```
TGGTTCTGAAAAAGTTGTTAAATTAAGTGTTGAAGTAACTGAGTCTGAAGATTAACATAG
TGAAAATTAAGGTAAAAATAAGTCGATATTAAATCGGCTTATACCTTAAAATAATATAAT
AGGTATATAAATGACAACTTATAAAGATTTTCATAATGATTCTTTGAATGCTGTAGTTAT
AGATAAACGAGCTATAGAACAAAGTATTTTTAATATATTAACTACTAGAAAAGGTTCCTT
AGCTGGTAAACCAGAATTTGGTTGCAATTTATATGCTTATTTGTTTGAAATGATTGACCA
TATTACTATTAATAGTATGCAAACCGAAATTACAAGATGTCTAAAAGTTTACGAACCTAG
AATCAAAGTTCAAAGTGTAGACATTTATTCACAACCAGAATTCAACAGGGTTATATTAAG
TATTAATTATAATTTTACAGGAGTAGAAACTTCAAGCTTTGAAACTTATACAATAACCTT
AAATACTAATTAATCTATTTAAATTATTTAAGCCTCTGATCAAAAATAAATACTAAAAAT
ATAAGCAGGAGATTTAATGTCTGATTTTAGATACCAAGGCTATAATTTTAACTTAACTAG
TTTTAGAGAGTTCGTTCAAGAATTCAATATTATGGATAACCAAAGAGCTAGTGCAGACGC
ACTAAACAAGTCGGTTAATAAACTCAAAAGAGAGGTTAATCAATTAATCGGCCAATTTAA
AATATTAACTTCAAAAGAATCTATCAGATGGGATGCTAGCATAATTTATGAAGCAGGTGA
AATAGTTTCTTATATAACAGAAGATAATCCAGATGTAGAAACCATTAAAAATTCATATTA
TTTAGCATTGCCTAGTGATATCGAAAATCAAGGGTATTATCCAGATACTAATCCTGATAT
GTGGAAAAAAGTTACTTTAAATGAATTATACCCTTGGTTAGATGTAGATAATTATCCTAC
TAAAACTGATAATGATAAAGATTGGCCCATCAACGACGATTACGATGTTATTAACTTAAA
GTATCTTAAATGGGCTTTAGAACAATTTAAAGATTTCTTAGATGGTTATCTCGCAGGTAT
CTATATTAAACAAGATAATAAAATAGATTTAGAAGTATCTGAACCCGCTCACGTAACAAC
TAAAAAATATGTAGATAATTTAATAGATGAAGTAAAACAAAGCATTACTAATATAGATGA
TTTGTTAACGGATTATGTATTTGTTGATTCTAAATCTAAACAATTACAAACTCGTAAAAG
TAAAAAAGAAGCTTGGTTAACCACAGAAGCTGGATTATTACCAGGATTAAACTTAATATC
TACAATTGGCTCAACAACACAACAATTTAAAGCTATGTACGCTCAAGATTTTATAGGAAC
TGCTTTAAAAGCAAAATACGCTGACTTAGCTGAGGTCTACGAAACCGATAAAGAGTTTGA
AGTTGGTGCTGTTCTGGGTATTAATGAAAATTCAGAAATTGAATATTTCGACATCTATAA
ACATAATAGACCTTTAGGTGTAGTTTCAGATAAACCAGGGTTTATTCTTAATAAAGATTG
TAAAGGTGTGTTAATAGCTTTAAAGGGTCAAACACCAGTAATTGTTAAAGGTTCTGTAAA
AGCCGGCGACGAATTATATGCTGAGTATGACGGTTATGCCTGTGTAAACCCAAGCAAAAA
AGAAGAAAATATTTTATAGGCATAGCTTTAGAATCTAAAGAATCTGAACTAGTTGGCTT
AGTAAACACTAAAGTATAAAATATGTTAATACATAATGGCCAAGAATATGAACAATTAAT
AATAGTAGATTTATTAATACTACTTTTAGTAGTTACATTCATTTTAGCAAAAGAAGAAAT
ATAAATAATTATAAAAAATTATAAATAAAAGAAAGGAGTTTAGAATGTTATCTAGAAAGA
TAAGAATTGATAGTTTTATATCTGATGCAGAAAAATCAGAAATATTTCAATATTCTAAAT
CCCTTTCTGCTGTCTATAACGTATGTCTTGATACGCTCAAGAAAATTTAAATTTTAAAG
ATTTATCTAAAATCACAAAAGGTAGGTCTAAAACAACAGGCTTGCATTCAAAACATATAC
AGAATACCTCTAGAGAGGTTATAAATGCTGTAAAATCTTATCTAGCAAAAAAGAAAACAG
ATAAAACTGTTAGATTTCCAAAATTATATAGAGAATATAGTCCTATCATTATGGATATAA
ATCTTTCTTCTAAGATTGTAGAGGTTGTTAATTCTGAAACAGGAGAGGTAACTCTTGTAA
AGAAATATTGTCCAGGCGGGGGATTTAAACTAGAAGGTAAGAAAATAAACTTTACTTCAA
TAGGATTTGAATTAGATTTAAGTAAATGCCCTTACTATGATATAGAACTTATCAACTATG
AGACTTTAAAACAGATAGTCATCAAGATTGATGAGAATAAGAGAATAGATTGTATTTTTG
TTTTCTCAGAGAAAAAACAAGAAAAAGCACTAAATCAAAATTTTCTTTCTATAGATCTAG
GAATAAGCAGTACAGCATCTTGCTACTCAAATAAGATTGATTGTCTGAAGATACAAACTA
AGAGATTTAAAGGTTTAGAAAGAGCTATAAATGAACTTAAGTCTAAAAGAGATAAGAAGA
AGAAAGGTTCAAGAGCATATAAGAAACTTAACAAAACAATCAGAAGAAAGCAAGCAAAAC
TAACTAATAAAAGAAAAGACTATCTCCATAAGACCTCAAAAACTATGGTAGATCTCTGCA
TTCTTAATGGTATAGATAACATCATTTGTGGAGATATCAAGACTAAAAAATTAAAGAAAG
ACTATAAAACAAGTTTAAACAAATCAACTCAAAATGAAGGACTATTGAGTAGATTTAAGG
GTTTCTTAAAGTATAAAGCAGAGAATAAAGGGTTGAACTTTTTACTTGTGAATGAAGCAT
ATACTTCTCAGACTAACTGTCTTACAGGAAAAAGAGAACTAGACTCGAATCTTAGTATTA
GAGAGGTAGAATTAAGTCCAGGTTTCAAAGTTGATAGAGATATAAATTCAGCTGTCAATA
TAGCCAAAATATGTGGGGATTTATGGTTATCCCATATCTTTGAGAAGAATAGACTTCTCA
AGATACAAAAATGAATATTACTTTGTAATATTTGATTAAATTCTTGTAGATTTCTATAA
GAATTTAAAAATCATATATTTTTATATGAAGGATTATGATGCCAGTCCCAAGTGTTAGAT
TTATTGATAGTGATACCAGTTCAACATCAAATTATTCACAACCAAGAAGAGTATTCTATG
CTGGATATTTCGATAAAGGTTCACCAGATACTTTAACATCCGTTTATTCTATATTAGATT
TTAAAACAAATTTGGTAAACCAAACAAAATAATATAAATGACTGGTTTCAAATTTATA
ATTATTTTTTATATGATAATAATGAAATAGTTATTTCGAGATCTATTGGTGAAAATTCAG
TTAATGCTAGTATTAGCTATCCATTTAATGACTTTGACGTCAGAATAGATAACTTAGATG
ATTTTAGAAGTAAACGTATAATTTCTGAAAATAATTTCTTGAGAATCCTTGCTAGAAACC
CAGGAGAGTGGGGAAATGATTTAACAGTTTGTATTTTTACACAATATGAAGTTCTTAATA
ATATGCTAATACACAGCAATTATTTAGCAAAAGATATTCAAAATTCAATGAGTTCAAATC
AATATTGTATTTGTGTGTTCTTAAAAGATACATTAATGGAAAATATATCTTAAAAGAAG
CTGAGGGTATATGGTAGATACTATTAATGAAAATTCTAATTATATATTCATTGTTTTCGATC
CTAAAAAATACAAGTTATATGATGGTAATATCCACTATGTGGATGGCTTAAATCGCTTAG
CTGATGGAAATGAACCTAACTCAGATAAAACAGTTTTTTATGGTTCTAATAGTCTTAAAT
```

FIG. 17E. Continuation of (CJLB-15-1 [organism=Campylobacter phage CJLB-15] partial genome contig_1)

```
TAAGTAACGGGTACGCAAGTTTACCAAGTGCAGCCCAAATAGATGAAACATATAAAAGTG
TCGGTGAATCTAATGATTATGTGTTTGATTTTATAATCGCTAATACACAAAGTCCAAATT
CTGCTATCAATTTAGCAGATACTCGTGGTGATTGTTGCGCTTTCGTAGGCATACCCAGAG
GTATCAAACCTGAAGAATATATTAAACAATTACAAATTTCAAACAATGCTGTTGTTTACT
ATGGTTCTAAATTACAATTAAATCCATTTAATAATCAAATATATATGTTAATTGTATAG
GCGATATTGTTGGTTTAAGAACCAGATTAATTAATTCACAAGAATTATCAGTATCTCACT
GTAAAACAATTTATAGTTTCTTAAATACAATAGATTTGGATATATATTTAACAGAATCAC
AAATAAAAGATTTATATGATTTAAATATTAATATTGTTAAAAAAGGATATTCCGGTATAT
ACGCTTTAAGTGAAAATACCTTAAAAGGATCTAAATTAACAAATAGAATAATATATTTCA
ATTTAGTTCGAGAATGTGAAAATGCTGCATTATATTATGTATTTGAAAATAATGATGAAT
ATACAAGAAATGATTTAACTTCAAAAATAAAAGAAATTTGTAGAAGTTATGTTGCAGATA
ATAATATAGAAGATTTTAAAATAGTTTGTGATATTTCTAATAATCCTACTCAGGATAATA
ACATTTATGTAGATGTTTATTATAAACCTAAGTATTTAATTGAAGAAGTTGTATTTAGAA
TTCAAGCAGCTAGTGAATTGCCTAGTTGAATTCTAAATTGATTTCTTAAAATTTTAATCC
CATATTTTTGACTCTATCTAAAGTATCTGTATAATCTTTATCTTCTCTAAATCCATTAAA
TCTTGGATGCATTAAAGCATATATTTCAGAATCTTCAGATTTTGTCAATGCTGTTGCTTT
AACTGTAAAAACTTTATTTAAATACTTAGAACTATTTTTAAATATTTCAGCTCTTTCAGT
ATCACTAATCCCAGAAACTTTACCTTGAATTAATTCATCATCTGTTTTAAAAACAATAGC
ACCAAAAGTATCCTTAAACTTACCATTACCTTCTGTAAAATCAATACAACGAACTTCAAC
TTCTATTTCTGGTTTTAATTTTATTTGTTCTGTACTAGTACCATTCTTAAATACAGCGTC
ACAATTTTTTAAGATAGCACCTTCTTCACCTTCTTTTAACCAAGTATTTAAATACTCATT
AGCAGCTTCTATATTGTCAATAACTCTGGTTCTAACAACAGTTAATGTATCAGATTCTAA
AGATTCAGTTAATCTCCAAACAAACTCAAATCTTTCTTTATATGGTGTTTTACTATTTCC
ATTTTCAAATTCTTCTAAAGTCAAATAATCCCACATATAAAAAGTTACATTTTCAGGTGG
TGTTAAACTATTAAGTAAACCATTAGATTTATATCTGATTTCAGTTGAATTAGTACCTTC
AACTTCATTACAAATTAATTCACCAATATAAGCACCATCTGGCAGATTCAATAATGCTGA
ATATACTTTAGGGTGATCATAACTTTCACCAGATCTTGAAATGCTTGGGCACTATCACC
TTTTTTAATAAAAGTTCTATAAGTTCCATCCGCTTTTATTTGAATCATTGCTGGAAATCT
AATATTCTTAAATTTATCCATTAATGAACATCTCATATATGGAAATTCTGTTATAAGTTT
TTTATGAACTTTGTTGATTTGTTTAGTTGAAATACCTGAATGAATATCTCTATCCAAAAT
ATAAGTAATAATCCTGGTTATTTCTGGTGTTTTATTGTTAAGTAATGACTGAACAACACT
AATCGCCTTATTCCCTGTAAAATCGCGATTATGCAACGCTATGAACGTATTTTTAATTGT
ATTGAAATCTATGGTTTCATTATTATTTTGAAATTCTGGTACTTTTTTAATTCCGTAAGA
ATATTTGACTTTATCATAAACCAATGAAAGAAATTCTTTAATGATTTCATTGTTATATTT
TTTAAGAACTTCTAATTTATAATTAGAACTATTTGAAGCATTTAATTCATTTAAAAAATC
TGTTATAATTTGCATTTTATCTCCTTTTGATATATTATAATATAATTGAACTTAAAAAAT
TATTAATTATGCATTTTCTCGTTCTAAGAATCCACAACATTCTACACAATTAACACAGTT
TTTACAATTTTTGCAATCTTCACAAGTATAGCAATCAACAATTTCTACACAATTATAGCA
ATAATCACAACTTTCACATTTTTTGCATTTTTTGCAGTCTTCACAATCTCCACATTTTTT
ACACCTGACACAATTGTAACAACAATCACAACCTTCGCAGTCACAACATTTTGTGCAGTT
CTTACAACCTTCACAAACAAAACATTCATAACATTCAGCACAACCATTACATCTGACACA
GTCTTCGCAACCAAAGCAATCTTCGCAGTTTTTGCAATCTATGCACTCGCTACATTTTTC
ACAGTCTTCACAATCATAACAATCTTCGCAGTTAAAACAATTAACACAGTCTTTACAATT
TACTAAAGATTCTGAAGCTTTTTTAGCTTGGTCCTCAGAATATAATTCAGCATCCCATTT
ATTGTTGTTAGAATCTACATAATAACCATCTATTAATTTCATTTAAACTCCTTTAATATT
ATAATTTAAAACCTAAATGATAGCCAGCCTTCATAAACTTCAAATGAATCTAAATTTAT
ATAATCTTTCTTATTGAATATAAAAAGTTCACAACCAAGTACTTCCATACAACATCGATC
TGATTCTGAATCCAACCCTCTAAAGAATAGACCAAAATCTTCACCGTGTTGATAAGAATC
TACATGATCTAAAAAATATTTTTTACCGTTGAATGTAAATATTAATTTTTCATTTCTAAC
GCGATCTATTAAATCGTTCATAACATTGTGTGCATAGTTGTTAGGGTCTTTAGCTATTTT
ATTCATTATGGCTCCTTTATCTTTTAATGAAATAATTATAATATAAAATAACTTAAAAGT
TTCTGAATGTAACTAAAGTTTTAAATCAGTGAGTCTTTTTAATAGATAAACCGGTTTTA
TCATATTCTTCTTCGGTATCTGTATTATTAGCATTGTATTATTAGAATCGTTGTATTTAGGT
TCATCACCAGAATCAGAATCTGAATCTGAACTGAATTCATCCCCACTTTCAAAATCTCTG
TAAAATTGTTTATACAATGGATTTTAGATTCTTTTTGAATAGCTTTAAGATTCTTTTTG
ATTTCAACATCATTAAATCTAAAAATTTCTTTATATATGTATCTACAGGTAAAACTGTT
CCTCCAAAATCTTTAGCTGTTGAGAATGCATCTATACGTTTCATAAACAATGTTAGATTC
ATTCTTTCAATAAATTGATTTCTTCGCTAAAGTATATATTAATAGAATCTTTAAGTTCT
TGAAATTGTTTTCAGTACAAACTTTAGTACAAATTAATTCTCTTTTTAGAATTTGCATA
AAGAATTCCGTGTATACTTGGCGAATCCTAGTTATTTTTTGGAAGAATTTGATGTCCTCG
TTTGTGATAGCATCTGCTTGCAAATCAAATAATGGTTGTTGTGATTGGTCATCTAAGTAG
ATTCTATTAACTGGTATTCCCATAGATCTATATAATAACTTGTAAAAAACATAATATCA
CCAAGTTCTCCTAAATTACCAGTTTCATCCAAGATATCTACTTGCATACCTTTAGCACCA
GCTTTATTACCAATCCAATAATCTTCGACCATAGTGACAATATGTTGGTTATTAGTTACT
TCACCAGTTTCTGGGTTGTATTGTTTTTATATTTGAACTTATTAGTCAAATCCCTCATA
TAAGCTTCTGCTTTAGAATTCGGTAATTCACTTAAATCTATATTAAATACACGTCTTGAA
```

FIG. 17F. Continuation of (CJLB-15-1 [organism=Campylobacter phage CJLB-15] partial genome contig_1)

```
ATTGATCTTGAAAATCTTAAAGGTATTAACAAATCTTCAAGTGTTTTTAATTGATTAGCT
GTTTTAACGGAAGCTTCTAATTCACTTAAACAAATACCAGAATCTGAAAATAAACCAAAA
TTTTGATGAACTATTTCCTCTATATCGTATTCTAAAGCCGCTTGATCTATTCGAACTGGA
GCTTTACCATTGATATTGATATATCTTTGATTTCCTAAGAAATTATTTTTAAGAGCTACT
GAAGAATTTATATCTATGTATTTGTATTTAGAATCTGTTAAATCATACCAAGATATCTA
GGATCTAAATAATATAATTCTTTTATACCTTTTTTCTTATCATCGTGGTATTTAATTAAT
ATATTCATTTGGCCGTCTATATAAGATTGTCTGATAAAAGAATGTAGATATTTTGGGTT
CCAAATAATTTCATTATTTTTCAAAAGCATTAGATATTGCTATGTCTATTTTCTTATTC
GAAGTATCAACTTCTAATTTAATAGGATCTTTGAAATCTCTACAAATATGCGACTTCGTCT
ACAATTTCTGTTAAACCACTCCAACATTCAGCAATCTTAGCAGTTTGTCTGTAGATATCA
ATTTTTTGAGCTTGTTCTGATGCTTTTTGTAGATTATCAACATAAGTTATGTCATTTACA
TTATCAAAAAGGTTTGGAATCTTAAAGGTTCATCATCAGATAAAGTGTTTATTACTCTA
CCGATGGAACTGTAGTATCTATTTTATTAATAGGTTGTTCTAAGAATGGTCTATCTATT
TTTTCACCTATAATACTATTTTTTATACTTTCTAATAACCCCATTATTAACCTTTTTTTT
TAATATTTATGTACTAAACTTTTAAACTTTAGTTATACTTTAAACTTTAAGAATACAAAT
TATAAGATATTAATAAATCTTTTGTTTTTTGACTAAGATATTTTGTATACTTAATTTTCT
TTTTAATATAATTAATATCTTTTTTAGTTTCTAAATGAATTGCTTTAATCAGTTTATTAT
ATAAAGACTTCGGAAAAATTTCTTTTAATTTTTTTGCTTCACTTGGGTATACATACGGTG
TTGTATCAGTTTCCAAATAATTTGCAGCATTTCTTAAAAAATCAGCCAAGTTTTGAATTC
TATATCTTTTATAATTATTTTCCATTTTACCTAAGAAAATATTACAAGTACTGCAAATAA
CATTTCTGACTAAGCCAGCGCCTTGTACACCTAAATTTTCTTGTTTTTTACTATGTTTGT
GATCAAGTACAGGATTGAAGATCTTAGAACCGCATAAAGGACAAATTGGGTTTGATTCTA
CCATAGAATCTCTGAGTTCTTTTGCAGTTTTTGTATTTAGAACTATAAGTTCTTCTATTT
CATAAGTTTTTAGTTCTCGAGGTTTTAAATCTTGCATTTTTAGTCTTTATATTTTATGTT
TTTATATTAGTATTTGACGGTTCATTAACAACATCACGAATTAATTTAATATCATAAATAT
ATAGTTATTATACAAAATATTAAGAACATTTTCCAGGATAATGTATGATGCATATAAAAA
TCAATTAAAAAACAAATTATACCCACTGATATAGCTATAGCCATATTTAAGAAAGTTTTA
ATTAAATGGTTTGACAAGTGTTAAATCCTAGTTTAAACTTGATATTTCAATACCATTATT
ATAAAACAATTTTTTAGTTTTCTTAGAACTAATTAAAACATTTTCTGGTATTGTTGAGTT
ATCTAACGTAGATGACACCCAAGTTTTATTAGAACTATTATATGTCCATTTTTGATTGTT
TGATATATCTATTATAGTATCATCATACACACCTGATTGCGAATCAAAATAAAATTTAAT
ATTTTGAGACCAATTACCAAAACCCATTTGACAAGGTGAATTTAATAATTCTTTCAATAT
ATTAAATTCATTATCGGATAAAACACTAGGTTTTGTTGTTGGTAATGTATAATCAATTAA
TGAGTTGTCATCCAATGCTTGGTTTAGATCTGAAGTCCAACATTGTACTCTATTTTTAGT
TCTAGCCACTTTTAATAAATGTTTACCTGCTCGCCAAATTGTTTTAGGATAATTATCTGT
AATATTGCCTTTAGAAGCTAATAACCTATAAGTTGTATAAGGTTCTTCATTGTTGCCACA
ATAATTAAAAAATAAACCCCACGAAGTACCACCTGGTAAAGCGTTTAATTGTAAAGATCT
CACTGCGCTTAATGTATATAATTTACCATTGATCATTTAGCTGCTACAACAATACTTAA
AACATCATCATCATTATCTTGGCCCACAGCTGATATTTGCACACTATAAGTATCTTTGAC
GTCATTACTTAAAAACATATTATAATAACTTGAATTTATATTACTTGCTATAGCATCTTC
TGCTTCTATGTAAGACCATTTAGCAGCTTCTGCTTGACCAGCATCATCATCTAATTTAGG
ACCACTAGCAGAATTCATAATAGAATGTCTTACCCAATTATCAAAACATTTTTTAATGT
AACACTTGATTTTAACGTGGCTAAATCAGTCGCATTATCACATATGTTTAAAAATTGAAC
TGCAGGTGTGTTTGAACTTGAGTTATAGTGTTATTTACATTTTGTATTTGCTGAGTTAT
AGTGTTATTTACATTATTTTGAACTTTTTCTATTTCGGTTTTTAAGCTTTCTGCATCTAT
AATTTTATTAGCTTTGTTACCATCACCTAAATACACGGCATTTTTAGAAAATGTTAACAT
ACCTCTTTGGGTAGATTTATAATCTCCCGCTTCTATGATATCTTTAGAATCTACATTTAA
TCTTAACTCAGTCATTTTAAACCTTGCCCGTCATTTTTTGTTATTTATTTTCTGGTTCTT
TAGACAAATCTGATACTAAACCTAAGCTTTTAAATCTTTTTAATATTTTATTATACATAG
AATGTATTTCACTTGGTGTATTTCTTTTAAAGAAAATTTCTGAATTTAGATTCTCAATTA
CTGCAGTTGCAGAAATAGCGCCAGTATCTCTAGGCGTTTCGACAACTTGAATATCTGGGT
TAGCTCTTAATTGGTTTACATAGTCATTATATCTATCACTACCACATAAAACAGCATTTA
TATTCATTTTAGATTTATTCATAATACTAATAATATTTCCTGCTATGTTGTATAATTT
CAATTTCAGGAAAACAAGATTTTAACATTTCTAATCTAAGATCTTCAAATTCTTTAGTAT
CTTTTGAAGTTACCAAACAGACTACGCCATTATCGTATTTTTTAATCCATTTTTAATAA
TATTATAATGAGCTTAGTTAAAATTCTAAACTTGCCTAAGAATAAAAAGTTATTATTTC
CTTTAAGTCTTTTAATAACGATCATTTGATATTACCTTGAATATCATCTTTTATTTGAA
ATTGTGTCTTTTTAGGATGTGTAAAATTCAACTTATATTTCTTAAGAGCTTCTCCATACC
TTTGAAGTATTTCATTTAAAGAACCTTTAATATTACTAGCTCCAATAATATTTAAAGCTG
CTAATCTAACGTTAGCCCAATAAGCATTTTCAGTATCAGGATCTCCTTGATATTGTGAAC
GTGTTTCTGCTCTTGCTTAGGATCCACTTGATAAGGTTGTTGAATTTTTAATAAGAATC
CAGGATAAGTTAAAACATAACCTTCAGGTTTACCACCATACTTAGATTCCATTTTAAGAA
ACATTTCAGATATTTGTTGTATATATAAATCTATGTTTTCTATTTTAAGAATATTTTTAT
AAGTTCTAAAAATATCATTGAGTTCTTGTGATTTGATACCACGTTCGAAATTAGCGAAAT
TACCTTCAAATATAGTTCTTGGGTAATCAAATCCTAATTTCTTAGCATAAGTTTCTCTTG
AATCTGTATAGAAACCTTTTGGTTTTGTGAATAATCTCCCAAATTTGACTTCATAAGTAC
```

FIG. 17G. Continuation of (CJLB-15-1 [organism=Campylobacter phage CJLB-15] partial genome contig_1)

```
AAGGGCTATAAGCTAATAAAATTGCGCCCATCTTCTTATACTTATGTTGTAATGTAGGTT
TTTTCATCAAGAATTCTACAAAGAATTCATAATTTAAAGGTAAACTCTTTGAATCACATT
TTTTAAGAATATCGAAAATAAATGTAAATTGTGAATTATTAATGCTTTCAGGTCTTATTT
TGGATTTGGCTGCGTATTCAAACTCATCAGGATATATAATATTGGATTTGTATGAAACAA
TAAAATCTTGTTTATAATCACCAGTTTTATCTATATGAACTATAGTTACTTTAATACCAT
CATATTTTTCTTCTACTTTAACTTTATCATAGATAAAAGCTTCTTTTCTTGCTTGGCTAG
TTAAATATTTGTTTGCATTTAATATAGATATATCAATTTGATCTTTTTGCATTGTATTCG
CTTTTTGTTTTATTTATTACTAAATAAATATATCAAAAAATCATAAAGGTCTAATATGAA
TTTTAAAGAAGTTCAAAAAACACCTGCCAGAGGTTATTTTTGTATTGAAAGTTTAGATGC
TAATGGTAATATTATAGATAAATTCGAACAGAAAAATCTTATTACAAATGTAGCAAGAGC
TGAATTTGCTAAATTGATTGCTGGTATCAATGAAAGCAATGCTATTAATAGATTTGTTAT
GGGTACCAAAGGACACCAAGGTTCTGATATTTTAACACCAAAGGATGAAACTACTGGATT
TACTGCGTCTGTTACTGATATTTTCAGTGGTCAAGAACAAGGTGATATTAATAGAACTTG
GAACCAAGTAATTTTTACACCAAGTGGTAATATGGTTAACACTGCTGCTACAAACGTTCA
GGATGGTGCTAATAATAACTCTACAGTAGATATTACAGTTACTGGTATTGAGCAAGCAGA
GCCTGTAGTAACTTATACTATTAATATTGCGCAAGATGCTTTTAACTGTGCTAATGATGG
TGTAGTTTATACTGAAGCTGGTTTGTATAGTGGTACAAATTTAATTGCTATGGAGAACCTT
TAAAGGTAAAGTAAAAGAATCAACAGTTGCATTCAGAATTCAATGGAGTGTAATGTTTTA
ATTATTGGAGCTAATATAGCTCCTTTGATTAAGATTTACACATAGAATCTAAAATACTTG
CATATAATTTAGCTACTTCTTTATTTACCTTATATTTTAATTGTATTCTTTGATAGATT
CTGATTCAGCTAACGCTTTCGCAAATCTTATAAATTTTGGTTTATTTTTGTGTATCTCA
CTAAATTATATTGTGCTTCATCTGGTAAGCTTTTATATAATATATTAATATCATTAGCTA
ATTGTAAAGTGCTAGGGCTTGACCCTAAAAATCTACAAAACATAAAGCTATTAAAACCTA
AACTCTCATTATAATCTTTGTCTTTGAGACAGTTTGTAAATTGTTCGAATATATTTGCCA
TAATTAATTATATCCTAATTTTGTTTAAATTTTGATTAAAGGCTTTTAAAAATAACACTC
GAGTGTTAGATATACTAAAGGTATCAAGATCCAACTTCAAGTCTTCTATATAGATAATCT
TTGTATTCTTTAGTAGAGTTCTTAAAAACAAACATAGCCCACTTAAAAGAATGTTTAAAT
AAATGACATACAGAATCTATTGGTTCTCTACCTTCGAATTTAGCTTCTCGCATTTCTTGG
TGTGTACACCCAACATTACAATACTCGCGAATTTCGCACTTCATACATTTCTTGAATTTT
CTTGGGTCTGCGTATTTAGACATAAACTTAAGATTCTTTAGATTTAATCCTGATTCTGGA
CTATATAGAACCATTTTATTAGTTGATCTGTATCGCTCGCAAGGCCAGAATTTACCATCT
ACCGCATATAAACAACCGTTATTTCCTACGAAACAACCGTGGTCTCTTTTACCAAATCTA
GCACCTGCTAAAATATCTAAAGCATATAAATCAAATAATCCTACACTTGCTGGTATTCCT
TTATGTTGATATTCAAGTACTTTATGTGCTAATCTTTCAACTTCTATAGCAAATGTTTCT
ATTTGACTTTTAGTATAAATGTTATCACGAACTAAACAAAAATCGGGTCTTAAGAATTCA
TAATCGTTAACAAAAAACTCAAAATTTTCAGTCATTGTTGTGAAGTTCTTGGGTTGTATC
ATAACTTTACAGGTATCTGTAATGCTATGAATTAATGCTTTATTTTGCTTAAAATAATCT
AAAGTTCCTTCAAAAGTACCTTCAGCCACTGGTCGATTGTATTTTGCCATAGACCATCA
AAACTCAGTGAAATTCCACAATTATGAGCCTTTAAGAACTGAACTTTTTTAGGGTCTAAT
AATGCACCATTAGTTATCACAACATAGCTGGTACATCTTGGATCTTCTTGGAATTTTGGT
AAAGTTGCTTCAATCACTTCCCAGTTTAATAAAGGTTCCCCACCAAAGTATGAAATATGA
TAGCTATCTTTATCATAATAATCTAACATATAATTAATTCTATCAAAGAATTTCATAGCT
GTGTCTATAGACATAGGGTTTGGTGGCGTATGCGCACTATAACAATATTTACAAGCTAAG
TTACATTTAGTATCTAAGCTAAATTCTACTATTAGTTTACCTGCCATTTTAACCTTTGTT
TTTAGTTTTGGTCTTAGGTAAGCAAGTTAAACAAGCTAAAAAGTTTAGTTCTTCTTGGCT
TAAATCCGAATCTAAACTTGAGTTAGATTCAGAATTTAAACTAATCTTTTTAGCACAACG
CAAAGCATATTTTATACCCACTCTGATGTCTTGCAAATCTTGTATTTTAACTGAACTTC
GGCTTGATTTTTATCTATTAAATCTTTTACCACTGTCTTTAATCCTTTGTAAAATTGGAC
CCAAATAAGCATCAACTTCACTAGCATCATATTTTACATCATTTATAAGACGTTTTTTAG
TTTCTGCAATAATTTTGAGAACATTTTCTTGAGAAGTTTCTAAAATTAATAAAGAATCTA
CACTTAATTCTATAATAATATCTTTAAACATTTGCTTTAATTTGTTATATTCTGGTTTAT
CGGTAAACTTATACCCAAGTAATTGGAAAGCACTCATAAAATCCATTATTATAATATAAT
CACTTAAAAGTTCTTTATAATTAACAGAGTTTATTTTAGCACTCTAAACCTTCTTGATAAA
ATAATTCTTGTAATGCTTTAACAGCATCAAACCCATAATCATAATCACCAAGTTCTAAAG
AATGTCTAATCTTAAGATAATTTTTATAACTTGGTCTATCTACTTTATCAATTGTTTGTC
TAAATACAACCTTATCACCTAAATAAGTCAGACATTTATTGATATTATTAATATTATCAT
CAAAATCTTTACCATTGATAGAAACTCTGTACAACGCTGGTGTGTTGTAAACTACTGGGT
TATTTGCTTGTGCGTAATCCAAATCATTTTTATCAAATGTTGCTATTAATTTACTATATT
CAATTAAATTGTTTTCATAACAATTCATAGCTAATTTACATTGGAGCATTTGATATCTG
GAAAATATCAGTAGCTTCTAATTCACCCAATTGTTTTAAATAATCTAAAACTTTAGATT
TATCATCAGTTGTATATATTTTCGAAATTAAATACGCAGTTCTTGTTTCTATACCCTCTG
GGTTATTTTCTATGATATATTCGTATTTTTCGAACATTTCTACAACTTGTGAAAGTAAAC
GTTCATCAAATAATATAAAAATTATTTTTCTTAATTCTTGTTGAACCATTATATTCCTTT
CGAATCTTTAACTTCAGTTTCTACCTTTGGTGTAGATTTAGATCCATTTAAAATCTCATC
AAATAAAGAGTCTACTTCTGCTTGTTCTTTCTTATTAAGTTGAATCTTAGGCTCAGTTGT
TTTAGTATATCCTAATTCATCTAAAAATGCTTGGGATAATCCAGCTTGATCTAATAATTC
```

FIG. 17H. Continuation of (CJLB-15-1 [organism=Campylobacter phage CJLB-15] partial genome contig_1)

```
AATAGCCATAGAATTAAACATTAAAGACATCATACCATTGGTTTCTTGAATATATTCTGA
AGCTTGACTTAAGTGATAGGCTGCCATTAGAACTTGTTTTGTTTGATCTTCAGTAAAAGA
AAATTTTGGATTTTGTACATTCATATTCATTTTACACCTTTAAATTTAATATATTTATGA
TTTTTTATAACAATATCTAAGTCGATTATTAGCTTCTAAAATATTTCTAAAGAAATCTCC
AGCTTGTTTAGATTGTTTATTAGACTCAAACGTCAGTGCTTGGACATCTTTAGGAAAACA
TTTACCACCAAAACCTTTTTTACCATCTACACATAACTTAGCCATTAATCCTTGAGAATC
AAAATCTTCGAACTCATTTAATAATAATTCTATTTTTCTAACATTGAACCCAGCTTCATT
TAATTCGTGAAAGAATAATACCTTTAAAGCACCTAAAGCATTTCTAGCGTATTTAACTTC
CATTGCTTCTCTAAGACTACAAAAATCATAAGGCGTATCTATTAATTCAGCAATTTCTTT
AGCATACATAATATTATTAGCGCCTATCACGTGATATTTTGCTCGTTTCAATGATTCAAC
TTCTGTTAGAAATTCTGGCCAGGTTACAAATTTTAAATTGTATTCAGATTCTATAAAATC
TACATTACTAGGTAACAATGTTGATCTAATAACAACTAAACCACTAAAATCTTTTGATTC
TATGGTATTTAAAATTTCGTATAATGTTTTTGTGTCTTGATTTGAATCAATATTATCATT
TAACACATTAATGCATATAAAAATCTTGCTATAACAATTTAAACCAATTTCATTAAGATC
TTTATCATTAAATCTTGGATCTATTATATTATATTCAATGCCTTTAGAATCAAAATAATT
TCCTAAGCTTTGTCCGACTACACCAAAACCAATTATTAAGTTCATATTAACTCCTTAAAT
CTTAAATATAAATTCAATATTAGTTAAACCTATAGTATAGCCTAAACTTAAACAAGCAAA
CGCTGCTAAACCTAAAACAATAAAAACGAATAACTTATAAAATACTCCTGGTATTTTAAA
CACACTGATAATGCTAAGAACTGCTAAAAATAAAGCCGACACATAGAAGCCTAATTCAAC
TAATAATAACAAAAATTTAATAATAATTAAACCAGTTGTTTCTAATATATTATATTGTGC
ATAATTACTTAACATTATATACCCTCCTTAGTATCAAAAGCTAAAATATGTGCTCTTGGA
CTAAAACTAAATCCGTGCTCAGCACATTTTTCAAACACAAATGGTGTATTCTTAATCTGT
AATTCACGAGTTTCACCCATAGGCATTAGATATACTTCAGTATATATAGGTAAATCATAA
AGTATTTCTTTTATTTCAGTGTAGTCCGTATCCCAAGTTTCTGGATTAACTACAAATTTA
AGATAAGATTTAGGACAATTTTCAAGAATCTTACTGATTGTTTTTATATTAATTCTTTTC
TTTTTAGGTTCTCCTGAACAACTTAATTTAACTGACATACTGAACATAATTTCTTTTTGG
TATTCTTTAAAGAACTCAATATCCAAACTTGCATTAGTCTCTATTGTTATTTGATGTTTT
CTTGAAATATAATAAGCTAAGAAATCTTGAATAACATTAGTATCCCAATATAATAAAGGT
TCACCGCCAGTTAAAATAATATCTTTGGTATGTTTAATTTCAGAGTTTTTAAATGTGACT
AATGGGTCAATAATTGATGTTAAATCTTTGAAATTATCAAAGTATTTCCATTGTGATTTA
AATTTTGGAGATACTGCACGAATAGTATCACAACCTGTTTACTACCGAACCATCTGGAGCT
ACTGCAGAGCATCCAAAACCTTTACAAGTATTATTACAACCAGCAACTCTAACAAATACT
GCAGATTTTAATCTTGGCCCTTCACCTTGAATGGTGTCACCAAAAAATTCATAGAATGGA
ACTTTTTAGTTCTTGTTTTGAAAATCATTTAATCTCCTTTTTCATATTTATATAATATAA
CAACTTAAAGTTTTTTGAAATTGTTTTAGTTTTATATTTAAATTAACACTAAAGTGTTAA
ATATAGCTTATTATTTAATGAATTCTTCAATATAAAACCTAGCTCTATTTCCTAAATGAT
TTAGAGTTTCAGGATCATTAAAGTTAGCACCGATAAACTCATTAGTTAAAAATCTTACTA
ATACCTGGTGTTCAAAAACTGTTAAAGTCCAAGAATCTAAAAACTTACTGATATTAGCTT
CAGCTTCTAAAATATCTTTCATTAAAACTTCTGCATTTTGGTTATTCATTTATATCTCCT
TTTGTTTTATTATATAATAAAATAACTTAAAGTTTTTTGAATTTAGAAATTTAAATGTTA
AAGTGAGAAAGATCTAAGTTATCTTAGATCTTTATTTTTGAGTGTCTGTAGTCTGATTTG
AAGGCTGAGCTGAATTTTGACGATTTTCATAATCTGCTTTAATTGTTGAAAACCATCCTT
TATAATCCATAGTTACGAATTCTTTTGAGCGTTCGTAAAATAATTTAAAGCTTCTTGTA
AGATTTGATCTAAAGTTGCTTCATCATCTGTCATTTCCATTTCATCTAAACCATTTAAGA
ATTCTTGATACATTTTTTCATATTGATTTAATTGATTCACAATCTTAAGATATTCTTCAA
GACTAGCGATTAATTTATCATTATCAGTTTCAAGAATTTTAATATACATCTCTTCACGAT
TATCATCAGTTATAAAATAACCTTGTGAAGCAAATATATTATTAAGATATTGGAATCTAA
AATAAGTATATTGTGGTATTCTCGTAAAAATCTGACTAATTGCAGAAGTTAATTGGAAAA
TATATGAATTCTTAACTAAGTTAGCACTCTCGTCAATTTCCAAGTTTTCTAAAGTTAACA
CATCAATATCTTTATAGAATTTACAAGTTTTTTTATCTGCTAATGCTTCCAAAACTGCTG
TAAATAATTTACTATCAAAAACTTCTAATGTGCTAGACCCCGGTAACAAAAAGCATTGT
CTCTTTGCGCGGAAACAATCATATTATAAGCACCTTGATCTATATATGTTATATACATAC
TCATAATTTAATCCTTCTTAACGTTTTAACCATTTTGGGGGTATAATATCTGGTATTAC
ATCGAAATTAAAAGTTGAACTAGCACCACAACGTGAACAAGTTACTGTATGTTCCCTAGA
TTCAATTTTAAATATCATTTTTTCAAATGCTTCAGAAATCTTATCCATTATATTAATATC
TAACTCATTGAAGTAGTCCTTAATATCTTGGAAGCCTTTTGTGTTATCCCCATTGATAGA
TTTAATATGGAAAATCAAATCATCTGTGCTTGGTGAATCTGAAGTTCTTAATTTGTTATT
ATAGAGTTCGATATTTGAACATCTTGTAGTTCAATTTGATATCACCAATATCAATATC
TTGGATTTTACCTGATTTTGTTGTAAATAATTTGCTTAATTTAATTTTAGAATCAGTAGT
TTTTTCACAACTTCTGCACCACCAACTGTAATTTAAATCATCACCAAGATTTATAATTCT
TAACAATAAAAACAAATATTCTAATTCGTCGTTATTTAAAGCTGTCGGGTTTTCTAAAAC
ATTTGTAACAAAACATTCATATCTTGCTTTAAGTTCGTCTTCTGTGGAACTAGTATTTTT
TAATTTACTTTTATAGAGTTCTCTATCTTTAACTTTCCAATTACGAACTTTAATAGATCT
ATTACCTAATTTGATAGGGTTATATTCTAATACCATTAAATCTCCTTATTTGTTATTATA
TTATATAAATGCTTAAAATCTGCTTAAGTTTTTGATTACGATACTCTGATGAATAAGCCT
TTAGTATCGCTTATTTTACCAGTACATTTCCAAGTACCTTGCATATATGCATAAGTGTCT
```

FIG. 17I. Continuation of (CJLB-15-1 [organism=Campylobacter phage CJLB-15] partial genome contig_1)

```
GTAGATAAACCAGATCCTGCATATAAATTATTAAAAACTAAAGTTGTTTTTGAATCTAAT
ATAGCTATACTGCCAATTTCATTAATGCCAATATTAGTTAAGTGATTTGTGAATTGAGTT
CTTGTTATATTAATTTCAGCATTTCCTGAACCTGTGATATCAGTTCCATTTATAGTTTTT
ATAGAATCTAATTTCTTAGATAAAGCTAAATCATTTGAAGTTTTATAATTTGTTAAATCA
TTATTAACTTGGTTGTATTTAGTTTCTAAGCTTTTAATATCATCAGTAATGGTTTGTATT
TGTTCAGCAGCTTTTAAAAGTTTCTCCATATTTTCGGGATCTAATTGTTTTAGAACTGTA
GATTGCTCAATTATTTTATCACTAACAGTTTTTAACCACGTAATAATATTAGCAAAGTTT
CTATCTACTTCTTGGTGTGTTAAGACATCTAATTTAACATCTGTAGTTAAGTTATCTTCT
TTAGAATCTGTGAAACTTGGTAATTCTGGTACTTGCTGATTATTAATAATACGTAATCTT
ACGTTCACTGCTGAGCCTTTTTTGGATATTTATTTCCGATCTATAATATAATTTATAACA
AATGCAAAGCTAACTTCTCTGGGTTTAAATCTATATCTTTTGTGCTGCTAGGGCACCCAA
TAAACTAGTTAAATAGCCATTTCCACCAGTTAAGAATATCATAACACTCCTTTAATTTAA
AATTGATTTAAACTCTGTTTTTGATAAGATATGAAGGGATTTTAGATCTTACTAAAATCA
ACATTCCAAGGTGTCATTTCTATGGGTTTACTCATTTCATTCCATAATTGACTAAACCAT
TGACTACAAGTAGTTATATTATAAAATGAAAATACTTATTAAGATTTTCCATATTGAAA
TCGGTGCTAGATTCGGTATATTTCTTTAAGATTTCTAATTCAATATCAATAGGTATTTCA
CTATCCATAACTAACTTATAATTACGATTATAATTAAGTCTATATATTTCGTTAGAATCT
AAGAAGGCGTCTAAAGAACCAAACTCTTTAATCTTTTTATTTAAAGCAGCTTCACCAAAT
CTTTGTTTTTATAAACTTCAACATCAGGATAAATTTCATTAAAATTATTAATAATACCT
AGTTTTAAGTTTTCATCTAACTTATAGAAATCTAATTCGGTTCCTTGATAATAAGCTTTA
AACTCAGGTGTAAATTCCGAAAAATCCACAACACGTGGTACATTATCAGCAGCATCACCT
AAACAACAATGTATTCTTTCCCAACCTTCTGGATCATCATTAATGATCCATTTATTAGTT
ATTGCTGAATATTGTTTTATATCGCCTAATTTATGCAATTGTTTAAAGTCTTTATCGGGA
CTTAGAATTAAAATAGATTCTGCTTTGCAGAACTTCCTAGTTAATACACCAATGATATCA
TCAGCTTCAGCTCCTGGGACACCAATAGCTTTAAATGGTGTATAATCATTTAGAATTCTA
ATTAGTATATTAATATGTTTATAAACTTCTTTAAAATTAACTTCAGATTCTTCTCTTTGA
GTTTTCTTTGAGCTTTATAATCTGGATATAAAGATTTTCTCCAATATGGAACACTATGA
TCATCTATACAAATAACCATAGTATTATATTTACCTCTATAAAGTCTATAATTTTCTAAT
AATTCTTCTATAATTCTAAAAATAGTCCCACTTATGAATTCTTCAGTAATATATTTACCG
TCTTTTTTATGTGGATTCATTTGCTTAATACTAGTATGTAAAGCTCTGTGAATCAAAGAA
CTTAAATCATATAAAATCATATATAATCCTTACAATAATGGTGCTAATTCCATAATACAA
GCAGCTAAATTTAAGTTTCTATCTCTTGAGAAAGCACTTTGGTATTGATATTTAGCTAGT
ATTATGATAGCTTGTGGTTTATTATTATTTTGAATATCTAATTTTTTAAATGCATATTCA
TAAAAAGCATCTGGGTTTGTTAAACCATAAACTACTTTCATTAAATTATCGAAATCGCGA
GATCTAATTAAGTTAATTAAACCTTCAAAATCAGAATCTTTTTGAATGTCAAGAACTAAT
TTATTATTGAAATTACATTTTTGTAAACAAGCAATCATACCTCTTATACTTGGATAATAG
TTCTTAATAATATTAACAAGATCCTCATTTGTATAAGAAACTTTTTCATTATCTAAGATT
TCTTTTAGTAAATTAAAAGCTTTTTGAACAAGTTCTTGTTTATTAGAAGCGTGAACAACA
TCAAAATCAAATACTTCAAATCTGTTAACTATAGGAGGCATTATATTAGAAACATAATTA
CAAGTTAATATGAATCTACAATTAGCAGCAACTTCTTCAATAAGTGCTCTTGCAGCTGCT
TGACCATTTTGGCCAAAGTAGTCAAATTCATCTGCTAAAACAATTTTAGGTTTTCCATCA
AAGCTTTCAGTACTAGCAAATTGTAATATTTTACTTCTCATAGTATCAATACCAGATTCT
AATGAAGCGTTAATATATAAAGATTCAAAATTACCTTCTTTTATAATGGCTTGTGCTGTG
CTTGTTTTTCCTGTTCCTGGGTTTACTGAACTTAATAAAATGTTTGACGGTTTTCAATA
TATTTTCTAAATTTATCTAAATAAACATTTGGTAAAATTAAGTCATCAATTTTTTGAGGA
CGATATTTTCTACCCAAATATCGTGTTTTAAATCTACTGTCATTGAACTCCTTTTAATA
TTTTCTTAATTATAATATATTTTAGCTTGATACAAAATTAAAATTTAATTTAAAATTATA
ACATTAATATAAACTTACACCATAGTGGATTATTAAATTTAAATACGACCCAAATCTATG
AAATGATACAAATTTTTACAGATTTTATATCTTAAGAATGTTTAGCACACCTCATAAAAT
ATTTTATTAAGTTTTATTATTTCTTCAGATATGACATAATCTTCATCTTTTATATCACCA
TACAAAACATAATCCATATTAGAATCTAAAACAAGTTTTAAAATTTCTTTTTTGCTTTCT
AAGTCTAAATTTTCAAATTCTTTATCTTTTAAAATTTTATTTATATCTACTCTATAATCT
AAAAAAGCTTTAGTTTTTAACTCTTGATAAATATTATCTAATTCTTTTTCATCATTTAAA
TTTTGTATTTTTTCTTTATAAATTGCATTTAAAGGCATAAGTTCAGCATAAACAAAATTT
CCACCACCTTGCCAATTTATTGCTTTGCTGATACCACCTTGCTCACCTTCTATGACTTTT
TTGAGTCTTTCTTTTGTGATAGTTTCTATATAATCCATTGTTCTATGCCTATCCATTTG
CGTTTCATTTTATGGGCAACAGCTAGGGTAGTGCCACTTCCTGCAAAAAGTCCATTACT
ATGTCGTTTCGTTTGTACTTGATTCTATAATTCTTTGTAATAATACTTCAGGTTTTTGT
CCATTTTAATAGTTGTTTTCAGTCCTTCTTTACAAATGTTAATTGTAGATATGTCTGTC
CATAAATCACCTAAAGTATAATCAAGATTTTCATTTAAAAACAAACTTTCATAATTACA
CCATTATTCATATAATAATAATGTGTTTTACCTTTTGAATTTATTATTTTTTCAAAAGCC
CCTTCTTCCATATTAATATTAATGTTATTATCAGGTTTTACTAAATATATCAAGTTTTTA
AAATAATCTTGTTTATTTAATTTTGGGTCAAAATATTTTATTTCCCATTCTTTATAATCG
CTTCAATATTTGGAATGTATTTGTTATAAAATTTAATATATGATGATAATTTATTTTGT
GATTTTTTAATCTAATTTGTTTTAATACAGATTTATTATCTTGTTTTTTATAAAGTAGA
ATGTATTCTTTATTTTTCGGTAATTTTTTATGACAATTAGCATTTTTTAATCCTTTAGAT
```

FIG. 17J. Continuation of (CJLB-15-1 [organism=Campylobacter phage CJLB-15] partial genome contig_1)

```
TCGTTCATCTTGACTACAATACAATTAACAAAATTCTCTCTACCAAATATCTCATCCATA
AGTACTTTTAAATACGCTTGCTCGTTATCGTCACATTGAACGAATATTACACCATCATCT
CTTAAAAATTCCCTAGCAATTTCAAGACGATTTTTCATAAAAGTAAGCCAAGTAGTGTGT
TTAAATTTGTCGTTATAATTAAAACTAGTATTGCCTGTATTGTAAGGTGGGTCAATATAG
ATAAGTTTAACTTTATTCGCAAATTCTTTTTTAAAGAATGTAAGCCAATTAAATTGTCA
CCTTTTATTAATAAATTAGGATTATTTTAAGAGTGGTTTTCAAATCACCGTTGCCAATT
AATTCAAAACTCCCTAAAACTTTTGGACTGAAAAGTGTGTCTATTTCATTTTTATTTAAA
ATATTATCAAAGAAAATCTCATTATTTTTCTCACCTTTTGACGGAACTTCCTTTAATACA
CAATTTTTGGATGGAAAATTAAGTACTATATTTTCGATACTCTTTTGTCTTTTTACCATT
TTATTATCCTTTTTATTTATAATTAAAATCATAATAAAGATTTTAAATGTAATAAAGCAC
CGAAGCCTTTCTTAAAAACAAGTTCTATTTTAATATTATTTTGAAGCATTTCATTAAAAT
CTTTTTGTGTTAAATCATTTGGATAACATATAAAATGACTATTTGGTATCGAATTATATT
TTATCATTTTTTCAATTCCAACTTTGTCGTTATCTAAACAAAGAAAGGGCACTTTATTA
AATCTAAAACATTCTTTGCTATTGTGGAAGTATTTAAAGCTATTATTTGATTAGTTCTGT
ATATTTGTCTAAAAGACAAAGCATCGAGAATAGCTTCAAATATAAAAACTGGTTTATTTA
AATCAACATTAAATAGATTCCAAACTCCATAATTTTGATTCAATGTAAAATTAATAAATC
TTTTTTCAGTTAAAGATCTTGCATAGAACCCATAATAATTAGAGTCTTTAGAAAATGGAA
TTACAAGATAGTCTTTGATTCCATAATAAACACCATTTAAATTAAAAGATTTAGTTCCAT
TATAGAAATCTAAAAAGTTAATAGTATCATCGTTAAACCCACGAGATTTTAAAAACTCTA
TTTGTTTACTTGTATTAGTGTCTAACACTGAAGTTAAGTTAATATATTTGAACCCATTGT
TGGAGCTTTCAATGCTAGTAGAGCTAGCAATGTTTTCAATACTTGTATTGCTAGATTCAT
TAGAATCGCTAGTATTGCTAGCACTAGAATCAAAACAAGACTTCATAGTCTCTATTTCAT
TATTACTTTCTATGTTAGATTTGGTACTAGAATCAATTGAATTAATTTTAAATTTAAAAT
TCTCTGATTTATACGGCAATAATAATTCTGGTTTATAAATCTTTAAGAAATTACTTAAAC
TCATTTGAGTATTTAATTCACAATCACCATTAAAACAATGAACTAAAGTAACTCCTTGTT
TTTCATATAGGTGTAGTCTTTTAACAGATTTTTTATATTTTGAGTCTCCGCAAATTGGAC
ATTTAACAGCAATATCCAAAGAACTTTCTTTATAAGTTCCAGGAACTGCTAACTTAAAAT
ACTTAATATCTACAAAGTCTAACACCTATATCTCCTATTAGTAAACGTTTTCTAATCTTA
ATTCAAACTCTTGTATTAACCCATCACTACCCATTGTAGATAATTTTAAAATATCAGTTT
TACCCGCTGGTATTAATTCACATTCATTAATAGATTTAATTTCATTTTCATTTAATAATG
CTAGAACTTTATTATAGTTCTTATTAAATGTATGTTGATTATTTTGAGATTGAACTA
CATATTCCTTTTGTCTATGATAAAATTTTATTGTATTCATACTTAAATCCTTATTAAGAA
TTATTAAAATGTGCAAATCTTTTAAGATTTACCACTCGATCCAAATCCTTTAGACCCTCT
TTCTTGCTTAGCTTCAAAATCCTTGAATTCAGAATTATTAAGTTCGACGAACTTAAAACT
ATATTTTCTATGAATTAAAACTTGCGCATATCTTGAACCTTTTTCAATAACTATAGTTTC
TTTACCAATATTATTAATTTTAACTCCAAAATCTCCAGTATATCCAGCGTCAATAATACC
AATATGTGGAATTAGATCTTTTTTAAAACCTAAAGAACTTCTTAAATGAACGGTCATATA
AAAAGGATCTTTTTCATCAATTGAAATTCTTAATCCATTTGGAACAACTTTTGATTCTCC
TGGTTTAATTTCAGTTGTTTCGGTGCAAGTAATATCAAATGCTGCTGAAGTTCCATTATA
AGCAATTTCTGGTATTACGGCATCTTCATTTGTTTTATGTATATAAAGATTCAAATCCAT
TATTTCTCCTATTAATTAGTTTTAGATTTTATAGCTTCGATTATTTTTAATATCCTAGAA
TCTGGGTCTAATTTAGAATCTAAGTGAATGACGTTTCTAAGTCTACTTTCTTAAAAATA
TTGTTTATTTTAGATCTAAATTCAGGATCTATTGATCTAACACCATTTGATTCTAATGGT
ATATTTCAGAATCTAAAACAAAATAAAATCGAACTGTTTATAATATTTTATTAAAGAA
TCTGTGAATAATTTTAAATCGATGTCTTTGTTAATACCTGTATATACTATAACATCCAAA
ATACACCTATCGTGCACAGTGGGTGCATTTATATTTTTTAAAGCATTAACACTATAATAC
AACATTTGCAACTGTGTTGCTAAGTTTGTATTTTCTGAGTGTTTCTTGTTTGTTTAGCT
ATTTTATTAGAAAATGATTCTATGAAATCAAAATTCTTAAAATAACTATGTTTCTTCATT
AAATTAATTAATGTAGTTTTACCAGAACATTGAGCTCCTGAAATTGCTATTCTAACTGGT
CTCATTACAATCCTTTTTGTAGATCTTCAAAATTATATTTAATATTATTAATTTCAATTG
TATCATTTTCATTCATAATATATGTTTTACCATCTATTGTGACTTCATAGAATTTACCAT
CTTGTAGATCTTCAAATTCTGCGTTCTCAGAAAGTATTTGATATAATTCAGATAATTCGC
GATTGGCTGCAAATTTTTGATTAGTGACATCCCAAGAATTTAATGGTTTACCTTTAAGAA
CATAGAAGCTCGTATGTTCATTTCCAAGAACTTGTGATATACCACCATAAGCGGAAAAAC
CTTCACAAATACAAAGATATTTTGACTTTTTGTTGCTCTAAAATATTTTCAGATTTTA
ACTTCTTAGATTTTCTACACTCTTAAGAGCTTTATCTGCATTTAAAGCTTCTTTAACTT
TATATATGTCTATAATAGGATCTATAATAGATTTATTTTAAGAATTTATTGATGAATC
CATAATCTATGTTAGAGAATTCATTAAATTCTTTTACTGAGTTTGTAATTTTTCTTTAG
ATTGTGAATTAAATTTAAGATTTGGCATTCCATTAATAAAACAAACAATCATTAATTTAT
TTTTAATATCGCCAGGTTTAATACTTTTATATTTTTTGACTAATTTGTCTCTTATACCCT
GAACTACGTTATTCATAATAGTATCTATGTGAACACCACCGTCTGGTATTTTTAAACCAT
TGACAAAACTAAATTGTTTAAAGTCATCCAATTCATTTGGAATAATACCAATTTTAATAT
TTTGATTTTCGTATAACTCAAAATCTGGACTAAACATATTTAAATAATTCTTAAAAGATT
TAAAATCTATTTTCTTAGAATTAAATTTAAAATTAATTTCTGGGTAACAAATAGCTAAGT
TTAATAATCTTTGATAGATTATATTCTTATGAGTTTCATCGATTTCTTTAAGATTAAATC
TTTCTAAATCTGGTTTAAATTCTACTAAAGTTCCTGATTTTTTAGAAGCTTCTATATTTT
```

FIG. 17K. Continuation of (CJLB-15-1 [organism=Campylobacter phage CJLB-15] partial genome contig_1)

```
CACTATAAGTTTCAGCATTGTTTTTAGATTTAAAAATATATCTATTTTTACCATCGTCTG
TAATACCTTTAAAATTAATACTCCAAACATTTGTACAATAACTTCCAACTCCGTTGGTAC
CTATTGTTACACGATTAGCATCATCATCGAAGTTAGAACCTGCTTTAGCGTGATTCCAAG
CTAGTTCTGGCATATAGTGGTCACCTGATTTTATTACTGGTATACCAGTTCCATCATCTT
CAATGCTAACAGTATCATTAGATATTTTAACACTGATATTTAAGCCAGATTTAAATTTAG
ATCTAATTGCAGCATCTACTGAATTATCGATAATCTCATTGATTATTTTAATTAAACCGG
GTACATAATTCAAAGTAGTGTATTTAATTTTACCTGATTCTATAATAAAATCTTCTGTAT
TTGTAGAATCTATAGCACCTATATACATACTAGGTCTTTTTAGAATATGTTCTCTATCAG
TCAGTTTCTTAATCATTATATCTCCTTTATGATATTATATTGTAAAATATCTTAAAAGTA
TCTTAACGTTTTATTATTCACACTAATACAAAGCTTCAATACAAATATTTTAATTTGTTT
AAACTATCAGAATAACCACTACAATATAATCTACGTTTAGTATTTAAACCGTCAATATAA
TACCCGGTGTGTAAATCCCATTTTAAATACCAAGTATCTTTTTCATTTTTATGAATTTTA
AGCCCTTTGATTTGTGCTATTAAATTATAAAAAAATTCTTTCATTTCAATCTCCTTTGAG
TAATTATATTATAAATATCTTAAAACATTCTTAATTCAAACTAAAGTTTTAAATCAAA
AATCATAAAATCATAAATAATATTAAAAGAGGGTCTATGAAGAATCTAAAATGTTTCGTT
ATAGCTTTGTTAGCTTTGTTTATAATAGGGTGTGGATCTGATTATTCCAGCGATTAAAACA
GGCAAAGAAGTTCGTGGAACTTCGGATTCCAGAATTAATCAAGTTTGTGTAGACGGTGTT
TTATACTTATCGACGGGAAATTATGTAACACCACAACAAGATCTTAATGGTAGTTTAATT
GGTTGTTCTAAAAAACCAGAAGTTATTATTGATCAGCTCAAAGAAAAACAAAAAAATAAA
GATTTAGCTAAACTTGCTGAAAATATTAAGAATGATATTAAGGATGATATTAAGGATGAT
GTAAAATCTGAAGTTAAGTCAGAAGTCAAGAATGACTTAAAATCTGAAATAACTGTTGAA
ATCAATGAAAGTATTAAGAGTAGATTAGATAAAAACCATACAAAGTAACTCACACAAGCA
CTTAAAGACTAAGATTGTTTTTTAAGTGCTTTATTTTGTTCTTCTACTTCATCATTTATT
AAACTTATAAAGATTTCTCTTTCAAATGGATATAAATCATTTAAAATACCATCTATGGTA
AACTTACCTAGAAATGATAATCTTGTCAAACTTTTGTAGAACTCACCTATAGGATTCTCT
GAAAATATATTTTTATATATTTCTGGGTTTGTTAAATCAATTTCAAGATCTTTCTTACAA
TTATAACATTTAACAACTTTAATAAAGTTAAATTTAGTAGTATTAGCTTCTAAATACATA
TCTAATTCAGAATCACAATCCACAATATTAGATTCTAAGTAAGAATCACTGTATATGTCG
GTTAAATTTGGGCTATAAACGTCTTTCAAATCTGGGTATGTATTTGTATCAATACTATGG
AGATCTCCAATTTTTCCTAAATCTATGTTAGATTTAAAAGTACAACCACAATCACACCTA
GTATTTAAAGATAATTGGTCAGAAACTGAAGTTGCTCTTAATCTATAAAGTAAAAATAAT
TTTTCTTCCGGATATAAATCATAAATGTTTATATTAGAATCTATATAAGGTTCTAAGATT
CTTAAGTAAATGTCTAAGTTTAAATCATTTAGATCTTTACTGCATACAGTATCATCTGAG
CTTGCAGTTAATAATAAATCTCTTTCAGTTTTAACTTTGTAAGCTGTTAAAGTAAATTTT
CTATCGTTGTATTTAATATATTCTTTCATTTAGAATCCAAATTTTAATAATATTCCAAA
TTACTGAGATTCAAATCCTTATTATCAGTATTAGAATCTGGCTCTGTACCTAGACCATCT
GCAAAAGCTCCAAATGTTAGATACTCAAAACTTTTTCCTTCGGAACTTTTTAAAGAATCT
ACAATTTCTTTCATATCTTCAAAGTTCTTAACATTTGTAAAAATACCAAAACATAAACAA
CAAGACATTACTAAATCATCGTGATATCCCACAGCTGCTTGGTACTTACCATTATCATTT
AATGTAAATACCCCAAACTCCTTAATAGTTTCTTTGTCCACTAATAATAATTTATTAGCT
TGTGCTAACGTTGATACAGTTTGTAAAATAACATCCCTTGATAATTTTGTAGTTCTGAAC
CCAGGATATTTTAATCTTTGTTTTTGTTTATTGACGTCATAATATAAGTTTTCATATTCA
TAATCTCTTTTGAGAATATCAGCAACCACTTGACCAGAGCCTTCATTATTTCTACAATT
ATTAAAGCTTGATTGAACCTTAAACCATACTCATTGAGTAACTCTGGTAATAACATATAA
TCTATTTTAAGTTTTGCTGATGCTACTTGTCTGAAATTTAAATCTGTAGTATCAAATATT
TGGACTCCTGTAAAATCAGCACCTTCTTTAGCAGTATCAACACCCATAACGTATTTATGT
CCGGGTATTGGTTCTTCGTATATTAGTATTTTAGAATCCTTAATATTATCAACTTCTATT
GGTTCTTGTGGTTTATAAGTATCTAATATTTCACTAGGTATCAATGTCATCGCAGAACCT
TCAAATTTGCATTCGTATGCAGAATTCCAAACAACTAAACCACCGGTTTTAATTTGTTGT
TGCTTGAATTCTTCAGGATCATACTTAGTACCGTCAGATTTAAACCTTGGTACTAATCTC
CAATCTACCCTATGTCTTACAAATCCATTAATAGAAGTTTCTAAAGTGTCACCAGCACCC
TGCCAAATATCGTAAAATGATTCTTACCTTTAGGTGTAGATAAAATGACTAATTTTTG
AAAGCTAAGCCGGCTTGTGATGGTAAAACACCGTCAGTGAAATCTATCCAGCCCGCAGGA
TCTAAATATGCACATTCATCTACAACGATTATATTTGTGGACGTTCCACGGAATGCGTCC
GAACTTGGTACGTCCGTTAAAATCTTTATATTATTTTCACATTCTATTGAACCTTTATTC
CAAGTAACTGTTCCGGGCTGCATCCATATTGGTAAGCCTATCAACATTTCTTTGTTTTG
TCTAAGAACTCTCGTGCCGAGTTACCACTGTAAGCAACTATGCCTATGTTGATATCTTTC
TTAAAACAGTATAAATGCGCAAGTTTTACACTTGTTGTAGTTGATTTAGATGAATTATGA
CTTAAAACACCATTGGTGTAATAAAGGTGATAATGCTCTAAAGTTAAATCATAACAATGA
TCATATTTTATAAATGTTTTAGATATTATTTTAGAAGGTCCTGATTTTGTTTTAATTACC
TTATTTAAACAATCTCTAACATATAATTCGTTATCATTTTCGTCTATTAATACGTGTAAT
TCAGATGCTTGTAACTTGAATCCATTTTCGGTTTCTATCTCAAAAATATTGTATTTAATA
GTTTTATGGACTTCGCGAATTTTGACTTTACCTATAGGCGTTTCTACATATTTGTCTTTA
CATTCATAACTTTCAATAATTTTCAATTTTATCACCTTTCAATACATCTATATCGAACGC
TTCGGTAGTAAATAATCTGTTATTTCTTATTATATTAATTCTATTGCTATCAAATGATTT
TAAAATATTTTGTTCTTTTTTAAAGCATTCATATATTAAATCTTCGTATATGTCTATAAT
```

FIG. 17L. Continuation of (CJLB-15-1 [organism=Campylobacter phage CJLB-15] partial genome contig_1)

```
TATATATTGCATACCTTTAATAAAAAACTTACCAAATCTACCATCTACAGATCTTTTAGT
AATACCTATTTTATAAAATGTAATATTATTATCAAAAAATTTGACATAATAACATAAGCC
CTTAGTATTATGTAGTTCACCACCTGGTTTATATTTAGAATCAATATTAGAAGCTTTGGC
TCTGTTTATTCTAATCTTTTCTTCTGTAGACTTATTATTTAGGGTTGTTAACCATTTTTG
AACTGTGTTATTAAACCTTTTAGTACCTTCTTCAACGCCATATCTATATATAAACATATT
TAAAGACCTTGTGTTACAGCGTTCGTAATACTTTTGTTTTGCTATATCATTATCCCCATA
TAATTTGACATAATATTCATAACGCGCATTTTCATTTTCGGGGTGTTTTGTTTCGTTTG
GTGAGATTTCACACGTACATCATTAATTTTATTTTCAATTTCAGTTTCAGTTAATCCCTT
ATACTTAATAAAATTCTTAGAATTTGCTGAATACAAACCTTGGTGATTAAACCCAGGGTT
ATTAACCTTAAACAACGAGTTATTATAACGGTAAATACCTTCAGTCAAACCAAATTGTAA
TATTAAATATGCAAGCGTACCACTACCATTTATGTTGTTTAAAAGTCTTATTCTTTTTAA
TATGTTCGTGACATCACGAGTCATTAAAATTTTTAATAAATTAATAGGTAAAAATTCGCG
ATTTATACGTCTTGTGTGGTATATCTCCATTAAGTTATTTTGTTGATTCCGTGTTAATTT
CACACCACTAAGCCCTAGAGATTTAATATATTTCTGGAGTTACTTTAGTGTTTATTTT
TGTTTGTAACTTACTTAAATCTTCGTATGGAATTAAAATTGATTGTGTATTATGTTTGAG
TATAGTACCTGTATAATTTATTATATAAGCGCGTTCTATTTTACAAACATAGGTGCAATT
AAATTTTTTACGATTCACTACCACGCTTACACTCCTCAAATAATTCAATAATAGTAGTTT
CATTACCATTTACATTTATTTTAGTATTTGCTTCAATGCATTGACGAGGCTGCATTGATA
TCACGTTTTCGATAGAATCGTCGCTCAGCAATTGTATAAATTCATCCTGGTATGGCCTAG
AATCTACGAAATCAAAACCTTTTGGTGTAGTCATTCGCACATAATTTCTTAAGAAATAAA
GTGGATCATTCGCACATTTTTCAAGCTCGCTGATATGTATCGGACTTAAGTTTAATTTTG
TGTAAGCTTTTTTAAGACCACGAGACCCATTATAACTAATTCTCGTATTATACGCATCTA
AGTAATAGTTATCAGAGTCTTTAGGTAAATCTAAGATTTCTAAGGCTTGTGCTTTTCCTA
GTTTTCCTTGAGCTCTAATTGTTTCTAAGAGTTCGTCTGTTATTTCATTTTTATGTGTTT
GAAAATATTTTATTTCTTCTTTGCTTAACATTATAAATCTTTTTATGATTTTGTTTTATT
ATATTATATTATATATTAAAATTAACTGATTATGGTTTGAAATTTGAAGCTGAAGAGCTA
ATATTTTAGTATTTTAAAATGTTAGCTCTCGAGTAAAATTTGGATTTTAAATGTTTAAGA
AATCGAATCTCGATCTGGGTTATATGCATTATTTGCAGAAAATTGTGAAGCTCTCATATC
CCTATATTTTTCAATAGAAGCTAGTCTTGATCTAATTTCTGGCATATAGTCGAACTTATC
AATTAGAATAGCTCTGAAATCATTACTTGCTTGAGCCAGCCCTTTATTTTGAATTACATT
CTTTACAATATCGTCATACATTTTTTAACTCCTGTTATAGATTATTTGTTTTTATTTTTG
TTCTTAAGTATTTCAATAAACTCTAAGAAATGTTCTTTAAGAATAGATTCTTTTAGTTTC
GAATCTTCAGTATTATCTTTAGAATCGTTTGAATCAGAATCTTTCGAATCTTTAGTATCA
GCTTTGCTATCGCTGTCAGAATCTTTAGCACTGTCAGAATCTTTAGATTCTACTAATTTA
CCATCCACCATTACAAATTCTTTTTGTGATTCATATATAGATGTTCCTTCCATAGTAGCA
TTATAATCGCTTGGTGCAGATACTAAATCATATGTAATTAAATCAAATGATTCGACAATA
CCATTTTTAACTCTGCCAGAACCTCTACTAGATACAGACAATTTAATACCATTATCTATT
AAGGATTTTAATTGGTTAGCTCTTGGATTATCTAACAATGTAGCTTCACCCATAACATAC
TTGCCGTTGATTTCAAGTTTATTGATGGCAGCAACTGCTTCCATAGGATCAACTGTACCT
CTTTCAGGATGTTCCCACTCACAAAGTCTATTAATAGAACCGCTTTTTATAACGTCTTGG
TATTTTTTAACATTACTTTCCCAGAGTTCTTTTGGGTAAATTCTACCGTTACGGTTTTTT
TCACCTATTGTTGAAAAAATACCAGCAATTTTATATTTTTTAACTTTTTCTTTTTGTCG
TTAACTGATTCTTCGATAAGTACATTAGCATCGTGATATTCATAAAGTAATTTAACTTA
TCTGACATTTAAAATCCTTGTTTTTTTGTATTTATTTATACACTTGGTTTTGAATCAGA
GTTAAATCCAGGATCTACAGGCTCTGGATCTCTACTAAAATCAGAATCAATAGTCTCAGA
AGTTATATCAAAGACAGATTCTCTTAATATCGCTGTTTCGTTAAAATTGAAATCAATATT
GAAGTGGTTAGTATCATCTAAAGATATTGATTCACTAAAAGTTGCGGGATCTGGTTTAGA
TACCAAATTAATAGAATCTTGTATGCTATATTCTGGATCATTTTTTATTGGTTCGTTATA
TAAGAATATATTACCTTTATAAGATTCTGCTAAATCTAAATCAACTTTAAGTGGTGATTT
ATAAACTAACCCCCTCATTTTAATCCTTAAGCTTCAATTTCTTTAATAATAAAATCTACA
GTTTTAATTCCAATTTCTTTTATTTTAGTATAGAGTTCGTTGCAAGCATCTGCTGAACTA
GAAACAATGCCAGCACCTCTGGTTTTACCAGGTAAAATACAACCTTCTGTATCTTGTGGG
TAATTTCCAATATGTATTCTGATTAATCTATTGTTAAAATTAGCATCGTTTGGTCTTTTA
ACCCAAATTGCTATGGTTGATCGATCTTTATTATACCATTGTGGGTATTTTTAGCTAAT
CCAACATTTTTAGAACTAGCACACCATTCTAATTTATAAGAACCTGCTGTTATACGTTTA
TCAGTTCCTGATTCTTCTGTGCTTGGTCCGGCATTTTCACAAGCAGCACCTTTCCAAAGA
ATTTGACCATTGTCATCATATAATATTAAATCAGATAATGTAGATCCTTCGATTTTTCT
TTACTTAGTTTTCTAACATTGGTACATTCTTGTATTCTTTGCAATATTAATTTGCCATT
ATGATCCTTTTATGTATTTATTCACTTATTTGGATACTAAATATAGTGCTAGATCTAAC
ACTCGAGTGTAGATTTTTAAACATTAATAGCTTGAATTTTTTTGTCTTGACTTGAAGCAC
TTACCGGTTGAGGTACCAACATAAATTGTGGTAAAGAACCTTTAGATCTTAATTGCAATT
TCCATAATTTACCGTCTATTTTAATATTCCATTTGATATCAGCATTACCATCACAGGAGA
CAACACAGTATTCGATTTTTAAATCTGAAGGCAATGTATCAAATACTTCTAAATGATTTC
CTGAAACTTTATAAAAATTAGAACTTAATAGAGATCTACTTAAACAATTACAAACAACTT
CAAATATAATATCATTAAAATATTTTGAACTCATAGATATAAATGCTAAACTCGGTGGAA
ACCCTTCGAAAAAATTAGCAGCTTTAGCATTGCTGGCAATTTCATCATAAATGTCAGCTA
```

FIG. 17M. Continuation of (CJLB-15-1 [organism=Campylobacter phage CJLB-15] partial genome contig_1)

```
AGTTAATGTTATTAGTTCTAACTCTAATGATATCTGAATTTTTATGCTTCTTTAATTCAA
CCATACATTCTTTAAAAAAATTAAAAAAATTATCATCGAATGATTTATATTTAATACTTT
TAAAATTTGGTAAACCATAATTACCTGATAAATTATTCAAAGCATAGGAACCACCTAAAG
CTTCTTTAGCAGATTTCTTAAGACTTATAGGTATTATATTATCAAATCATTAATTTCTT
TGTTAAGTTCTTGATAAGTTTTGTATGATTTGATTTTATATGTAGGTTTAACCAAAAAGA
AATCTCCAGGATTCCATTTATCCTCTGCTAATTTAGTTAATTGTTTACCTTGCTTTTTAA
GATCATTAAAAACATCAGTTTTGTGGTGAAATTCATAATTTCTAAGGTTTTGTTTTAAAA
TAATTTCATTTAGAATACATTTAGATGCATCTTTACAAGCTTTATCCCAATCTGGATTTT
CAAATAAAAATGTTTTAACAGAATCTAATGGCGTCTTAGTCCTAGTATTTTAACTTGAG
TTTCATTATAGAATTTAATATCGGTTAATTTAGTATTTAAAAACATATCTAAATAGTATA
CAACGCCACACTCTGCTAAGTCGTCTTTGTTGTCACTTTTTTGACCTTTTAATGTGATAC
CAGATACATTAGATTTATGAATTTTACTAAAAGGTGCTTCACCTTTCTTTCCATTAATAG
AACCTTTAAAGTTTTTATATTTTTAGTATCTTTGTCATATATCAAAGTTCTACAGCAT
CGACATTCATACTTTTAATTAATTCAAATAATCTAATATTTGTAGGATCTTTTAAATCAA
AACTAAAAACACCAAGATCACCTTCTAATAAAAAATCATTTGTTTCTAATTTCTTAAGAA
AAGGTTTAAAATATTTGGTTTCTTAATAAATTCATTTACACTTAAAGGCATTTGATTTG
TCCTATCTGAAATACTTTGTTTTCAATATTTAATCCTGTTTTGAATCTCGAATTCTTTTA
ATAACATCTGCTGTTGAAATAACTTCAAAATCTTCTTTAACTTCTGTACTTGGATGCAAT
GCATTAATTTTATTAATATTAATTAAAATATCAGATATCCCTTTATAAGAATCCGTTAGA
ATTTTTAAAGACTTGTTTGAAGTTTCAATTAGTTTACTATAAGCAGTTACTAAGTCTGGG
TTATATCCTTCAATTTCCATTTCTTGAACTAGGTTGTCACTCATAACTTTTAATTGTGCT
ACATTAGCTAAAATAATTTGTCTTAATTTATTATAATCGTCTACTACTAAATCCAATTGA
ATTATTTCATCTGGATTTAATTGAGCTTTATTAATTTTAGCTTTCTCAGAATCGAACTCA
ACGATTTCTGCTTCTATTACTTGTTCCATTAGAACCCTTTATGATTTTATAACAGCTTCT
TTTAATTTAATAGATTCAAAATAATCGATCAATTCGAAATTATCGAAATTAAAGGTAAGA
TCAAAAGTTTGTTCAGCATCATCAGCATTCGATATTAGTTGTAAAGCACCTAAGTTTGTG
ATTTTACAACCATACATAGTCATACTGACTAACGATTCTCCTTTATTGTCGGTTATTTCC
ACACCACAAGTAAATTCTTTTAATGGTTCGATATTACCATTATTTGGGTGAACTCTATCG
AAAATATATTTGATTAATTTTGTATATATTTTGAAATCTTCTCCCACAAGGAAACCTACA
GTTACTGGGTCATAGTCTATGTGGTCACCACCAACATAAATAGTTTTACCGCCGAAGTTG
GCTTGACTTGGGTTCAGACTAAACCCCGGTAATGCTATATTTTGAGCATATATCCATTCA
TCGCCTAGAAAAGGTAAAAATATTTTATAATTACTAGATTGCGAATAGCTATTACTAGTC
ATATATTTCCTTGCTTGTTATATTATATTCAAGTATTTATTTTTTATACTTACGGTATTA
TATTAAAATATAACTGAATTTTAACTGAAATGTAGTCATTGTTATATACTATTAAAAAGC
CAAGCATTTTTTATACTTTTTAATATTGCTTTAAGTTTTAAGCATATGCTAGGATATATA
GCATTGTTATATACTATTAAAAACCCAAGCATTTTTTATACTTTTTAATATTAGTTTAAG
CTTTGCTTTAAGTTTTAAGCATATGCTAGGATATAATACTATAGTATATACTACTAAAAA
CCTTAGCATTTTTTATACTTTTTAATATTGCTTTAAGTTTTAAGCATATGCTAGGATATA
TAGCATTGTTATACACTATTAAAAACCCAAGCATTTTTTATACTTTTTAATATTGCTTTA
AGTTTTGTTTTGAATTTTAATGTGGGATTCCAAGTCCTTGAAATTTTTTTTTAAAAAAAT
TTTTACTCTTTAATATGATATATTATAATATAAAGCTTTTTAAAAAAGTTTTTTCGAGTT
TTTAAAACCAAAATTTTTAGTTTAGATTTAAAACTTAAAACAATATTAAAAAGTATAAAA
AATGCTAAGGTTTTTAGTAGTATATACTATAGTATTATATCCTAGCATATGCTTAAAACT
TAAAGCAAAGCTTAAACTAATATTAAAAAGTATAAAAAATGCTTGGGTTTTTAATAGTAT
ATAACAATGCTATATATCCTAGCATATGCTTAAAACTTAAAGCAATATTAAAAAGTATAA
AAAATGCTTGGCTTTTAATAGTATATAACAATGACTACATTTCAGTTAAAATTCAGTTA TATTTTAATA

>CJLB-15-2 [organism=Campylobacter phage CJLB-15] partial genome contig_2
AATCTTTAAGTAATTTTAATAAGTATAAAAAATGCTTGGCTTTTTAGTAGTATATACTAT
AGTATATGCTTAAAGCTTAAAGCTAAAGCAATATTAAAAAGTATAAAAAATGCTTGGCT
TTTTAGTAGTATATACTATAGTATATGCTTAAAGCTTAAAGCAATATTAAAAAGTATAAA
AAATGCTTGGCTTTTTAGTAGTATATACTATAATACTAAAAACTCACTAAAAATTAATAA
CATTTAAGTTTTAATAATATATAATAACAATATTTCAAATCAAAAGCATTTATATGAAA
GATACAGTTTTAAGCCTAAGTGGTGGTTTAGACTCAAGTGCTTTACTATTTGAGTTTAAA
GATCGTATTAAGATTGCTGTAAGTTTTAAATACGGTTCAAATCATCAAGAAAAAGAACTA
GCAGCTGCTAAAAAAGTCTTGGATGAAGTAAATAAATTAGGTGCTGAAATCGAACATAGA
ATAATCGATTTAACAGAAGCTTTTGGAACTTTTAAAAGTGCTTTATTAAGCGGTTCTAAA
GCAGTTCCCGAAGCTGGTTCAACTGAAGTTTCAAATGTAATTGTTCCGTTTAGAAATGGT
ATATTCTTAAGTATCTTAACGGGTATAGCAGAATCAGAAGATTGTAGATTTATTGCTATA
GCAAACCACAGTGGTGATTCTAACGTATTTCCAGATTGTAGATATGATTTTATCGATGCT
ATGTTTAAAGCCATTGGTTCAGGAACCGAAGACAGAGTTCAGGTATTCGCACCGTATACA
AATATTACAAAAACTGATTTGACAATCCGTGGTATATCTAATGGTTTAAACCCAGATTGG
ACTTACAGCTGCTATAAAGGTGGTAATAAACCTTGTAATGAATGTTCTGCTTGTGTTGAT
CGTAACAAAGCAGTTCAAGAAGCCGCAACAGTTCTAAAACATTTTAGTTCTTAATTTATA
GACTATTAAGTTTTAATATATTATAATATTCTAATCGTTTACACTAAAGTGTAAAGCAAC
```

FIG. 17N. Continuation of (CJLB-15-1 [organism=Campylobacter phage CJLB-15] partial genome contig_1)

```
AACACTTTAGTGTTAATTTTAGAACTTTAGTGTAAGTCACTAAAATTAGAACCAAAGGAG
AAATATGAAACTATTCGAAGCTTGCTTCAATTTAGGTAATTTTGAAACTTATGAAAGATT
CTATAATACAGAAACTAATAAGTCTGAAATTCAAAAAGTCTTTCTTAAGAATCAAGTTTT
TATTGAGGATCCTAAAGGAGAATATACATTTTTATTAGATCCAAATATTAAACTAACAAA
AGTTCAAGCTAATCAAGCTAAAGATTTAGAAACTTATGGTAAGACTAATATTGCTGCTGA
ACATATTAGGCAGAACTATTGGAAACTCAATGATTCAAAATATAATAAAAATATAAGTAT
TTTTTATCTGGATATAGAAACTACGGCACACTCACCTATTGACACCGAAGCTTGTAGAGA
AAGAATAGTTTCAATTCAAGTATATCATAACTTAACGAATACAAATTATATTTTTACAAA
TGAGTTCTTTGACACCGAAGCTCATACTAAAGATTCTAAATATATTTTCGATGATAGGAC
TTATGATTTTAAACTTAAATACTACCAAGTAGAAGGTGAACATAATTTATTAATTGCTTT
ATTTAAACTTATAGAAGCTTTAAAACCTTTATTAGTATTAGCTCACAATGGTGAAGGTTT
TGACTTTGCTTATCTTTGGAGAAGAACTGAAAGTTAGGTTTAACTGAAGGATTTAGTCC
ATTTGGAAAATCTGAATTTCAAATAAATGAATTAGATAATGGAACTAAAAAATACAGTAT
AAAAGCGCCGGTGTTTTCTATATGGATACTATAGATATCTATAAGAAGTTTAGACTTAA
ACCGAGAGAATCTTATTCATTAGATTATATTGCAGAAGTTGAATTAGGTGAAAGAAAAGT
TAATCACGATTGTTTTAAAACTTTTGATGGTTTTAGAACCGGTGAAGGATTTATTAGACC
AGAAGTTGAACCTAGCAAAGAATCTATTTTAGAATATAAACTTTATAATGCTAAAGATTC
TGAAGAAATAAAAAGAATTTCTAAAGAATATTTTATTCATTATAGTATTATAGATACATA
CTTATTATATAGAATAGATAATGCAATTAAATTATCTGATATTATGATTAGTATTGCTTC
TATTATGGGTATTCAATTACCTCAAACACTTGGAACAACAACTCCTTGGAGTACATTTAT
CCGAAATTATGCAATGCAAGATAAAATAGTATTACCAAATCCAAGTGAATTTAGTGGTGA
TGTAGAATTTAAAGGGGGCTTTGTAGCTGAACCATTAATTGGTAGATATGATTGGGTTTT
TTCAGCGGACGTTACCAGTATGTATCCTAGTCAAATTATGGCATTTAATTTAAGTTCTGA
AACATTTATACCATTTTATAAATTGCCAAATGATTTACAAGAAGCTATAAATGAATTAGA
TCTTAATGAAGATGAACAATATCATATTAATAATTATTATAAAAATCCCGAAGCTTATAA
AAAATACACGGATTTACTTATAAAGTATAATTATTGCGGATCATTAACTGGATCTGTGTA
TGATAAATCTAAAAAAGGTATTCTACCAATATTAACAGAATTAGTTTTCAATCTTAGAAA
AGCAGCTAAAAAAGAAATGTTAAAATATGAGCAAATGGCTGAAGATGCTAAAGAACCTGA
ATTAATACAAAAATACCAAGCATTAGCAACTGAATTGGATGTCAATCAATTGACATTTAA
GATTTTAATTAACTCATTATATGGAGCTTGTGGAAATAAACATTTTATTCTATATAATAA
AGAAATCGCTAAAGCTATCACAGGAAATTCAAGATTTTATATAAATCTTATGAGTAAAAA
TATCAATAATTTTTTGTGCGATTTATGTGGTTCTGGAAATTATATAATTTATAATGATAC
TGACTCCGTTGTTGGGGATTCAATTATTAAAGTAAATGGTAAAAATATTAAAATAGAAGA
TTTTTATGATTCTATAAAAGTTGATCCTATTGTTACAAAATCTGGTAATAATGTAAAATT
AGTAGATAATTGTTTTACAGATTCTGTAAATAAAAACTTACAAATTGAAACTAAAAAAAT
TAATTATATAATGAAACATAAAGTTAAGAAGGAATTTTTTAAAATAAAAGTCAATAATAA
AGAAGTGGTCGTAACCGAAGATCATAGCATTATGGTTTTAAGAAATTCTGAATTAATTGA
GGTTAAACCAAGAGATATTAAAACAGGAGACTTAATAATATTAAATGACTGAATCATATT
TTAACGATTTCAAACAATTTTTAAAATCTGAAGTTAAAAATGGTAAATTGCCTTATACAA
CTATGTACAAATATTTACTCACGTTTAGCGAATACAGACCTAAAAATTTATACGCGCGAT
ACCGACGTTTACGCAAATACACTAAGGGTGGTATAACGAAATATAAATGTTTGCTGCTAT
ACGGTAAAACCGGAGCGCTAAAAAAATGGACAAGTTATTGTAATAGACAAGCATATACAA
ATACAAAAGAATATAAAATGAATGTGCTGGGTATGAGTGATTATGAAGTAGATTGTTATA
ATCAATCCAGAGCGGTGACTAAGAAAAATTTAATAATGCGTTACGGTGAAGACCTAGGTA
ATAAAAAATGGGAGGATTATAGACATAGACAGGCATACACAAATACAAAAGAATACTTTG
TTGAAAATATGGTGAAATTGTAGGCGAACAGAAATATTATAACATCAACGCAAGTAAAG
CAATCACTCGTGAAAATCTTATTAAAAAATATGGTGAATACCTAGGTAATGAAAAGTGGC
TTAATTTTTAAATAACAAAAGTGTATAGGTTATTCAAAAATGGCTACAAAATTATTTG
AAGAATTGGAATCCAAATTAGGAAATAATTATACTTTTTATTATGAACCAAAAACAAGAG
AAATAGTATTAAATTCTAACGGAACTCCGTATTTTATGATTGTTATATCAAAGAATTAA
AATTAATAATAGAATTTAATGGTGATGTATTTCACGCAAATCCTAAAATATTTAATAGCC
ACGACAATCCCAATCCATTTGACAAGACATTGACTACTGAGGAAATATGAGAAGCAGATA
ATAGAAAAATTAATCACGCTTTAGATAATGGCTATAATAATTATAATAATTTGGGAAAACG
AACTTAGAATTAATACAAATTTAAGTAATATTATTATAGAATATATAAAATCGAATAATT
TATTAGATTTAAAGGAGTTTATTTGATAGTAACTGAAAATTTCCAAGTAGAATCTTTAGG
TATCCAAGAATTAGATGTCTATGATATTGAAGTAGATTCTAATCATAATTTTTTGCTAA
TGATATATTAGTTCATAACAGTTGTTATGTTCAAGTACCTAATATTATAAACGAAAAATT
ACCAAAAGACCCACAATTAGCAACAGATATAATTGATAAATTTATAGAAACTAAAATACA
ACCGGTAATTAACACAAGCTCACAAGAATTAGGGTCTATTTTAATGCTTTAGATGCTTC
AAGAATTTCTGCAAAGCGTGAAGCGATTGCAAGCTCTGCTGTTGTAGCAAAGAAAAG
ATATTTTATGAAAGTTATAGATTCTGAAGGTGTTAGGTTCAGTGAACCTTATCTTAAAAC
AATGGGTATCGATATTGTCAGATCCAGTACACCAGCATTTTCTAAAAAAATATCTTAAAAA
ATCCGTCAATATTATATTAGAAAGTACAGAAGAAGAACTTAAAGAATGGTTAAAAAATAT
TAGATCATTATACCTGGGTCAAAATCTAATGGATATTGCTAAGATATCTTCGGTCAGTTC
TAGCAAATATAAACTTGGTGTGGATAAATCCATACCGATTAATTCAAGAGCTTTCTTGGT
ATCAAATCATTATATAAATAGTCTAAATACAGGTGAGTTTCAACCATTAGAATTAGGCGA
```

FIG. 17O. Continuation of (CJLB-15-1 [organism=Campylobacter phage CJLB-15] partial genome contig_1)

```
AAAGGTTCGTATGCTATATCTTAGAGAACCTAACCCATTAAAATCTAACATTTTTGCTTT
TAATAATGAAAAATTTGCAAATGTATTTAAAGATTATATAGATTGGGATACTAATTTTAA
TAAGTTCTTTTTAAAACCACTTGAAATAATGACAGACCCACTTAATTATAATTTACATAA
AGAAACTGAAACTTTGGAGGAATGGTAATGGATATACTCGGTGTTTACAATTATATTAAA
TCTTATATTTTAAAAGGATACAATTATTTAAAAAGTAATTATTCTTTTATTACTATAATG
ATATTATTATTTGGCACTATTTGGTTAGCTTATAATTTATTATTTGCTGTAATTTTTATT
GTTTTCTTTTTAATAGGTTCGTTTGTTTTATTTGCATATCTTGATTCTGCAATAGACGAC
ATTAATTTTAAAAAATAATGATTAATAGGGCTGTTATAACTAGGTGTTTCAAATATAATG
GCTCTATGTTCGATGCTTTTGAATATTTTTATAGACTTTGGGAATTAGATCCTGATACTA
AATTTGTTTCATTGTACAGTCATATCAATAAAGATTTTTTAAGCATTAAATACAACGTAG
ATCCAAAATGTTTTGATAATTTTATATATAAAGATCCATATGATTTAGAATTTAACAAAG
TTTTATTATTCGATACTCACGATTTCTATAATATAAATCACCCAAAATCCCTTAAATTAA
ATAAGTTATATGTAATCGCTAACAGCACCATAGGGTTCAAAGAAAATACTGAATATTTTG
ATGAATATTTTTAAATAAAAATTATATTAATAAAATATATTATCAGATTCACAGAATAT
TTAATCATTTAGATAATGTATATGTTAATTGTATGGATAATTGCTGCAAGAGTTATTTAA
ATATTCTTAAAATGTATCCGAAAGCAATTATCAAAGATCCTAAAAATAATTTTCAACATT
ACACAATGACTAAGAATTTTATACCGGATATTTACAAGTATTTTAATAAGTACATATATG
TTAAAACTGGTAGAACTTATGATAGACACCCAAGACAATTTACAGAATGTGCTTACCAAG
GCATTGATTGTGAATATATTTCTGAAGGTTCTAAATTCACAAAAAATGATAATTCATATT
ATAGATTCGAAGATAGATACGATTTTGATAAGAGATCTATATACAACGATATAGTTATAT
CTAAAATGCTCGATTAATACCAAAAATAAATAAGTTAAAAGGTTTATGATGAGATTCTTA
GAATACTATAGATTAAAAGAAGCTGAAGAATTTAGTAGAAATGACATTAAAACCATCGTT
AACAATACAACAAAGTATTCACAAGAATTCTAAATGCAAAATTCTATTTAGTTAATGAA
GTTGAACATTGTACTTCAAATGGTTCAAAATTAATAGGTATTAGATTTGCCAGTGCTGAT
GGCTATATGATAAGATTTAATTACACTGCAAAAAACGCTAAACAAATTCAGAAAATTAAC
AAAGCTACTAAAGAATTTCACGTTGAAAGTATAGATTTTTGGAATCCAATAACTGGACAT
TTAAATAAACCAAGTATCAGAGTTTCTGTGATTTCGAGTTTATCTCTCAAATATTTTATA
GAAGACATTACAACTTCTATTAAAAAGAATCTTTTAGGAACTTTTTATTATAAAGATCTT
AAATTTACAGACGATATAAAATCAGAAAAATATGTGATTAACCCAGATGAAATCATATTC
ATTAATACTAAAGGATTTAAAGAATCCAATGATTTTACATTAAATTCACAAGATCCTAAT
ATTCAACTTATACTTAATAACATCAAAGAAGTTTATGGAAGACTTGATGAAAAGAATCT
TAACCTTATCAGATCTTAGGCAATATATCAAGGAAGAACTCGGATATCCACAATTACAAG
TTGAACTTACAGATAATCAATTAGACCACTGTATTGAAAAAACAGTTCAAATGTTTTGTA
ATGTTGCATATGATGGAGAATTAACAAGATATATAAAATTTGAATGTCAGGGCCAAGGCA
ATTATTTTGTAGATCCTGAAGTTGAAGAAATATTACAAATATGCCAAAGTGGTATTTTTG
TAGGTTCTGATTTAAATGGATTAATAGATCAAAATCTATCTAATTATATACTATCTACTT
CTGGTGTTGCTTTAAGTTACTTAGTTACTTTAAGTTCTACAAGATCCTTAGTCGACAAAT
ACTTTGGTCAACGTATTAATTTCGAGTTTAACTCTCATAAGGGATTATTATCAATATATC
AAAATTACCACGGGCCTTTGTTAATTGAAGCTAAATGTAAATACATACCAGATGAACACG
ATAAAATATATGACCAAGAATGGGTCAAAGCAATGTCTGTGGCTCAAGCCAGATTGATGC
AAAGTGTAGTCTTAGGAAAATATTCAGCACCTTTAATTAATGGTTCGCAAGTTAATTATA
GTGATATTAGACAATTAGCCCAAGATGAAATACAAAGATTAAACGAGGAACTTTCCAATA
AATTTACAGAACCTGCTGTATTTATCGTTGGCTAAATAATTTTATATTTAAGGAACTCTT
AAGATATTTTATATTATAATTATCAAAAGGAGATAAATATGAGAGTTTCTAAATACAAAT
GTTGAGTTCCTTAAAAGACTCAGAATTACAACTTAGTTTTAACAAATTACAAATACCCACA
ATCTAAAATAGATTTAGAAGAATTTAACGAGTTTGGAGAACGCGTTCTTAAAAGATAATGC
AATTATCGATGTTAAAAAACTCAAAGATCCTGAATTAAATCTTAGATATGATTATGTTTT
AATACTTAGAACAAAACTTACTGATACTGCTTTAGAAATTATAAAAGAAGCTTATCCTAT
GCTAAAAACTATTGACGAATATAAAGCTTCATTAACAGGAGATTTTAATGAATTATGATA
AACTAAATAAAATTGGAATAATTTTGATTATTATTTTATCAGTTGTTTATTTTATGCTTG
ATATTAATAATACAAAAGTTAAAAATTTAGAATTTAAAATTCAAGATCTCCAAACAGAAC
TTAATAAAACCAAAAAAGAATTAAATGATACCAAAATTAATTTAAATCATTTAAGTTCTA
AAGTTCAAGATTTAAAAATATCTTTAATGAAAGATATGTCGTCAACTGTATCACTTAAGTG
ATAAACAACAATCTCTAATACTTGATGAAATATGGAAACAATCTAAAAAATACAAAATAA
ATCCAGCATTCTTATACGCAATACTGTGGAAAGAATCAAGATTTAGAAACGACGTTATCC
ATAAACCTACTTATGTTAGAACACTTAAAAAAGAAATACAAGCCCAAGGTATGGGTGCTA
TTGTTTGGGATTCTGGGGAGATAAACTCAAATCTAATACAAGTTTAAAATCTAAAAAAG
ATCTTAAAAATTGGAAAAGAATATAGAAGGAACTGCATATACTTAGTTATTTGAAAT
CTTTACCAAAGGTATCTAATACAAAAAATAAGTATGAATCAGCGGCTTCAAGATACTATG
GAAAATACCAAGCAAATTACGTGAATAAAACAATGTCAAAATTTAATGAACTAAACTCTT
AATGCTGAAATTAAAGTGGGTTTAAATAACGATTTTGAACCGATATGATTGTCTAATAAT
TAAGTACATTTTAAGTGCTAATATGTTATAATATTGTTAGATTTCAATAGAAGGAGAAC
TATGAATGAATTAAGTTTTGTACCAAAATCAGAAATTCTTAATAAATCACAAGAAACTTG
TATTAAAGAATGCCAAGATATTGTATTTCAAGAAACAAAAGAAGTTTCTAAAGACCTCAT
ATTAGATACATTATTAGGTATGATAGATTCTGTCAAGATTTCAGATTCTGCAGTTCATAT
AAAATTCAATAAATCTTTAATCATACAAAGTGAAAACATTGTTTTAGGTGCGGATAATTT
```

FIG. 17P. Continuation of (CJLB-15-1 [organism=Campylobacter phage CJLB-15] partial genome contig_1)

```
AAATATACAACTTGCAGGAAACCGAGTAGAATTACAACCAAGAATCAAACAAAATCCAAA
GGAGATTAAATGATCACAAAAGATTTCATTAAAGAACTTTCAAAAATGTCGAGTATAACT
GATAAAGTTATTCTTAAGTATCCAATAACAACATTAAATTCTGAAGCTATAGATATGCTT
GTAAATATAGATGCGTCTAAATTAGGATGCCAAGAATTCCCAGATACTGGTATATATGAA
TTAAATAAGTTTGTTCATATGTTCGCATTATTTGATAATCCAGAAATTACAAGAACAAAC
AATGCAATAGAATTTGAAACACCGGGTACAAAAAGTGTTTATACAATTTCAGATTTGTCT
GTAATGGAAAACTTTGATCAAAAAGCTTCAATTATTGAAAGTTTAGATAATTTTCCAGAA
GTTGCCAGAGTTGACATTAGTATTGAAGTCATAAAACAAATTAAACAAGCTTCAAGTATT
TACAACGAATTAAATGTTTTAAGTATAGAAGGTAAATCAAATGATTTATATTTGTATTTA
GATGCACATAATAGATTTAATTCTTCTAATAATACATTTAGCAAAGAGTTTTTAAATCAT
TCAACTATGGATTTTAAACTGAAAATCAATATTGAAAATTTTGTTAAACTGCCGGTAACA
AATTATACTTTAAAGATTAAATATAATGAGAGTAAAAACGCATTTAGAATTCTCTTTGAA
TCTGAGTTTTCTAAGATTTTGATCTCAAAAATTGCAGATTAAAGATTTACACCAAGGAA
CAATAAATGGATAATTTAAAACAACTTTCAGCTACGTGTATGCAAATCTTTATTAAATTA
AATGGAATGCATTACTTAGCCAAAGGCAATCAATTTCACAGACTTCACGAAATAACACAA
GAATATTATGAATTTTTTCAAGAGTCGTTTGATACATTCAATGAAAGATTGGTTCAATTG
AGTTTAACACCCTGTGTTAATATACAAGAAATCCACGATCTGAAAAATCCATATATTTTA
GATCTACAAGCTACAAAACTTGATTTGGATACCATAGCTAGCACATTAATAAATGATTTT
AAATTAGTTGACAATTCAGTAGCAGTTCTTATTCAAGAAGCTATTAAAATTGAAGATACT
GTTACAGAAGACATCTTAAGAACATTTAGAATTCGTCTCCAAAAATATATTTGGATGCTC
GAATCTATGCAAAGTTAAGGAGGTATAATGTTAAAAGAAGATAAATTTATTTGGAGTTTA
TTTCAGAAAAAATTTCCAGAAGTTTCAAGAGAAGCTTATGAAGATTTTGTAGAAGAATAT
TTAAATATCAAACCATTTAAAGCTAGTGAAAATATATTTGAAACCAATCAAAGTATTTCA
AACGAAGCTCATTTTATTATGAGAGCATTAGCTACTAAAAAATTACAAGAAGTTTTTGAA
ATACTTAAAATTGATTTAGAAGACCCAAATGTTAAAGCAGATTTTGAAAATGGTAATTTA
GGAACACCAGGCAGAGTCATTAAGCTAATGGCTGGTGCCAACACTGATGATGATACTGAG
TGTGGCTCTGGTAGATTTATGAAACCTGTTAGAATAGCAACTTTTCCAAATAAAGACGCA
GCTAAGATTCCAATTACTAAAAGGATTAACATAGCAAGCAATTGTAGTCATCATTTATTA
CCATTTAATACAGATTTTGCGGAAGATTCCTATGCAATAGTTAGTTATATACCTAAAGAT
TATGTTCTGGGTATTTCTAAGTTACAAAGATTAGCAGATTTCGTCTCGAGGCGTTATTGG
TTGCAAGAAGATTTGACTAAAGAAATCTACAATAAAATTAAAGAAGCAGCACAAACTGAA
GATGTTTATGTTAAGTTATGTAATATTAAACATACTTGTGAATGGATTAGAGGTGCAAGA
AACACTGAGGGGGGATTTACTTCAGAATTCTACGGGGGTGCTTTTGGTGATCCTGAATTA
AGAAAACAGGTTCAAATCCGAGTTTAATGTTAATACACTATAGATCTTAGCATTTAACAC
TTTAGTGTAATTTGCTAGATCTTTAGTAAAAATTTAATTAAATTTTAATCGTTCTTTAT
ATATAATATCATATTAAAAATTTAAATTTAAATTTTAAAAGTCTAAATCAAAGGAGTTTA
ATTTGGATAATTTTGAATCGGTTCTTCTAAAAAATATTATAGAATCTAAAGATTTTTTA
ATAAAGTAAGGCCAATCTTAAAACCTAGTATTTTCACAGATTTTGGTAACCAAAAAATCT
ATGAATTAATAGATAATTTTTATTCTAATTATAATACAACTCCTAGTATTCAAGAAATAG
CACTTCAAATTAAAGATATTCCTAATAAAGAAGCAAGAACCCAGATTGCTACTAAACTTA
ATGATGCTAGAAACTCAGAAAATATCAATAAAGAATTCTTAGATGATTTAACTGTTAAAT
TCATTAAGGACCAAATGTTCACAAAAGCATTAATGTTAGGTGCTGAGTCATTGATAAAA
AAGATGAAACTTATAAACAAAAAGCCAAAGATCTTATAGATGCTTCACAACTTGTGAATA
TTCATAAAGATCTTGGTAATGAATATAATAATATAGAAGAACGCATTGATTATTATCAAA
ATCCAAGAAAAGGTATCAAATATTTAAGATTCAATACTTTAAATGAGTATATCGGAGAAG
GCTTTCTTAACGGAACTTTGAATATTTTTATGGCTCCTGCAGGTATTGGTAAAAGTTTAT
TAATGAGTACCAGCATTGGTGATTTTCTTAAACAAGGTTTAAATGTATTATTAGTCAGCT
TAGAATTATCTAATTTTGAGTTCTTAAAAAGAATAGATGCTGACTTATTAGATATACAAA
TTAATGCTTTAAAAGACGTAGACCCTAGTGTTATCAGAACTAAGTTTGAAGAACTAAAAA
GATCTGGTATTGGTAGCTTATATGTTCAAAACTTCCCAGCTGGTTCTTTTAGTTCAAATG
ATTTAAAATCTTTATTAGAAATGTATAAAGCTAATAATATAAAATTCGATGCAATATTCT
TGGATTACTTAGGCTTGATGAAATCTGATAGAGTTTCTGCAAGTGCAGGTTATATAGTT
ATATTAAGGCCATTGGTGAAGAAGTTCGTGCTATTGCAGTCACAGAAAATATTCCGATAT
TTTCTTGTTCTCAATTAAATAGATCAGCTGTAAATAATACAGATTCTAACAATGAAGCTA
TTTCAGATTCTATGGGTACTGCTATGACTGCTGATTGGATTTGTTTCTTATTACAAACTG
AAGATCTTAAAAGAAAATACTATTAGATTTAAAATAACTAAGAATCGTATAATGGTA
GAACTTCAAGTTTGATATGCATATTAATTATAATAATATGCGTATAGAAGATATAGTTT
CAAATGATATACAAATGTTAAGTAATGCTGATATTAAAAACGTTCCACAATTAGAAATAC
AAAAACCTAAAACTGATTGGAACTTTAATTAGTCTCATAAAGATTGACACTATAGTGTTA
AATGTTTTAAATTTAATTAAACTTTAAGTTTAAATATTATATAATGTTTAAAAA
GTTTTTTTAAACGGTTAGATTCTAACCAGGATTTTCAAACTGTTAATGTAAAAGTTGCAG
TTTGAATCCTTTTTAAATTAATTAAACTTTAATTATAAATATGATTGAAAATTTATAATT
TTCGGGGTGTAGCGCAGTCTGGTTAGCGCACTTGGTTTGGGACCAAGGGGCCGAAGGTTC
GAATCCTTTCACCCCGACCATTCTAACATTAGTAAGCATTCGGGTAATTGGTAACTCACC
AGACTGTAAACACATTTAAGATTTCAGTAGAAGTTTTAAATGTGTTTATGATGTCAGCGT
TATATTATATAACTAAAACTGATGATTGTAAACACAATTAAAAATCATTTGTAAGTTTTA
```

FIG. 17Q. Continuation of (CJLB-15-1 [organism=Campylobacter phage CJLB-15] partial genome contig_1)

```
CCCATGTTTATTAAATTGTGATACTATATGTTTATATAACCAATAAATATATTTAAATAT
ATTTTGGAGGATTAAAATGACATTTAAAGATTATTTAAACAATATTGCTTTAAATGAAGC
GTTGAAAACGGATGTGTCTGCTATAGAGGAACTCAGAAATAGATATCAAGAAGTAGCCAA
AAAAAAGATGGAATTGCAAGCCGAAATAAGTAAACTAGAAGCTGCACAGACTACAGCTTA
CTTTAAACTAGGTGGCTTAGCTGCACAGATTGCACCCGATAACGTTGATAATGAAAAACT
CAACAAAGGTTTAGAACAATACGACAGTGAAATTGAGAATATTGAGAAAAAGTTAGAACC
TCTTTATAAAAAACGAGAATCTTTACTAGACGAGCTTAAAAAAATAAGCAGAGTTGCTAA
TAACTTAGTAACAAGAAATGCAAAAAAAGCTGGTGTAAGCCCTTTGAATTATGTTTTTAA
ACATAATTTATCATTTTAATAAAGTTAAAGAGTCATCGTATAGAATTAAACTCTATACAA
TGACTGAATATAATGCCTGATTAGCTCAACTGGTAGAGCATTCGCCTTGTAAGCGAAAGG
TTGAGAGTTCGAGTCTCTCATTAGGCTCCATTGTCCTTTATGTGGGAATTAATCTACGTT
TAAGGGAATTGATAGTTAAGGTAACGTAAATATGATCGTTGTGGTATTACAGACCTAAG
AGCTTCCTTGTAGCTCAAACCTTATAAGTAGACATAAACCTTATAAGACGTATAGCTTTA
TATGACCCACATTTACTAATAAACTTAATTATTCCCATTTAATTTTATCGACAGATTTAA
CAGTTTCAGATGAATTAATTTTTTCTTTTAATGTATTCGCTTTAAATATTACTTCCTGAG
TATATTCGGTTACTTTTGAAACAAATGTTAAAAATTCTTGAGGTGTAAAATTAACCTTTT
CATCATTCAAGTCAATCCAAGTAATCTCAGTTATTGAATTAGTACCACTTTGTATATCTA
ACAATATATTAGCGGCCATTCCGTTAATATTAAGTTTATCCTTTTCCCTAGTTTGGAATG
TATGGTCTTTGAATACAAAACCAGATTCTAAAGCTACGTCCCTTTTGTTTGTATTTCAA
ACTTCTTCTTTTCTTTAATTATATTAAGTTTTTCAGATTCACTTGCAGTATTTAGTACAT
ATTCATAATACAAATCCATAAGATTATTAGCTAAGCAGTATTCTTTGACTGCTTGTGTAC
CCGCTTGAATTTCTTCAGGTGTAATGTCATCTATATGCTTTATGATATACTTATCAGATA
AACTTGTATCCGTGGTTAAAGGTCTGTTTAATACACACAATTCAGTATTAGCTTCAATAG
CCCATTTAATTACATCTGAATTTAATACACCTTGGTCACTTAAAGTTTTTTTTGCTACTA
TCATTTTTACTCCTATATATTTGTTGAAATGTAACCTGATGTTGTCCATTGCCCAGGTGT
TTGTGAAAATTTAGTTCCAATATTTCCAGTCATAGCAATGCTAGGATTATTTATTACGCC
TCCACCAACTACCTGTAACCCAACTTTATAATTACCGCTTATATCTATACCTGTATGCCA
CCATACTGAACTTATCTTTGAATTAGTCGCTGCGCTAATAGCTACTAGTTTTTCAGGATT
ATTTGATAAAAATTTAACATTAGCACCTATTTGAAGATTGGCATTTAATACTGATAAATC
ATAGCATTCTTCAGCTCCTTGATAATTATTTTGAATATTAATGTTACTCACTTCTATATT
TCCTGAGGAAGCTATCACTAAATTAGTGAGTGACATTCCTATTAAATCAACATTATATAT
ACTTCCATTTGTACCAGTAGATATGTATATTGATGAGCAATTGTTAGAAGATGCTCTTAT
TGTAATATCGTGTATATGAACCTCGCACATCACGATATATAACCCAAATTGCGCCCAAGC
TGTATTATTTAAATCTATTATAAGTTCATCACTTCTTCCATTTTCACCAACTATATTGAC
GCCTAAAGGTAAGTTATAAAATGTAGTAGGTTTAGTAATAGTATATCCATTCTTTATTTT
TAATGTTATATCATATATAGACTTACCATATTTATATATTTCATTAATTGCATCATCTAT
ATTTTCAAAATTACCTCCCTCTCCGACAGTCCATTCTAATTTTTGTGTTAATAATGTAGA
GTATCTGTTACCCGCTTGTGTCAACACATCTTGCAATTTAGTATCGATTTCAGATTTATC
ATAAACAGATTCGGCACTTGCTTTAAGTTCCATAAAAGAATCTATAGTAGATTTATTATA
ATATGAATTAAATTTAGTATTAATTTCAGATTTATTATAATAATTAGATAAATCTACACTTAG
AACTGCATTTTTCCATTTTTTAGTATTTGAATCATATTGTAAAATATGATTGTTTGTCGG
GTCAACAATACTTGTATCAATTAAGTTAGTAATACTTGTTTTATGTGGGTTATTAAAGTC
TGTCTTATGAGTATTAATTAAATCTACATTAAAATTCTTTTTGGCGTAAGCTAAATTAAT
AGCGTGCCAATCACTTGTTGGGTCTGCAACATTAAATACTTGCGTTTCAGAACCACCCAG
ATTTGCTTTTGTATTTAAATTATTATTGATGCTAAGAATGTTATTTTCTATATTTTTTT
AAATTGGGTATACTCACTATACCTAGTATCTTCTAATTCTTTATTTGCAGCAATGGTATT
TTCAGCAGTCGTCACTCTTTTTTCTAATTTATAATGTTTATCTTCTATATCTTTTTCATT
AGTACCTACTGTAGTTTCTAATTTGGTAAGCCTAGAATCATTAGCTTCCTTATAAGTTTC
AAAAATTATTTTTCGAAGGAAATTATCTTCTATATATTTAGAACTGTATAATAAATCTTT
TGAAGCTTCTTCTGGATTTTCAGTTGTATGTCTAAAAATTGCTTGAAGATCTATTAATTC
ATCTGATGCTTCCATAGTCTCCTTAGTTTCAGAATCCATACAAATCCAATATTTACCATT
AACTATATCGTGAATATTAGCGATATAACTAATACTAGGATTTGATTCTTTGCTTATTTT
ATTAAGTTCTGTTAGAACTTTTTCTTTTAACTGTTCTTTTGTGAGATTTTCTGATATTAA
AACATCAACTTTTTTAAATTGCATTTTTCACCTTTAAACTAAAGATTTTATAAGTCTATC
TATTCTTTTATCCTGAACGATATTATTACTAGTATTATTTATGATCTTACCATCAGAGTT
TATTAAAATAACTCTACCTTGATCTACGTCTGTTACTCTAACATATACTGGTGCACCATC
ATTTTTAGCAACTAATCCCTGCATTTCATCAACAGCTTCTTTTGTAATTTGACTTAATGT
TTTAGTTGTTTCGTATACGAAATCTATTATTTTTATTTTAGATGCTTCTAATGCCATTTA
ATTTTCCTTGTATATTTTTACCATTTAGATACTAAATTTTCAAAAGTATCTTGAACTGCA
TTCTGCGCTGCGCTTAATCCATTTTTTAACATATTACTAAAATATGAACTTGCTTTAGAT
TGTACACTATCATTCCCGGTCGTGTTGGAAGTGCTTGCTAATTGAATATTTTAATATCT
GTATTATCGTGATTTGGTTGGTTCATTTTAAAACTAACATTGAATTCTATAATTTCATTG
TTATCTTGAGATAATTGTATTTGTGAACATCTGTCAACAATGCATCCTGCGTCTCCATT
ACTAAGATGTTTTTAGAACCATTGCTTAAATAAACCTGAATTAGCCAAGCACAGACATCA
TTGTAGTTACCTTTTGAAATTTGAAAGCATTGATAAATCTACGATACATACTAGCATTA
```

FIG. 17R. Continuation of (CJLB-15-1 [organism=Campylobacter phage CJLB-15] partial genome contig_1)

```
TCAAAATCTCTGAAGGTCATATCCACTTGGTATACTGGGTCTGCACCACGTGCTAAAACC
CAAGTCCCTCCAATTAATAATTCTTCAAATCTACCGGTATATTGTGGCAAATTAATACTT
TTTAAACAAATATCTATACTATTTTGTGTTTCGGTAGGGTTTCCCCAGTTTATAAGATTT
TGGAAAGTAGCATTAATAGGTTTCATAATAACTATAAAATCAGAGGTTTTACTCCATTTG
ATAGTATTAATAACACTAGCAAGTTTATTTAAGGTAACAGTTGCCATTTATCCTACTTTT
TTGTATATTTATTTTCGATTTTTGGAGCTAACATTTGTCGTTTAAAGACCATAATTTAAG
CTTCTTTTAAGCGGTGTTTAGTTATAATAACTTCAATTAAAAAGTTAAGGAAATTAAAAT
GATAATAAAAGAAACCATTTCCTCAACATCTTTTAGAGAATACTTATATGAACAAGCTTT
TAGTAAAGATGTAATGATCTCTAAATTTACTAACAATTCAGACAACATTTTTAATCATAT
TTTAAAAGTCTTAGTATATGATGATAATTTAAATAATAAAAAACATTTAAGAGAGATGTC
AGGAATAGTAAGATCTTTACAAAACAAAACTATCAAATCAAAATAACACCGGAAGACTT
GTATCATATTTTCTATGGAAATATTGAAGAAGATTCGAATCTGAAACAATATATCTTGGA
TTTAGAGATTAATTACGGTTCTCTTCAAAAATCTAAGCTATCAGAAAATGAGATACATTT
CAGACTAGCTAGAATCTTTAAAAGATTATCAAGTGAGATATTAACAAAGTCATTCAAGTC
TTTTGAAAAATATCCAGAACTAAGGGATAGATTTTAAAACAACAGGCTTTGATATAATTT
ATACCCGATTATATCAAAGCTTTAAATACACAAATGATTGAATCATAAATATTTAACCAA
CGATTAAAGGACTCAATTTGAATTTAGACACTATACATATTGTTAAAAATAACGGAGAAC
GTGAAATATTCGATGCTGAAAAAATACATAAACACTTACATTTTGCTTGTCAAAACCTCG
ATGTAGATATTATTAGCATTATTAAAGATGCTAGATTAAAAATATTTGATGGTGCCAAAA
GTGTAGACATACAAGATTCTTTAATTAAATCTGCACAAGAAAAAATCAGTGAAGATTCTC
CAGATTATGAGTTAGTTGCTGGTAGATTATTAAATCAAAAACTCAGAAAAGAAGTTTATA
AACAATACACACCATTAGATTTTAAATCACAAGTTAAAGAACGTATTAAAAAAGGTTTCT
ATACTGAAGATCTTAATGCTTATAGTGATGAAGAGCTTGACTATTTTGGATCTTTAATTA
ATTATGAATTAGATAACGAACTACCTTACAGCGCATTAAATCAAATGTATTCTAAGTACT
TGATCAAACATAATAAAAAATGCATTGAGGTTCCTCAAGAAGTTTTTATATTGATACCAA
TGGCTATTTTTTATAATACCGATATAGAATATAGAAAAAAATATGTTAAACTTGGGTATG
AATTATTATCACAGCGTAAAATTTCTTTACCTACTCCTATTATGAATGGAGCAAGAACAA
GTTATAAGAAATTTATATCTTGTAATTTATTAAACTTTGGTGATTCAGTTGAAAGCTTTG
CTAGGGGTTTAGAAGCTGTTTTAAAATGCACCAGTGCTAAAAGTGGTTTAGGTATCAATA
CAAGTTTCATCAGAGGTTTAGGAGCTCCAGTAGGTAAACCTTCAAGATTAGATCATACTG
GTATGCTGCCGATCGTTAAAGCCATTGAATCTGCTACGTCTGCGCTGATTCAGCACGGCA
GGGGCGGTGCAAGCAATCTGTCAATGCCTTTCTTTCACTACGAAATAGAATTATTTTCAC
AACTAGGTGATTCTAAAGGATCTTTAGAAAATAGGGCTAGACATACTGATCAAACTATTA
TCATCAATAAATGGTTCTTAGAAAAAGCTCTTAATAAAGAGGATATATTTTATTCCATA
TGAATGCTGTAGGTAATAAGGATCCCAAATTAGATTTATATGATGCCTTAGGTGATTATA
AAAGATTCGATGAATTATATAAACATTATAGCGCTAAAGTTCCTAATAAAAGTAAAAAGA
AAATTAATGCTTATGATTTATTATCTTTAATTATAAATGAGAGAATGATTACTGGTAGAG
TTTATATTGTTTTTGCGGATAACTTCGTTAATTCAAGTTTTAAAGAAAATCTATATATGA
CAAATCTTTGTTGTTTAGCAGGTGATACAATTGTTGAAACTTCACAAGGGCCTAAATTTC
TCAAAGATATTAAAAAAGGAGATCTTGTTTTAAGTTATAATCAAGATACAAAAAAATATG
AATACAAAGAAGTACTAGCAGCTGTTTTAACAAATCCGGAAGCTGAAGTTTTTGAAGTAG
AATTCAATGGTAAAGTGGTCATTTGCACTAGTGATCATAAATTCTTAACCCAAAGGGGTT
ATATTGAAGCTCAACATCTTTTAGAAAGTGATACAATAGTAGAATGTTCCTCCCGTATTT
AGAAGAAATAACATATTTAGATAAACCGAATAAACATAATCTTAATTTCTTTAGAAAAAC
ATATTTAATGGATTTCTTTGAATTAGGATTAGTATTCGACGAAAATGAAGATTTAATTGG
TATTAAAAATGAAGATACTACATCAGGCTATTTACCACTACATTTTAATAGTATATTAGA
ACTCTCAGAGTTTTTATATGCTTTTAATGGCGCGTGGGTAGCAAAGAAAGTATTGGATGA
TTGCCAGAAAATGGATATGGTGATTAAGCAAATGTCTGAAGAACTCGGTATACCAGAAGA
GGTTATTAGAAATGGCAAGTTTTAAGAATATTATTACAGTGAAAGTATTTTATCTCATA
AAAGTGATTACAATATTGTTAATAAAGATATAATTGATATATTATCCAGTTGTATAGCAA
GTTTCAAAGAAAGGGCTATTTTAAGAATGGCTACATTTAGACACAATAACTTGTTATATT
ATGTTATAATTGAAAGGAGAAGGGGTGTCAAAGGTGACCATACTTGTGTAGAACCACATT
TTGGTGCTTTTGTAACTGATATAGAAAATATCTTAAAAATTTCTGATCTAAGCAATTGT
TGTTACAACTCAAACACAGAAAGGATATTTTAAAGATTTTAAACCCAGATAAAATAGAAA
CAAATTCTCAATTAGTTTTATCCTATGTATTAAGTGTTCTAAGAGATTATATTAAAGAAC
ATTATACATTGTTTATTAAGCTTGTGACTAATGAAGAATTAATGAAAAAATATATAAAAT
TATTACCTTATGTTTGTACTGATTTAAAGTATACTCCTATAGATATTTCAAATGAAATTA
GAACGGATTTTGATGGAACTAGGAAGCGTTTTCTTGTGCTATTGCTCAGAAAATCAAAAG
ATTTAGACAAACAAGATGTACTAAAATCACTTAGTAATATCAATTTAAGTAATTATATAT
TATAATAACAATAAAAGAGGTGCTATGATAAAATAACTGAAAAAATACCT
GTATACGATATAGAAGTTAAGGATAATCATAACTTTTTTGCAAATGGATTGTGTGTTCAC
AATTGTGAAATATCTGTGCCTAGTCATAGTTTAGATAATTATAGGGGTATACCAGGAGAA
CTAGGAACTTGTATCTTAGGTAATATAAATTTTGGACATTCTAAAGAATCTGACATCCCA
AAAGTTGCTGATTTCTTAGTTAGGTTCTTAGATAATATGATTGATATTTCTGATTTTGCT
ATGCCAGAAATTGAATACTCAGCTACAAAACGTAGAACATTAGGTATTGGTGTTTCTAAC
TTATTTGGATATCTTGCTAAATCGAAATTATTTTACAATACAAAAGAAGCACGCGAACAT
```

FIG. 17S. Continuation of (CJLB-15-1 [organism=Campylobacter phage CJLB-15] partial genome contig_1)

```
ATTAATGATTTAATGGAATTATTTTATTTTAACTTAGTTAAAACTTCAATAGATTTAGCA
AAAGAACGAGGTGCTTGTGAATTATATAATGAATCTTTTTATAGTGATAATAAGTTTATA
TTCGAAAGATATTTAGAAGCTGGGATTAAACCTGAATTTAAAACAAAATTAGATTGGGAG
TCACTTCGTGAAGAATTATCTAAATACGGTATGCGCCATTCAAGCTTGTCAGCTGTACCG
CCCGCTGGGAACAGTTCAAAGCCAAGCTCAGCAACACCTGGTATCGAACCTCCAAGAGAA
TTAGTAACTATTAAAACAGAAAAAAGTTCTACTGTAAAACAGTTGGTTCCTTTCTATAAA
ACAGCCAAAAAATATTATACGACTGCTTGGGGTGTTGACTTTAATAATAAAGATTATCTT
AAATTAGTGAGTACAATACAAAGATATGTAGATCAAAGTATTAGTACAAATCAATATTAT
AATATCGTAGAAACTAAAAAAGTTAATATTGAAGATGTTATAGAAGAATTTATAGAATGC
TTCAATTTAGGTGTCAAATCATTGTATTATGCTAATTTTAGAACTACAGATGATGCAGAT
GGTGATCAAGTAATTGAAGGTTGTGGGTCTGGAGGTTGTAGCGTTTAAAAACTTTTAGGT
TTAAGCTTTTAAGACTTTTTAAGCTTAAACTTTAAGATTCGGTTTGTATTTCAGAAACTT
TTAAGTTATTTTATATTATAATTATTTCATTAAAAGATAAAGGAGATAAAATGAAACACA
TTACAAAAATATTTTTAGGATATAAAAACGACAAAGCATATTTCAATAGAACACAAAGAC
AAATTACGTGTGCTATCAAAAATCTTGAACGTTTAAAACCTTCATTTAATATTAACGAAG
CTAGATTTGAAGAAATCTACGAAGCTAAACAAATTGAAACAAACCCAAATATACTTTATA
TTGCTGTTACAGACAAACAATATGTAATTGTAGCCAATAGTGATTGGCACGGTAATATCA
CATTAGATTATAAAAATATTGATTTTGGTGTAGAAAGAAGTCTACAAATATCAAGGCTTA
AAAGATTATTTAGAGCTGGTGTTAGAATATGGAAATGTAATACTTACTTATATGATAGAA
AACGTAAATCCATAGGTTTGAAGAAACCTAGTCTTGAAGATCGTTTAGCAGAATATAAAA
AATCTAAAATCAATGATTTTAACAAATATTGCTTAAATAAATTAAAAAGTGTTAGTAATT
TAAATCTAAATGTAAACAATATTGAAGATTTAGATTTTAATAATTTAGAAAAACAAATTG
ATTTTATGAAAGAGTTGTTATATTATACTAAAAAATATATTGCGAATGAAAAATATAAAT
TTTGTGATGAACCTTATTTTGAAAGCACAAAAAGAAAAACTATGAACTGCTATTATAAATT
TAAAGATTTGAAATACATTCATAATCACACAAAAACTGGGATTAAACGATGATATTAGAT
ACTAAAGCAGATATATTAGTAACTCATAGTTTTCACTTTAATAATACTAAAATGCACGGA
TTATCAGGACATTTATTTGAAGTATTAGATTATTACTGGTATTTTAAAAATAAAGGTGTT
AATGTTAAATGTTTAATTCCAGAAGTAGTAACTAAAGAAACTTTTAATGATTTCGTAAAA
GGACACTATAGTGTAGATTTTGATTTAAATGATATATATTTTTAGATACTAAGATATTA
GCAATTAAAGCTAGAAATATACTAGTAACCGATGGTGGGTATTGGTTTTTAAATCAATAT
AAGTCTAAATTACTAGGTAAAGTATTTTCGTTTGCTTGTGGTCCTAGTTTTTTAGAATCC
GAAGATAAACCAGAATATGTGACTTTTTTAGCAGATCATAAAATATATCCTGGTTTGGGA
ATAAATTATACTAAGAAGGTGTTACCCCATTTAAATCATATACCAGGAGATAAACCTTTT
GCTCATATTACTAAAAATTGTAGGGCATTATCAGAATCTCAAATAAAAGATCTAATAAGA
GATTATCCTGATATTGTAATGTATAGTGATTATTTGAATATACAGAATTCGACAAACAAA
CCTATCAAGAATTTTAATTTTAGTAAGTATGTGTATACGCCTATTATGAGACATTTTGAT
TGTTCACCTAGACTTATAATAGAATGTAGAATATTAGGTATAGATTTTGATTTATGGAAT
ATCAATTATAAAGATCCTGGTTTAGAAAGACGTTTAGAAACAGATCTGGATCAATTTATA
TTGGATGGGTCCGACACAATTATAAATTATTTAGTTTAAAGTTTAAAAGCACACAAAGGT
TTAAAATGAATAAAATAGACTTCTCGGGTTCTGAATGTTCATATGAAAAACTACTAAATG
GAACATTAGAGTTTGAAGGTATTCGAGCTGCGATAATGACAACCGATAAATGTTGTTTTA
GTTGTGAATATTGTTGTAATTCAGGTTTTACAGATTTTAATGCTGCTAAAAATACTAAAA
GCGAAGCAGATTTAAAATGTTTTAATTTGGTTAAAGCTATATTTCCTAGATTAAAATCCG
CAGTTTTATGTGGTGGTGAACCACTAATGTGTGATTATCTTTATGATTATTTAGACTTAT
TTAAGGATCTAAAAGACGTAACAATTTTAACAAATCTATTATATATAAAAGATCATTATA
AACGTCTAAAAGAATATAGAAACCTAGATTTAGTTACAACTTATCACGCTTCTCAAATTA
ATTCTAATCAATATATTGAAAGACTTAAATATTTCTTAGACATAGATTTACCAAAAGAAG
TTAAATTATTTTTTAACCATAAAAAACCAGATTTAATAGAAAGAACTCAAAATGTTAAAG
ATTTCTTAGAATCTCAAGGATTTACTAATATTATTTGTACTCATATTTCAGGATTTGGTT
TTAGTAATCCAAATAAAAATGTAGCAGGCGTTGACCTTAATGCAGATAGAGACTACGTAA
TGATTTCTCAAGGAACTAAGAAATATATGAATGAATCTGAGTTTGCGAGTCAAAATTATC
TCGGTATGGTCTGCAATGGTTTGAGACTTCACGTTTACCCAGATAGAATCATTGAAAATT
GTTCAAGAAAAACTTTGACTGTAGAAGAAGTTCTAAAGTTAAAGATTATCAAGTTTGTA
AATTCAAAAGTTGTAATGTTGGTATGTGTTTGAATTATTTTAATAAATACAATGTTAAAT
ACTTAAAGAATATCAATTTTAATTGTATAACACCTCAAATTGATTATGATGAAGAAACAA
TAAAAATATTAGATTGTTTGAATTTTTACGGAGTAGAAGACTATGAAAAATATTGATTTG
TTAAGTTGGATTAGTACCATAAAAGATATTGAATTACTTGAATTCTTTGAGAATCTAAAA
AATTCTAATAATTCTAATAATTCTAATAATTCTAATAATTCTAATAATTATTCAGATGTG
ACACCAGACTTAATTGATGAATATATTAGAAAATATAATTTGTAGTTGACTGTAATTGAT
TTTTAAGATTCTATATTATATAATATTACAAGGAGATAAAATTGGATTCAGATTTTAAAGA
TTTTAGTAATGAATTGACTGACTTATTGAATAGTATAGATTTGAGTCAAAATTTCGATGA
TATTGTTAAATCATTGAATACAAAAAGTATAGTTAAAGAATTTATAACCGCAAAAATTAT
TGGAATAGATACCGATGGTAATTATTTGTTTATTTATGTAGAATTTACAAATAATAAAAA
AGTGCGTAGTATAGTAGGTTATTTTATTGTTCTTATATTAATAATCAAGTAATTCTTGC
TGAAGAAATGTACGATAAAAATTATAAATTATTTACTAATTCTGTGAGTTATTTAGTTTA
ATACACAATACGGGATTTTAATGATTTTAAATAATTTAAATTTATTGATTTGTTCATTTA
```

FIG. 17T. Continuation of (CJLB-15-1 [organism=Campylobacter phage CJLB-15] partial genome contig_1)

```
TTATATTTTTTCTTTTTATTATTAGTGTTGTTGGTTTTTATTATATTAATGGTAAAAAGA
TCAATTGTGTTTATTTGTTTGCAATAATACCTTTGATTTCAATTTTAATACTATGGTGTT
TACTCATTATACAAATATCAGTCAAAAATTAGCACCAAAGCTTAAAAAATGTTTAAAACG
AATAAATAATATAAAATCGTAAAATAAACTTGTTTTAAATAAGCTTAAAATCAGTTATTT
AAGATTATTATATAATAGAGGTAAAATGATTAAAAATCAAAAATACAAGAAATTTTTGAA
AAAGTTTTGAAGGAAAAAGAAAATGAATATACGGATGAAAAATTAGAAGAAATAAGAAAA
GAAAGAGAATATGTTGAATCTATTATAAACGAGGGTATTGAAAAATCAGAAAATATTAAG
ATAGAAATATTAAGTGAAACTAATTTTTAGAAGAAAATAAAAAATTAGATTTAGACATTA
AAATATTTTTCTTGTATAAAAACCAAATTCATAAGCAATGATGTATAATTTTAATCTTA
TTTTAAGATTATTATTATATAATAACAGAAATAAAAAAGGAGATAAAATGATTAAAAACA
CAAAAATACAAGAAATAAAAGATTTTAACAATGATTTAATATCTAAAATGTTAAAAAATA
ATCCACATTTTGACTTAAAAGTAGACTATAGAACTCAATTTGTAGTTTTTAAAGACAACT
CGATAATAGAAAGTGCTTATTATCCTACTAAAATAGCTACTTGTGAATATGGTGTAATTG
AAGTAGATGAAGATGCTTCAGATGGCATCTCAATATCTCACAATAAAATAGAATTTTTTA
GAAATGGTGTACCTAATGGTTTGGCAATAGAACTTATTGAGGATAATGAAACCAGAATCA
AAATTAGATTTGATTTGCGAGATCGTAATATTTTCTATGAAAACTATTACGCTTGGGATT
GTTTTGGAAAAAGAGCTTTCACTTTTAGAAATGATTTAAATCGTTTTAATGATCGTTTTA
TGACTAAGATTAAACTTAAGAATTTTTTAACAAAAAACTTTGATTTATTTAAAGATTTTA
TCAAAAGTTCTAATGAATATTTAGATTTTATTAATAAAAGTTTATAATTAATTATAGTCA
AAGGAGCTTAAAATGGAAATAATTAAATCTGCAACTTCAGGTTTCATTAAATACACAATA
ACGTTATTTTTATTAGGATTTTTTTCAGGTATAGCTTTTACATTTTTTATGACTAAATGG
TATTTCGAAGATCGTGGATCAACTATAGGTTATGAAATTCAAAGAGCCAATATGATAAAA
AATTGTATAAAAGAAGTTGACGTTTCCTTAGAAATAATGAAAGAAGAAAACTCGGTTATA
GATGCAACACAACCATTAAATTAATATTAAATTAATTTTAAACTAAATATAGGATTTAAG
ATGATTATTGAAATAAAAGATTTTCCATTAAATGTTAAGAGAGTAGTTTTAGAATTTGAT
GATTCTGGTGCTTGTACGATAGAACCAGAAACAAAAGTTAAAAAATCTAAGATTTCTAAA
CCTATTAAAGAAGTTGAAATGATTCAGCTGATATGACTGAAACTGAACCTGTTTTAGAT
ATTAATTTTGGTTCTAAACCAGTAAAAGCATCAAACACAGAACCTATTGATAAAGTTGTA
ATCCCGGATATAGAAAGAGAAGCTAACGTTTCAGCTACAATGCAAAACTTGAAACTATAA
AGTGTTATGTGTTAACACTATAGTGTAAAACTTAGAAGCTTAAGAATCTCTTAAGCTTCC
GTAATTGCAAACTTATATAACATCGGAGTAGTTGCAGAATGTAAAGGGTGTATTGTATAT
GCATTTCTTGTAAATATACCTACAGTTCTTTCACCTGATTTATAATTATAAGCAGTTGTT
AAGTTCATACAATATGGGCTATAAATCAACGAATTAACACCCTTTTCTTTATGAGATTTT
AAACCCACATAAGCATTATTATCATCAGGATTTGGATTTAAATAATATCTTGTATTATTA
ATCTTACCTAAGAAATAATCATTCGCTCTATTTTCATCTGTTGAGTCATCTATTCTTGAA
TAAGTAAAACTTAATGATAATATACCACCTACACCAGTTTGTGGAAGTATACAAAAACTA
TCGTATGTTCTAAAATTAGGTGAATTCATTTTAATAACTAAATCATTTACCTTTTTAGAT
ATATGAAATAAGTTTGTTTCGGCATTTTGTTTAGAATCGTTGTTATCATCTAACGTAATA
CCTTCTGATTCAACTGCATTTTCTTTAATAAGATTTATAATTTTTTCAGTTTCTTTGTGT
GCTGCAGAAGACTTGACCCAGTTAATGAATAATTCTGGTGTTTGTTCATTTCCGGCTTTA
TTAAGATTACTTAAATTTAATAAATCTTCCCAAGCTTCCTGTGATATTTTGATAATAGAT
TTATTAGTATCAACATCAATTTGTTTTTTAATAATTTTAAATGTATCTTGAGTTTCTTGT
CTTGCGAAAACATATCCAGATGGTTGCATCATAGGTTGAACTTCAGCAATGTGATGACCT
ATAAACGATTTGATTTATCTTTTAAGATATCACCTAACATAACTTGGTAAAAATCTGCA
TCTATACCTTCGCTAATTAAGTTTGTAGTCTCCTTAAGAGAATTTTCTAATAATAGTTTA
TACATTTTGGCCTCTATGTATTTTTAAGTTATTTATTATCTTAATTAACTTCGATATTTA
GTATTTAGATTATTTAAGAAACTTTTAAGTTATTTTATATTATAATTATTTCATCAAAAG
ATAAAGGAGATTAAATGAAAAACTTTAAATCAAAATTAGGTGATAATAGATTTACATTTG
ACTTAGTTTACACAGTTGTAGCCGTAGTAATGATGATAGCATACCCAGCTTATTTTATTT
GGGGTTAAAATGAACTTCGTAACCAAAGATTATATGTTAACTGCAGAAATAGCGGATAAA
TTAAATATAAGTATGACTAATATTTCAAAATGGTATGTAAAATTTCCAGAGTCTGTTACT
AATAAACATTTAGTAAGAATAGGTAATTGTGTGTTTGTTCACAGAGACTTTCCTAATTTA
ACTAAGAATATGAAAATTATTTTTAATGAACCCAGAATGATTGGAGTAATAAATTACCA
TTGAATTATATGATTAAAAATTTTAAAATTAATGTTGCTTATTGTGAAAAATATAATATA
GGTCATAAAACAAGTTATATTTTAAAACACATAGAAATCGTGTAATTCAAAAAGATTTT
TTTGCATTTGACCCTAGTATTTTAAAATTATTAAAAGCTACTGAATTAGAATCAAGGAAG
GTTGCTAGCTTAAATTCAATTCAAGTTTCAAAGAATTACTTCATTTGTTTTTGATTATTT
AAAGGAGTAAAAATGGATTCAAAAAGCTTTATTAAAAAACAAGTTCTAAAAATCTTAAAA
GTAACTAATATAGAAGAAGAAATTCTTCATAAAATGTTCGTAGATGAAGGTGTTGATGCC
GATTTCTTGATACAAGTTCTGAAAGATCTACATAAAGAATCTAAAATTAAAGTTCTAATT
AAATCTGATAATTGCTTGTTTGAATGGGATTCTCACAAGCCTTATATTAAAGGTGTTTAT
TATATAACTAGTAAAATGTAAACAAAGGTTCTAAATGACAATATATAGTTTTTCGAAAAT
AGATACATATAAAAAATGCCCAAAACAATATTATTATAGATATATTGAAAAGGTTCCAGA
AACTCAAAAGAACCCAGCATTAAAAAAAGGTTCTGATATACACGAAATACTTGAGTTTCA
TAACACTGAAAAATACAATGAAGTTCTTAATTCAAAAGATCCAGAAATACAAAATATTAC
ATTAAGATTTATTGATTCTGAATTAGGAAAAGAAATACTATCCAGAAAATCTTTAAGAGA
```

FIG. 17U. Continuation of (CJLB-15-1 [organism=Campylobacter phage CJLB-15] partial genome contig_1)

```
ATATGAATTATTCTTAGATTCTAATTATGAACCTTGTAGCAAAGATACTGCTATTTTTGT
AGGCTATATTGATAGAATTAATACGACTGAAAATGGCTTATAGATTATAAAAC
AGGTAAATATAAAGAACCATCTTATCAAGATTTTACACAATTAATTTTATATAGTTTATA
TATATTTAAAAGACTTAAACTAAATGAAATAAAAATAAGATATGTTTATGTTGAACATCT
TTTAGAAAATACTTTAAGTTTGTCTCAAGATTCTGCAATTTATTGGCAAGATAATCTTAA
TAATCAAATAAAATCTATTGAAAATTCTATTGAATCTAATACTTGGAATAGCAAACCAAA
TAAATTATGTCCTTGGTGTCCTTATGCAGGATTATGTCCAGATTTTAAAGGTAAACCTAA
ATGTTAAAAATAATTTTAAAAAATTAAACGAATCATTTAGTTTAATATCTTTAACTGAT
GACCAAAAAGCTAAATTAATATTTAAGAAAGATATTCGTTATAATATATGGGCTCAAATG
AATCCAAAATTAGCTTATGAATACTTCTATAAAGATTTCAACAACCAACAAATTGTACCA
AACGGTGTTTTAGAATACCTGGGTATAACAACTAAACCAGAAATTAATGAAAAATTAGAT
TCGCAATTGGAAATAATTATAAAACATTTAGAACCATTTCCAGTTTATGATTATCAAAAA
CAAGCTATAAAAGATGCTATGCAATTTCATAAGTTATTCATTAGAGCAGCCACAGGTGCT
GGTAAAAGCGTCATTATTGGATTAATTGCTAAGATTCTAATATTAAAAAAATTAAAAGGT
TTGATACTCGTTCCCAACATTTCACTAACAAATCAATTTAATAATGATTTAATAAATTAT
AAATTGGATATAGAAACAAGATTAATAGGTGGTGAAAATAATATTAAATCTTTTGATAAA
CCATTAACAATTAGTACTTGGCAATCTGTTAAAAACTTTAAAGAAGCCTTAAATGATTTA
GATTTTATTATTGTAGATGAAGTACATACAGCCAAAGCAGATCAAATATTTGATATTTGT
AATAAGTGTATTAATGCTAAGTATAAGATAGGTTTGACAGGGACTATTCCAGATAATGAA
ATAGATGCTATGAGATTAATAAGTATTTTTGGTTTACCAAGAACATATATTACACCCAGA
GGTTTAATAGATAGAGGTCTGGCTACAAATGCTATTATTAATATAATAGATCTTAAATAT
AAATTTAATTTTGAAGGTGAATATTCAAGCCAATTGAAACAATTAAAAGAATACGATCCA
AGAAATAATTTAATTCAAAGAATAGGCGATACTGTAGTCAGCAAAGGTAACACTTTAGTA
TTATTTTCTCATACTGAACACGGTCTAACTTTATTTTATAAGTTCTTGAAATCCAGAGGA
TTAAACTACGATAAAAAGACTTATAAAGATTTGGCGTTTCAACAAAGAAATAATGTATTT
TTTATTAACGGAATGATAGAAGGTTCACAAAGGGAAACTATTAGACAATTAATAGATTCA
GTAAACAATGCTATCGTAGTTGCTAATTATGCGACAACTTCAACCGGAGTAAATATTAAG
AATTTACATAATTTAGTGCTTGCTAGTCCACTCAAAAGTTATGTCACAATAACTCAAAGT
ATTGGTAGATTATTAAGACTTCACGATTCTAAAGATATTGTTAATATATATGATATTGCT
GATCACAATGGTTTTTTTAAGAAACAAATAAATGCTAGAATAACAAAATCTTATGAACCT
GAAGGTTATGAAATAAAAAGATTTACTTACAATATATAACCAACTAAACTATTATAAAT
ATTATATTTTAATTTTAAACTAAAGTTCTAAAATTTCAGCAAGAATTAAGTTCAAATATA
TTATAATTCTACATAGCTGTTTAAAAGGGGATTGATAGTCACGGTGACGGTAAATACAAT
AAGGGTATTGTAGACCTAAGAGCTTCCTAGTAGCTCAAACCTTTTTTACGGCTTAGATTA
ATTTTAAACTTAGATCTAAACTTGCTGCTATAGTGTTAAATATGTACTTTAGGTTTAAAC
TTAGAATTAATTTTAAAAGGAGATACAATGTTAATACAAGTTAACGAAAATACAACTGTT
AAATTATCAGCAGTTTGTAATATTAATGTTTTGAAAGACAAACAAGTTTTCAATATGTGT
TATACTTTCACAGATAAAAAAGGAGCAATGAGTGGTTATTATTATGTAGATAAATAGTAAT
ATAAACTATCAAAATTCTAAATACTTCAAAGAAAAATTCATAGCAGTTCGTGGTATTGAT
AGATTAATATATATTAACACAGATTTTGTAAGCTTTATTAAAAAAGATTACGCAAATTAC
CCAAAAGTGGTAATTGGTTTTAGTCATAGTGTATTAAGACACAATGTCGAATCTTTTGCA
TTTGCACCCGAATATATGTATATTAGAACCAAACCTGAAGATTTAGATTCTACTTATGAA
CAAATCTTAGAAGCTATTACAAATATTTCAAAATAAGGAGGTAAAAATGAGAGATGAATT
TGATGATTTGTTAGCAAGCTTGTCAATAGAACCTGTTAAGAAACCTGAAATAGAATATCA
AGAACCATTAGTTGTTAAACCTGCAAGCAACATAGAAGTTAATGGAGTAAACGAGCAAAA
CGCAGATTTAAATGATTTTGGTGATGTTCTTAACAGCATCGAATCAGGTGTTAGTAATAC
CAGCAATAATAACGAAAATATGGTAGCTAGCTCAGATTCAGAAGCTTTTAAGGAATATAT
AGATCTCAGAAATATTAAAAATGAATCAGATATTGAAGTTCCTGATTTAGTGGATACAAT
GCATTTAGAAGAAGCGCCAAGTTTAATACCAGAAGCACCTAGTGAACATACAAATCAAAC
ACAAGAATCAAAAACAAGTGGTTACGAAGTCCCAGATATCAAGGGAACTATCAAAAGGGT
ACCAGATGTTGACGATTCTGAAAATAATGTTTATAAATTAGAAACTGAATATATTGATAT
TATATTAAGTTATGAAGAAGAATTAAAAGATCTTAAACGTCGTTTTAAACTTAATACATT
AGAATATCAAGCAAAAGGTGTTCAGACTAGGTTAGTTATTAAACAGTTAAACAAGCAGC
CAAAGACGCTAAAAAGAAGGTTATATTATTAAAGATGAAAATAGAATCCAAGAAAGAAT
TAATAATGATTCTAATTTATTAGGAAGAATTTGTTCAATTATTAATTCATCAATCTAAAA
GTTTAATAATATTTTAAGATATTTAAGATATTTAAGATATTTTATATTATAATACACT
AAAGTTTAAAAGGAGATATATGGTTCACAAAGTGTTCAAGATTATTTTCTAAATGAATT
AACTAATTATTCTTGTTATAGTACTTTAAGAATGATAGCTAGTTCTATTGATGGTTTAAA
AAATTCAAGCAGAAAAATCATTAACACAGCATTAGACAAAAATTAAATACAGAAACTAA
AGTTAGTATATTTGATAATATGTGTTCAAAGTTATACACAATATTGCACGGTTCGTGTTC
AGGTGTTATTCAAAATATGGCTGCAAGCTATACTGGTTCTAATAATATTCCATTGCTTGA
AGGTAAAGGTAATTTTGGTTCGAGGTTTATTAATGAGCCAGCAGCACCAAGATATGTTTA
TGTTAAAAATAAAAATATATTAATGATTTATTTGATATTAAAGATGTCTTGATTTCTCA
GAATTTTGAAGGTTCAGAAATAGAACCAGTATTTTACGTTCCAAGTTTGCCTATACTAGT
TTTAAATGGTTCAATGAATGGTCTTGCTAGTGGTTTTAAACAGAATATTTTACCAAGATC
TTTGGATTCAGTAATAAAATATATTAAGACAGGTAATAAAGTTGATTTAAAGCCGTATAT
```

FIG. 17V. Continuation of (CJLB-15-1 [organism=Campylobacter phage CJLB-15] partial genome contig_1)

```
TGCAGGTTTTAAAGGGGCTGTTGAATTAGTAGAAGATACCAGTTCTAATAATACACAATG
GAACTTTATAGGTGTTGTCGAAGTCAATAAAAATAAAGCAATTATAACAGAAATACCACC
ATTTATCGAGTATACAAAATATCTCGAAATATTAGATAATCTTGTAGAGACTAAAAAGAT
TAAAAATTATAAAGACTTGTCAGACCAAAGAAACCAAGAATTTAAATTCGAAGTTATATT
TTTCGATAATATCTCTAAAGAGAAAGCTATCGATATATTAAAATTATCTAAAAGAGAAAC
AGAAATATATAATGCTTTGGATGAAAATAATCAAGTCAGAACTTTTGAAAATATTGAATC
TATAATTGATTATTACATAGACGTTAGAAAAGATTTTTGGTTAAACAAAAAGATTTTGA
TTTAAAAGTTCTTGAAAATGATTTAAATATTAATATTCAAAAATTAAGATTTGTTAAATT
AATCATTGATTCAGAGTTACAAATTATGAAAAGATCTAAAAAGGATATTGAATTGGATCT
TGAAAGTAAAGAGTTTATTAAGTTTGAGAATAGTTATGATTATTTGCTTAAGTTACCAAT
ACATTCGTTTACAAACGAAACTTTTGAAAAATTAGTACAAAATGCTAAAGAAATCAAAGC
TAAATTTGAAACATTAAAAAATCTGGATACATTTAAAAATTTATGTCGAATCTTTAGATTC
TATTAAGAACATATTAACTAAAGCTTAAGAGGAGTTAAAATGAGATACGAAGCTATAAAC
AATAAAACAAAAATTGAGGATTCTGAATTGGATATTATATCTACAAAAGATACGAGGCAT
TCATTATACAAAAAAGTTTTAATTATACTAATTATACTTTAAATATCAATTCATTTGAT
CACGAAGAAGGTGAATTAGAAAATATTTTTGCTGATCTTAATGACGCTAATGAAGGTGAT
TCTATACAAATCTTTATAGCCAGTGTGGGTGGTTTTGCTAATGAACTTAATAGATTTACA
AATATAATTAGAACAAAGTTCTATGGTAATGTAACAACAGTATTAAACCCATTTGGATAT
TCTTGTGGTGCTATGATGTTCTTAATTGGTAATTCACGTGTAATTTATGAGAACTCAAGT
ATTATGTTCCATTCAGTAAGTTTTGGAGTTTCTGGTAAACATTCGGATGTTAAAACGCAA
TTTGATTTTCTAATAAGTATTGGAATGAATATATGAAGTCATTATTAAATCCATATCTT
ACCAAGAAAGAAATTGAATTATTAATAGATGGTGTTGAGTTTTGGTTCGATGCTTATGAA
ATGTGTAAACGTGGTATTGCTACTCATATTAATGTTTTTGGTTTAAGTATGAAAGCAGAT
GCTTATTGTGAGTACATAGATAATTTAGATTATAGAATAGAGTTTCTTGAATATATTATT
AAAGAAGGTGACCTTGATTCTATTGATTTACAAAGGGCTGAAATTGAGTTAGAACAAGCT
AAAAAAGATGCTAAGAAAGCCAGCACTACTAAAACTACTAAAACTACTAAAACCACTACT
AATAATGAAATTGAGTCTAAAGATCTTAGCTAAGATCTTTAGGCTTAAGAATCTTTTTA
GTTCAGCTATATTATAATCATATATAACACCTAAGGTAATAAAATATGAAAATAACAATC
TTTGGAACTGCAAGTAAAAATGAAAAGTTTGCTAAGTCGCCATACGATGACAATTCTTTT
ATTTTTGAAACAATTGAAGTCCAAACGACTTACCAAGCATTTCAACTACTTGTTAATAAT
TTTTGTTTAAATATTGCCTTAGACTTAAAAGGACCTGGCAAATCCAGAAGATTAAAAACA
GATTTAGAACCTCATATAATTAAAACATTTGATCATTTATTATTTGATTTTGAATGCAAA
TCAGAGTTTAATAAAAATATGGCATTAGACTATTTTAAGAGCACACAATGCACTATCGGT
CAATCCAGATCTTATGATGGTGTTAATAATTTTAATTTAAAAGGTATTATTAAAACAGCT
CCAATGAGCTTAAAAGAACTAAAAGTTTTGCAAGCTAAAATTCAAAAAGAACTTTCTGAG
TATGGTAAAATACTACTGATACATTAAGAATAACTTATTATACAGCGCCTTTGAATAAA
GATAATATACTCTTGGATAACCCAAACGGTTCTATGTTAATGCCTATAGGTACGAATGTT
ACAGATTACTATAATAACATAGATTTAGATTGTAAATTTAATATTACCTCTAAAGAAACT
ACTGAAATATGCAAAACAATTTTTAAGAACCTGGGTTTTATCTTAGTAGATATCAATGCT
AATGGTTCTATAAAATACACAAAAGATTCTGAAAATTATATTTGGTACCCAAATAATCCA
TATATTATGAATCATACTGAAAGTTATATGTCAGTAAATATTTGGAAAGAAGCTATAAAA
TATGAACCTACTTTTGATATAACTCCTTATATAGATTATAAAGCAGATATTGTAGTTGAT
AGAAACTTTACAGAAATTAAGTCTGAATTAGATTCAATTGTAGAAGCTTTTTGTTTAAG
CATAATGGTGCTCTGACTTTGAGAGCTCCTATGGGTTCGGGTAAAACAACTTTTATAGAT
AGAATTATAGAAGCAGCACTAGAGAGAGATTTTAAGGTTGCAATTATAACTAATAGAGTT
ACGTTAGCAGAAGATTACAAAAGAAAATATAAGAAGTTTTTATATTATAAAGATTATACT
GATGCTATTAAAGCCAAGGATTCTAAGAATTCTAACAACATAAGTGGTGAAGAAGCTATC
AGACTTATTGAAAGTTATAGTAATGTTGACAACGTTAGTAATTTAAATAATGCTAATACT
AGTTTTGTCACAAAAACCAAAAAACCAAAAATAGTTAGATCAAAAGGTAAATCCTTAATT
TGTCAATACGACAGTTTTAGACATTTTGATTTAGATGACTACGACCTAATTATACTCGAT
GAGTTTATGAGTTTATTAATGCATACAAGATCTGCATTGAATAGTAAAACAGAGAACTTA
ATAAAATTCTATACTGCTTTAAATAAAAAAGTTGTTGTAGCTGATGCATTTTTAAGTAAA
TACATTGTGGACAATATGTTTACTAAACCTTTAAATGTTGTTAGCTATACAAAAAATAAT
ACAGAACTTTATAGTTGCAATGACAGCAATACCTTTTATACATTAATTAAAAATGCTTTA
GATTCTAATAAAAAAATAACTATTTCTACAACTAGTATAAAAGTTGTTGATATTATTAAA
CAAATGTGTTATATACTAAATAAAAAAATAATTATTTTTAATAAAGAAACCGGCTCAGTA
TCAAAAAATATTATATATGATAAAATTAGGTCTAAAGAAGCGCTAGATTGTGATGTCTTT
ATTTACACTCCAGTGTTAACTGTAGGAGTTAACATTCTGAATGATGTTGATATACATTTT
CATTATGATAGTGCAAGTTCTACAGACGTTATTAGTTCTTTACAAATGTTAGGCAGAGCA
AGATTTTCCAAAAAGATAATTTACTATGTTATGTAAATAGAAATATAATGCTTGTATTAAT
TATGATTTATTAAAAACTACTGTAGAAAAAAAAGCCTAAGGAGCATACTGATGATTCTAAA
GACAGAGATGTTGAATATAAGAGGGGAACTGTTAAAAATCTTTTATATCATTTTCACGTA
CCACCTGGCAAAGATTATCAAGAATTAAGCCATATTGGTAAAGCTTGTCTAAAAGTAGAC
GTTTTTAACAATATGACTTTATGTGACTATAAAAAATCTTTTGATGTTTTATTAAGTTTT
AATTTCAGTAAGATACCTATTGAATTAAGAAAAATAGGTGGTGATATTTTGAAATTAATG
AATATTAAAATACAGGATTCGAAAGATTCCGAGCTTTAGTTTAAGTTTAAAATTAGTCCA
```

FIG. 17W. Continuation of (CJLB-15-1 [organism=Campylobacter phage CJLB-15] partial genome contig_1)

```
AATATATTATAATTAAAAAATCAAATAAAGGAGTTGAAATGCAATTAATAGATGGCTATT
ACACAGATTCTAATAACAATAAATGGGATTCTTCTATGTATACTGAAGAACAAGCGAAAG
AAGCTTCTGAGTCTTTAGTAGTTTGTAAAGATTGTTTAAATTGTTTCAATTGTATTGATT
GTTATAAATGTATTGATTGTATTGATTGTTATAAATGCCGCGTTTCTAAAGATTGTATTG
ATTGTAAATCTTGTATTGATTGTATTGATTGTTATAAATGCCAAGGTTGCTTTAAATGCC
ATAAATGCGTTATTGTTTGGATTGTCACGAATGTGTGGATTGCAAGAGGTGTCGAGCTT
CTATAGATTGTTTGAATTGCATTGAGTGTGCGAATACTTCGAATGAATCACATACTCGAA
AATCACATACAGTATTAAAAATATATAAAATCTTAAATGCATAAAATCACAGATTCATAA
ATAAACTAAAAGGTGATAATGATTTATATTACAAGTGATTTACATATATCTCATCAAAAT
ATTATAAAATATACTGGTAGGTATATTGATGATGCTTTAGAATATTCAAAAGAAGTTCAT
AAGTATTTTAAATCTGTTTTAAAAGATTCTGATATTTTAATGTTTTTAGGAGATTTAGAT
TGTGGTCCTAATAAAAATATAGAATTCTTAAGCACACTTTATTAGTTCATTACCAAGCAAA
AAAATTTTTGTAAGAGGTAACCACGACAAGTGGTTAGATACTGAAAGTATTTTATATATT
GGATTTAGTGCAGTTTCTGATATCATTAGATATAAAGATACTTTGTTTTGTCATTATCCG
TTAGATTCAAAATCAGTAATACCTAAAGAAGCTCCAGAGTTTTTAAAATCATATGATTTA
ACTGGTATTAAAAAAATATATCACGGCCATACTCACAATAATTGGATAGTGGATTCTAAA
GATGGTATTGAAAGAATTAATTGTTGTATAGACAGAAATCCAGAAGTTATTGGTGCTTTG
ATACCATTCGAGCCTAAGACTTAAAAGCTTAAAATAAAAGGATATTAAATGAATAAAGTT
TCTGAAGTTAAAAAAGTTACAAGAGTTTTCCAAGGAAAATCTGTGTATGATTGTTTAGTT
CGTTGGAATGCTGCTAATAAATTTGTGCCTTGTACAGTTGATATTCAAAATCCAGGTGAC
CTGAAGCCATTAGCAGATTACTTACTTAAACATAATCTTATCTCTGGTCTTTAATAAAAG
ACCTTACCAAGGTTCGTGATGCATAGTGATGTTATCCAAACTCTAAGTTCAGCAGGCGCT
TACTTACCTAATGACACTATATGTCCTAGAGCAAAACTAGACACTGGCACATACTGCAAC
TATCGTTGTTATTTTTGCTATTACCAAAATGAGTTAGATAAAAAGACACCATTTGAAGTC
ATTAAAAAAAGAATAGATACTTTGTATAGTATAGGTTGTAGAGATTTTGATTTAAGTGGA
GGCGAATCTTCCATACACCCAGATTTCTTTAAAATCCTAGAATATATTAAATCTTTGAAT
CCAGATAATAAAATATCTTGTTTGACAAATGGATCTAAATTTCAGAATAAAGATTTTCTT
AAAAAAGCAAAAGATCTTGGGTTATCTGAAATATTATTTTCATTACATAGTGTTAATGAA
ACTCACGATAAAATAACTGGGATAAAAAATTCTTATAATTATATAATTAAAGCTATTCAT
AATGCAAAGGATCTTGATATTGTTGTTAGATTAAATTCAACTATTACTGATGTAAATTAT
AAATTAGTTGATACTGAATATTTCGAAGTTGTTGAAAAATTAGAACCACTTGAAATGAAT
TTTCTACCATTGAATTATTTTAGTCAGAATTCAAAATCAAAAGGTGTTAATTATTCTGAG
ATTTTAGAACCTATAAAAAGATTTGTAGATTCATCAAGTATACCTTTGATCAATGTCCGA
TATGTCCCGTTTTGTTATATGACTGGGTATGAGAAATACGTTGTAGGATATTATCAGCAC
ATCTATGATATTTACGATTGGAATATTGCTATGTATGAATACTTAGAACCTAATTTAGTA
AATTTAGCAAAACAAGCTGCATCTAATAGACAAAAAAGTTATAGGAAATGTGATGCTTGT
AGAACTTGTAAGTATTTTATATCTGTGATGGTATTGAGCCTCAAGTTCTTAAAGCAGGT
TGTGAATTTAAACCTATTCAAGGTTCTAAAATAAAAGATGTTAATACATTTAGAAAATCA
TTCTTTAATTTTTAGTTTATAGTTTTTGACCTTAAACTTTAGATTTTAAACTATAGTTTT
ATTTTTTTTAACATTTTAAAAGGAGTGTAATGGATATTTCATTAATTATAGGACCTATGA
GATCTGGGAAATCACTTGAATTGTTAAGACAAGCAGAGAAACTTCATTTTAGTGACAAAC
CTTATGTTTTATATAGACCCAAAACTGACACAAGGGATTTTATATCAAGAAGTTTTAGAC
CTAGTTTAGACTTAAATATACAATACTATAGCAATGAAAACTTCAGTGAATCTAAATATG
ATTATATATTATTAGATGAATTTCAATTTTTTGAACCTGAAATTATTAATAATATATTAG
AATCTAATAAAACATTTGTTTTATGTGCTTTACAAAGTGTCTAATAATATCAATGAAC
CTTATAATGTAGAAGTCTTTAGAAATGTCAATAGAATTATGCCATTTTGTAGTGATATTA
GATTGTTAACTAGTATATGTGAAAATTGTGGCAGTTCTTGTGCTACACACAGTTATACCG
ATGTTATCACTGTTTCTGATAATTATAAGATTCTTTGTAATAATTGTTTAGATTTTAAGA
TTTCAAATGCTGGTATTTTAAGAGATTAAAAACTTGAAGCATTTTTATACTTTTTAAT
ATTGCTTTAAGTTTTAAGCATTTGCTAGGATATATAGCATTGTTATATACTGCTAAAAAG
CCAAGCATTTTTTATACTTTTTAATATTGCTTTAAGTTTTAGATATAATACTATAGTATA
TACTGCTAAAAAGCCAAGCATTTTTTATACTTTTTAATATTAGTTTAAGATTTAAGCATA
TGCTAGGATATATAGCATTGCTATATACTACTAAAAAGCCAAGCATTTTTTATACTTTTT
AATATTAGTTTAAGATTTAATTATGATAGCTGTATTAGTATATAAATAAACTAAAAGAGG
AACTATGCAAAAATATGTAGCTATTGCTTTCATTATTGTTGCTATGCTAGGATATATAGG
ATGGCTTAAATATGATAATGCTCAATTACAAACAACTATTCGAGCTTAGAAGCCAAAAA
CAAAGGTTTAGAAACTTCTCTAAATATCCAGGTTAATTTAAATAAAATACAAGACCAAAA
GAATCGAGAACTTGTTAACAACATTAAAGAACTTGAAAATAAACCTATTAAAACTGAAAC
AAAATATGTAACAGTCAAGGATTGTAAAGTTCAAATATCTAAAGTAGACACCAATATTAC
CTCAGCTAAAGGTATACCTTTATTTTAGGAAATATAGGTAAAACTCAAATATCTAACCA
AAAATAAGGAATCTTTATGAAGTTTAAAAAGTTTTTATTGGCCTTAATACCTTTTATTTT
TATAGGCTGTACCACTGTTAGAACTGAGTTTGTATACCCAAAAATACCGGATATTAAAGA
ACCGCCTATAACACAAGATTATAATCTAACTGTAATAAAAATAAATAACATAGAATATTA
TTCGTTGAGTGCTGAAGATGCTAAGATTTTGTCAGAGAACTGGATCAAGTTTAAATCCTG
GGCTGAGACGAATTATGAATTATTAAAAATAATTAAAAATAAGGACTTAAAATGAGTTTC
AAAGACACATTATTAAACCTAGTTTATGAGAATTCTAGCTGTGAAGTGCTGGATTATAAA
```

FIG. 17X. Continuation of (CJLB-15-1 [organism=Campylobacter phage CJLB-15] partial genome contig_1)

```
GACCCTGAAATCAAAGAAACTGATTCTGGTGATATAGATACAACACCTACCACTAAAGCA
GATATTGTTAAACGCAAAGATTCTAAAATCGATGAAGATGATTCTGGCGATGATTCAGAG
CTTGAACCACTATCAAAGGAAGAATTCGACGATATAATTAATTCTTTAGATCCAGATACG
ATTGCATTAATTATAAGTATTCTTAACGATAATGGATATATAGTTGCTTCCAAAGAAGAA
ATTTTATCAGCAGAAGATTTTGAAGATATTGGCTATCTTGTTTTAGAAGTTCTCGAAGAA
ATTTCTGAGTATGAAGCTAACAATTATGAACAATATGGTGCAACTCCAGTAGATGAATCA
TTTGATGATGCTGAAGTTCTTAAAGAAGCTGCTATGATTTTAGAAGCTAATGATTTAAGT
GATTTAAGTGAACAATTAGTAGATATTGCACATACTAAACAATTAAGACGTGATAGAAAA
AGATCAGCTTGGAAAAGATCAGCAGTTTTAAGAGCAAGATTTAGAAAAACTGGTGAAGGT
AGAAGAGAACGCAAAAAAGCGCTTAAATACCTTAAAAAATATAGAAGACAACATAAAGCT
CGTATGAAGAGATATTCACAAAAATATACACAAGTTTGGAAAGGTAATACTAAAAACTAA
TGATATTTTGTGAAGATTTAGAACCAATATATGAGGTGGTAAAAAAGCTACCTCTTTATA
AACAGAGAGCTAAGGAAGAAGTGTTTTTAGGTATTTTAAAATCAAAATCTAAGAAATGGG
TCGGATGGAAATACCTAAAAGAACTTAAAAAAGATAAAAGCTTTGACGACAGCGCTATTT
TTATTGAGCTTTATGAGCTTGCATTAAATTACTACTGGATTAAATCTCAAAACGACTCTA
TCAAATACGATAACTTAATAAAAAACTATAAATTTTAAATTTATTAATATTCTAATTTAA
TATTAAAGAGTTTGAAATTTTTTAAAAAATTTTACCCTTTAATATGATATTATAATATAA
AAAACTTTTTTAAAAATTTTTAGTAGTTTTATTGGTACTTAAAAAATGCTTGGCTTTTTA
GTAGTATATAACAATGCTATATATCCTAGTACATGCTTAAATCTTAAACTAATATTAAAA
AGAATAAAAAATGCTTGGATTTTTAGTAGTATATACTATAGTATAATATCTAAAGCTTAA
AGCAATATTAAAAAGAATAAAAAATGCTTGGCTTTTTAGTAGTATATAACAATGCTATAT ATCCTAGCATAT
```

CJLB-15-3 [organism=Campylobacter phage CJLB-15] partial genome contig_3

```
TTTAGTAGGTATATACTATAGTATTATATCCTGGTATATGCTTAAAACTTAAAGCAATAT
TAAAAAGTATAAAAAATGCTTAAGTTTTTAGTAGGTATATACTATAGTATAAGTCTAAAA
CTTAAAGCAATATTAAAAAGTATAAAAAATGCTTAAGTTTTTAGTAGGTATATACTATAG
TATAAGTCTAAAACTTAAAGCAATATTAAAAAGTATAAAAAATGCTTGGCTTTTTAATAG
TATATACTATAGTATTATATCCTAGTATATGCTTAAAACTTAAAGCAAAGCTTAAACTAA
TATTAAAAAGTATAAAAAATGCTAAGGTTTTTAGTAGTATATACTATAGTATTATATCCC
AGCATATGCTTAAAACTTAAAGCAAAGCTTAAACTAATATTAAAAAGTATAAAAAATGCT
TGGCTTATTAAATTATTTGTACTTAAAAAGTCTTAAGAAGTCACCCAAATAAGCAGGGTC
TAAAGCTTTTATAATCATATTTTGATAATTCTTTTGTGTCAATAAATCTATCAAATATTC
CCTGTATTCGGTTATTAATTGTTCAGTAACATTACCTTGGTATGGTTTCTCAGGATTATT
AAAATAATTGGCTATCAATTCGTCAGCCATATCTGCTATTCTATCATTATCATAAGGCAT
ATCACTCAAGGCATCTTTATTATTAATAAGCATTAATAAATCCCATAAATTAGGATCATT
ATACAATCTATTAGAAACACTTTCAATGAAATCATTTGCATTTATTTTAACATTAATAGT
ATTAGAATCATTAATATATTTTGTTATAGTGCTATAATCCATAGACCTGTAATCTCTAAC
ATTACAAACTTCTGCTTCGGTTTTATTAGCTTCACTGAACGAATAATTATCTAAATAATT
TGTAAGTTGCTTACTAATATACATTCTAACTCCTATAGACTAGCATTTTCAAAATTCCAA
TCATCCTGGTATTTTTGACGGAATTCTTTTAATGATAATGTAAACTCTATTTTCTTTGGA
ACTCCATCTAATGTCACAGCAATATCATCACCGTTTTCATAAACCATAGAAACACCATCT
ATTACACAAATACCAGGAGCTATCAACTTATGTAGCAGTGGGTTTGAAAATTGGACACCT
ATTCTTGCAGGCGGTATCAATAAGACACCACCAGCTTCTTTTTTAGGGTATGAACTTCTT
TTTAATAACCAAAATATTCGCATCATATTAGAAGCTTCATCTATGTTTCTGGGAGATATT
TTAAAAGTAAATTGAAATGTTCTTAAGTTAGAACCTTTAAAGTTTTGCCATTTTAATGGA
TCTACTTGTGGTAGTTGCGGAGCAAATGCCATATTATCTGTATTTCCACCAAAATCTCCA
AATCTACCATAAGCTTCAATTATACCAGAACTAGCTGTACTTGATAATTCATTAGCAGCA
TTTGACATAGAACCTAAAATACCAGTATCTTCAGAATAATTATGAGAGTTTGTTCTTGG
AACGCATTCATTAATGGTAAATGTATTGTATATAATATATTGACTGCTGACATATCTACA
ATGTCTTGACCAGCATCTTTTAGAGTTTTGGCTAGCATCTGAAGAATCATACCCATCACCA
GAAAATGCTGAAGTTCCTGCTGTCATCAGGCTTGACATTTTTTGACCAATAGCATCTTTG
ACTTTTTTATAGAAATCATTTGGGTCATAAACAGTCAATATTATTTGTTTGTGTTTAAAA
TTATCAGATTCTAAAGATTTGGTAAATTTTAGAATTTCAGCACCATTGTTGGCCGAGAAA
GTTTTCGTAGCTTTTGGTAAATCAACACCTGAATAACACTACTGACAGAACCAAATAAT
CCCAAAATTTAATCCTTTGCATTTAATGAACCTTAGCTCAAAACAAAAGAATCAGTCAAA
TCTTTATTAGAAGTTTCTTTTGTTTTAGTCTGTATATTGGTATTATTTATTTGGGTTTTA
TTGCAGCTGGTATCACATCTTTTGTTTTAACATTACTAGCAACTTTGGTTTGTACTGTA
TTGTTTAACCCTGCTGATTGAATTGCTTGTCTTTTAGACATACCATAAGATTGTAAAAAG
TCAGATTCTGAACCTTCATTAAGTATTTCGTAATCGCTGATGCCATCTAACCCAAACATT
CTAGCAATTTTAAAACTGTTTTTAGAAGCCCAAGAATAATCACTTGGAGATGAATTATTC
TTTATATTAACTACAGGAGTTACTGGTACTACTGAGCCAGCATTGTTAGTTTGAACGTTA
GATTTCGAATCTCCAGGTAAAGAAATTGGTGATTTGGATTTACTAAAGTTATCTCCTAAG
TTGTTGAAGTCTTCCATTGTTTCTGCATCATATTGACCTCTGTGTGGTGTACCATAGCTA
GCAGCTTTAGGAACTGCTTTTGGAGCTGACGCTACTGGTTTTGAAGCTGGCTTAATATCT
GCTTTTGTTTCTTTTGGTGTTGAATTTGCAGCTGGGCTAGCAGCTTGTGGGGCTGAACTT
```

FIG. 17Y. Continuation of (CJLB-15-1 [organism=Campylobacter phage CJLB-15] partial genome contig_1)

```
GACCCAAAACTAGTACTTAATCCAGATTCTGTATACATTTGAGTTAAAGATTTTCTGGTT
GTAATAGAATTAGCATTAGCAAAAGATTGGATACTACTTACACCAGAACTTATAACACTA
GCTGCAGCGCCTGCTGTATTTGTAACAACATTTGAAACTCCAGAATCCAAACTATAAACA
GCACCTTTAGCACCTCCACCCCCTAATGCAACTTTAAAAGAACTATTCATATTGGATAAT
TGTTGATTTGCAAGTTCTTGAGATGGATTTTGACCTGAAGTATCTCTTAGAATAGTTATA
TTAGCATCCGGCCCACCGAAAGCATTTACGTCTCTATAAATTGAAACTGAGTTTTGTTTA
AAATCTGAAACCCAATTAGAACCATTCCAAATAGCAATATGCCCATATTTGTGATTTCCA
AATCTCTGGGTTATTGAAATGTCACCTACTTCTGGGCTTATTTGTGAAGCTCTACCTTGA
ACTGGTGTAAAACCATATTTAGGTAAGAAATTTATATAATCTGCAGCTGCTACTGGCCAA
CCAGATAATGGATATCCTGCTGCCATCAAATAAGATCTAACATACTTGGCGCAAGCGCCT
GTTGCTCTAGTTCCTAAGTTATATTTTTTACTGAATTCTGCTGCAGCTCTTGCTCCTGGA
GATCCTCCTGAACTCGAGCCTTGGGCTTCTGTGGATTGAGCTCCTTGAACTTGCGCCGGA
GAGATTGAACCAGAAGCTTGCGAAGCTACACTAGCACTAGCATTTGTAGAATCTGGTTTT
GTATCAGTTCCCCCTGAACTAGTACTTGAATCTCCATTAGTTCTAAATACCGATAAATCT
GCATTAGCTCCTTGGCTTTGCAATTTTTTAATTCTTGCTTGTCCAATAGCTTGATATTTA
GAATCGATAGAATCTAAGCTCATTTTAGATAATTCATCAGATAATTTATTTCTTTGTGTA
ACTAATTTATTAAAGGTTTCAGTATCTCCAGAATTCATAGCTTTTTGACCTTGTTCAAAA
AGCGCATCTAATTGTGCTTCTTTTTCTTCACGTTTCTTAAAATAAGCTTGCTTTTCAGCA
TCATATTTTTCAGATTCTACCCAGGTCAAACCTTTATATATAGAACCTGTTTTAGCAGCT
ATAACGGTTCCGTTAGAATCCACTTTATGTGGTGTATACGAAGCAGCAAATCGTTAGCA
GATTTACCATCAAGTACTTTAGCATTTAATCCTTTATTACTTGAACTTGAATTAGAACTT
GAATCTTGAACTCCAGATTGTGCTTTATCTTTTTCTACTTGACTTGGTTCTAAAATACCT
CCAGTATCATTATTTTGAACCATTTTATTTGCTGTATTTACTAAATCATTTTGTTCTTTA
TTAAGATTATCTACATCATCTGGACTTGTTATAATATCAGTAGCAAATAAACCTAAGTCT
AAACACATAGATATGATCCCACCAATACCTGGTAATAATGAAATACAAGCACTAAGTGCT
GCTATTGAACCCAATACCCATCTACCACGAGTAAAGAAATCCCAAGCTTGGTATATACCT
ACAGCAAACCCAACACCTGGTAAAGCTTTTGAAGCTATTTTAGCACCACTAGCAGCTAAT
CTTGCTCCTATTTTTTCAAGATTTCCAAGTATACTAGGTAGAACTGAAAATAACTTAGAA
CTTCCAAATAGTTTCTTACCTACTGAACTAACAAATTTCTCCATAGGAGCTAAAGCAAAC
TTTTTAAGCATATTAAAGCCTTTTTGTGCTGCTTTAACTGCTGAATCCCAAGCAGAGCTT
ACCATATTTTTAACAGCATCAAATCCTTCAATAGCTTTTTCTACAATATATTTTTGTGCT
GCTTTTAATTTATCATATCCTGCAGATATAATTTTACCTACTTTAGAATTTTTAATATCT
TGATATTTCTTACTAGCATATGATTTTAAATCATCTACTTTTTGTGAAGCCCAATCATAT
CCATTTTGCATAGCACCTTTAAAAGAATCCCATTCTTAGACATCCAAGATTGTTCTTTA
GCTGGATTAGATGAACTTACTTTTGGTGATTTTGGATTTTTTGGATTATCATTATCTGAG
ATTTTCCATTTATCACCAATATTAATTTTTTATTAATAAAATCTACTAATGAGTTCCAT
TTATTTTTTAAGAATTCAAATCCATTTTTTAAAGGGTCTATAATAGGGCCTAATAATGGC
TCAAATAAAGTCCATAATTTATTAATACCACCTTTTAATAGATCTAAAATGAAATCTAAA
GGCTTTGTTAAAAAACTTCCTAATGATCCCAATAATGGTAATAAAGCACCTGCCGATATA
CCTAATAAACCTCCTAACCAACCTAAAAGTTTATCAAAAAAACTTTTATTCTGAGGTACA
TTTACTTTAGATTCTGAAACATTTTGAACGTTTTTATCAAAACCTTGGTGTCTTATTTCT
GTATCTTGATTATCTATTAATCCTTTTTTAATATCCGAGATTTGTTTTGAAATATTTTTA
AGAGATTCTGAAATTTCTGTTAATTTTCTAGCATTCATAGGATCTAAAGCTTTGGCTGCA
CTAACAACTTCATTGGCTACATTGTTTAATTCACTAACAATTGAATCATTATTTTTTTGA
GTTGTCTTAGATACTTTAGAATCCGAATCCATCCAGTTATTGAGTCTTTGAGTAGCACTT
CTAACTGTATTCATAGGATCTAAAGCAGAATTTACTTTGTTTATACCACTAACAGCACTA
TTATAAGCAGAATTAACACTATTAACTGCATTTTTGCCTGCTCTATAAGTACCTCTAATA
CCCCTAGCAGTTGATTTATTATACTCAAAATAAATCCTACTTTTTGTATATTTATTTTT
GGATTCTGGTATATGTCAGTATAGTTCTAAAATAGAACACTATAGTGTCAATTTAGAACT
ATTTTAGAATTCTAAGAAGCTTGAATATATTTCATCAAAGCTATTCTATATTTACCTATG
AATTTAAACATATAACATAAACCAGGTTGGCAACTATAATCAGTCCATCTTTCTGCGTAG
GTTTCTTTATTAGAAATACCAAATTTTGTAGAATTACATTTTAAACAATAATGTGTAAAA
CATTCTTGCAAGCTTTGGGCATATTTTCATTTAATATTTTTCTATGATCTTTGTGAGCTC
TTAATCAATGTTTCAGTAAATTTTACATTCTCAAAATTAATATCATTTAAAACATTATTT
GGTTTATATTCTTCACTAAAAACACCGTGACAAGCATACATTTTACCATCCAATTCAATA
CCAGAATAGCCATCACCTGCTGTACAAATACTTCTATTGGATTCATCCAACCAAAATTA
AAATATCCTTTTCTTTTAAAGAACTCAACTTCAGCATCACGTATTTTAAGAATTCTTCT
TTTAAAGTATTTGTCAATGCTTCTAATTGTTCTTTTGTAAAATCATATTTAGACATATAG
TCTATCGTAGGGTATAATTAAGTTCAATACCTAAGACATCGGACATTCTTTTAAATTCG
AAATAATTAATAGCAATCTTATCGAAATTCTTAGCTGCAATCGTAGGATGTACAATAAAA
GGTATATTTCTTTTTGCTAGTTCAAAAACAGTTTCTTTAACTTGTTGTGCTGAGCCCTTA
CCTTGTAAATTAAGTCTATCTGAATCGTGACTTGCCATTCCATCATAAGATATTTGAGTC
AAGAATTTTGGTTCTGACCCGACATTTGGCATATACTTAAATGTTTCTAAGTAATCAAAA
ACGTGGTTGTATTTATAACCATTTGAATACATAAAGAAACAAACTTTTGGGTTGTGTCTA
TAGTATTCTACAAACTCTTTAACACCTTCTAGGTTAGTTGTGGGTTCCCCACCCCAGAAT
GAAATTCTAATACCATCATAATGTTTATTGAATTCTACTGAATTCAATAGAAAATCAAAC
```

FIG. 17Z. Continuation of (CJLB-15-1 [organism=Campylobacter phage CJLB-15] partial genome contig_1)

```
TTTTCTATCATTTTTTTAGTAAGTTCTGGTGATAATTTTTCAAATTTTTGTTTATTAAAA
TCTTGAATACAGTATGTACATCTTAGTGTACACGCTTGAGTCATATTAATATCAAAATTA
TAAAGTTTTTTAGGTCCTTGAGATTTTGGTAAATATTCCATAATTCTCCTTTAGATATAT
TATATAGTATTTATGATTAAATGCAATTTAAATATTTTAGTATTTTTAGATTCTAACACG
CATTGTCATATCAACACCAAAATTTAAAAGCATTTTTCTTATATATTTCCATAAAAATGT
CAAAATGGATCATAGCAGTTTGGTCATCACCATCATATGAATATTTAAATACTAAGTCTA
ACTCATTTAAGAGTCTATTTAAAGTATCTAATTCTTTTTCCATACCTTCATAAGCTGCCC
CACCACAATCATCAAGCCAATATTCTCTTTTGATTTTAAGCATTTTATAAATCAATTTTA
AATCAAATATTGGCTCATAAGGTCTCCAAATTATTAATTCATTTCTGAATTTAATGATAT
TTTTTATAAATCTATAAACTTTTGAATTTCTGATTATTTTTGGTACTAGCATATTAATTA
CTCACTTTCTTAGATTTAAAACTTCTGGGTTAATATCCCAAGGAAAAATTAACCAAACAT
CATTCAAGATGATATTGATAGTCTCAGTTTTAAATGGACTATTATATCTTTCAAATAATG
TTTTAAATGTTATGAGACCATTGAAAACTTTTTGGATTTTAAATATTGTTTTACTTGTAT
CGTTAATATCATCTAAAAATAAAACTTTTTTATAATTTTGAATATTGATTACATCAGAAT
TATTAATTACATAAACAGGTAATTTAACACCCTGGGTGTATTGCAACATACTAGTTATTA
TTAATCCACCTCTATTGGGAGTTATTATACAATCAAAATTTTTAAGATCTACTTCATTTG
TGAGATTATGCAAAGCTTGGTGAACATCATTCCAAGTTAGTTTAATTGTGTTCATTTTAT
ACCTTTAAAACTTATGAGAAATATATACTGCAAAAACACTCAAAATCGCACTTATCCCGC
CGTAAACTGCAATATAATATATAAATGAATTCATTTAAGAAAAACCTTTTAAAGATTGAT
TTAAGACTTGATTTTAATATTATATAATTTATAGCTTTAAAAAAACCTTAATATCTCGCA
ATTTGTTATATTTTAACATAGATTTTTTAACTTGATCTAAGACGTTGTCTAAATTAAGTT
TATTTCTACATAATTTAAATAAACAATCTTTGGCTATAGGATCTATATTCAAATCTTTTA
TATATAAAGCTGGAGCTTCAAGATCTTTAGCTTTAATATAATTAGAATCTATAGAATCTA
ATATTTCATTTAACTTAACTTTTACTGAATTAGATACAGAATCAACATAAGCCACAGCTT
CTGGCGATAATTTTGGTAACACATCATCTATAGTTCTTCTAATATCATTTTGTATATCA
CTTTTAAATCTAAATTAGTTACAGTATTATGTAAGTCTAAATATTCTTGTGTTTTTAACT
TGTAGACTTTTTAGTTACTTTATGCTGCAATATAACACCTTCGTAATTAGATATGGTGT
TTATATAATCTTTAAGATCTTTTAGAGTCCTAATATTTAAATCTTTAAAATTAAACTCGT
TAGTTTCGTGAATTTTAAATTCTAATGTTCTAAGATCTAATTCAGCTATTAATTTTAATT
CAGTTTTATTATAATCTACTACTATTCTATTTAAAGGTGAAATCAACTCGAAAAGTACT
GGGTACCTGGATTATTTTTATTAGATCTAATATATCTGGATTATTTTTGATATACTTAT
TAGCTAATTTAGTTTGATCGTTGTCAATAGACATTTTAGTTCTAAATTTTATACCATCAT
ATTCATAAGGTATCATTAAAGAACCATCGTATTTTGTCACTATAGTGAAATCTTCAAGAT
TTGTAGAATCTGGTAATATCCAATCTTCATTTTCATTAATATTAAAGAATTTTGGTATTG
GTATCGATATACCAGGTGCTAAAGTATCTTTGTTTAATATAGATTTAGAATCTATCATTA
AACCTCTTATGAAAAAGTATTATTTTCTTTGAAGTTTTATAATCTGACAATATATAAG
TATAGAATTTAAAATCGTTTAATTTTGTTGACCTATAATTAGAATCTTTTAAATTCTCCG
CCATATTTTTAAGTTCTAAATAATTCATTATATCTCCTTTATATACAGCTTTGATAAAAT
AATTATAATATATTTTGACTTAAAAAGATATAAACTTCATATAAAACTTATAAAAAATTA
TAAAATTCCGTATAAGATTTTATAAAAAGTTTCCTGAAAACTCTAGATGAATCTATATCA
TCTAGAGAAACTCTATATCTCAATTTAGAATTTTTTACAAAAGAATACATCTCCATAAAA
CTATTAAAAGACTCTTTAATACCGATTTCTTCCAATGATAGATAATAAAGATTTTTATCT
TTTTCATAGTTTCCAAAGATGATATTCTTCTCCATCTTTTTATCTTTTAAGATATATTGA
TGGTAGAATTCATAACTCCTTCTTCCAATTTCTATACTTGCTAGAACATAATCAGGAAGC
TGATGAACTCTATATACAAGATTTCCAATAAATGAACTATATTGAGGTTGAACCTCTAGA
GTTCTAATCTTGTATAGACAATTCATTTTCTTTATTTGTGAAACTAAAAGACTTCTACAC
CACTGATTATTACAGAGTTTGTTGAACTTAGTTCCTTTTTCTTTATCTCCTTGCTTCATA
TTAAGGTATTCTAAGCTAAAAATCTCACACCCAAAATGATTTGCTAACTTAGATAGCTGA
TGGACTATTTGTATGATTTCGTGATTTCTTTTATTTGAAATGTATTTTCTTTCTTTACTT
TGACCAGAATACCCTTGTCCTTTTAAAGAATCATCATAATCATTTAGAGCTTTTAAAGAA
ATAGAACCCGTTTTTATGATTTTATAAGATCCATCGTTTTTCCAATCTACTACTGAATAT
CCAATGTAGTTGGGATTTAGATCAATACCAAATACTCTGTCTTTAATCTTATCTTGTACT
TTTAAATTGTGTTTGAGTTTATTAAGATCAAAACTGATATAAACATATTTGGTATCTAGC
TTGTAGGTTATCGGTATAGATTTGTTTATTTGTAAAGTAATCAGCTGATTCAAATAATCT
CTATATCTCTTAGAAGTTCCATTTAATTTTAGAGTGATATGTTCTTTTCTTGAGACTTTA
AAAATTATTGTATTTTCATCTTCTATTTGGAATTTTCTATTTCCATTCTTAGATGCTTCA
CCTACACTATATAGAGGAAGCAGTCTTTTTAGTTGGTATTCTTCTCTTGAAATTTTTCCT
TTTAATCTATCAAAGAAATTCTTTTTACCACCAAATATAACTTTTTCATCTTTCTTTTTC
TTGTTCTTAAAACTTTTAACATCAAAAACAGCTGAGTTAAAAAACCACTTATCAAGAAAA
ATATTATTCAATCTAGATTGAAGTCTTGTTGTTTCTGCTTGTTTTAAGTCAGGAACTTGC
TGATAAAATGAATATGTTGATCTAAAAAGAGAGTTGTAGTTTTTGATACAATCAAGTATT
CTTTCTGTATCAGAAGACTTATAGTCTAGCTTGATTGTTATAATATTTTGTATCTCTTCA
TTATAAATACTTTTAGTTTTAGACATATCAATCCTATGTTTAAAATTAGAGAAATAAAGA
AATTGGTAGTTTCTTTATTTCTCGTTTTATTATATTTAAATTTCAAAACTTTCAATTTTT
GAAAATTCTAAAATAATTTCTATATTTATTTAGTTTAATATACTTTTAAGTCCAGAATAT
ATAATATTTGATATAAAATTATATCTATTTGTATAATTTTATATAAAAATGCTTTAATAT
```

FIG. 17AA. Continuation of (CJLB-15-1 [organism=Campylobacter phage CJLB-15] partial genome contig_1)

```
TTTAAAATTTAAACTTTAGTTTTAAATCTCTGACCTTAAATTTTTAAAAAGCATTGAAGC
TCTTTTTAAGAACTTCAAGCTGATTATATGTTAATTGAGTTTTAATTGTATTGTTTGTTT
TGAAATTGAGTATAGTCAGTGACATATTTATATTCTCTATTAGCAGAACAAGCAATTTGT
CTATTTGTGTTGATATCACAAACACATCTGTAACCGCCTTGACTTCCAGTTGACCCATCA
ACATAAGCCATTGTTCTATTTGTAGCACATTGTGCAGCTATTGTGACGTTTGTATCACAA
ACACAAACTCTTACAGTAGTACTTGTTTGTGAATTTGAAGTATTGTTGTTGACAATATTA
TCGATTTGACCTGTAGATTTTTTATCCCAAATTGGTTTACCTGTAATATTTTAGTCCAT
TGTTTATCAACGTTACAAGAACATACTTGTGTTACAGTAGCGTGTTGTCTAACAGAATTA
ATCCAGTTAGCATTACATCTACACGCGTAATCATATATTTGACCGTATTGATTGTATTGC
GGAACACTTCTATCCCCTTGGCAAGAACACTCAGTCATATATTGGTTTTCATAAACTGGT
GTATACCCAGGACCTTGAGTTTGACAAGTAATATTCGCATTACAAGTACAAACAACGCCA
TTCCAATAATCAACACTATCGGTGTATTCTTTATTATTATTACAAGTACAATAATTACAA
TCACAAGTACAATAATTACAATCACAAGTACAATAATTACAATTACAAGTACAATAATTA
CAATCACAAGTACAATAATTACAATCACAAGTACAATAATTACAATCACATAAACAAGCA
ACTTCAGCTTTATTTAATAATTGTTTGAATTTATTGAATCTAGCAGCTGTAATCAAAGCA
CCTTTTAATTTCTCAGATATTGTATCCTCAATAGTTTGATCAATTGTAAAATCTAAATAC
CCAGAAACTATACGTTTTTGAACTGTTTTATTAGCGTTTTCTGTATTTTGAGAAACTGTG
AATTTTAATGTACTTGCTTTAAGTTTAACGTTATTAAACCATTTAATTTTCTTAGAACTA
AAATCTGCTATACCAATTTCTACGTCAGTAAAATCTTCAAGAGCTAATATTTTTGTTAAA
GCATCATAATTAATATTAACTTCTGATCTACCTTGATCATACCAAAGTTGAGACTGATTA
TAAGTTAATCTTACACCACCAGAAATATTAGCAATCGCACTTGCTGTAAATTCTAATCTT
GCAAATAATTACCGTGTGCTAAAAATAAAGATTTTTGATTTAATTTAACTTGATTAAAA
TCTGCTTGGACTGCGGTTCCAAAATTTATAATTCCATCACCTACAAATGATTCTAAAACA
ACCTGCATAGCAGTATAAGGTGTGCTTAAAACTACAGAACCCTGCAAAACACCATTTTGT
GGAACTTGTGAAACATTTTGATAATCGGTATTACCTTTATAGAAATTATTGCGAGTTTGA
ACCTCCACATTCATAGCTTTGATAAATTCACGAATTTTAGTAGGTTCTATTAATTCACCA
GTTTTTGTATTCACAAAATTGGTAGCATTATCTGGGCGTTTGGTGCCTTTACCTATACCA
TCTTTTAGAACGACATTTTTAAGAACACTTCTAAAGTCATTATCTGTAAATCTGCGTTCT
AGCCACAATGCTGCTAATTCTTTCATTAAAATTCCTGAGTTTTAAATTATTTATTTTTAA
TTTAAAGCTATAAAAGTTTTAAAAATAAAGCTAAAGCTTAAAATGTTTAATAACTATAAG
CTAAAGCTTAAAAATGTTTAATAACTAAAGAAACATATCGCAATGCAACAAGATTATATT
ATCCTTGATATTGAGTTCTTGGTGTAATTCAAAAAGCTGAGCTCTCATTACCCTATAATT
CCTAGGATTGAATCCTCAGTTAAAAGAATATAATTTTCTTCAATATCTTGGCCTTTTGTG
ATATCCCATTGAACTGTTTTATTAACCAAATCATATTGACATTTAGGCCCTTGTTTAATT
ACAACACCTTTGGTTGGTCGATCATAAAGATTTGATTTTTGTATTTTGTAATGATGCCA
GATTCAGTTTCAAATTTAACGGGTTCTGTTTTTATTAGAACAAAATCTTGAAGTGGTTTA
AAGTTTTCGATATCGATCATAATTCTTCCTTGAGAAGAAGCCCATCAGAGCTTCTATAAG
TTACTTTAATAAGTCAGCCATCAAATCATCAAGATTATCTGCTTGGTTAGCACTTGGCGC
TTTAGCTTTTGGTGCTTCTGTTTTTGGGGTTGCTGCCGATGATGTGCCGTGTGGTGCTGT
TGGTGCTTCCGGTTCAGCAAAACTTGTTACTGGCGCTGCTTGAACCATTGAATCTAAATT
GTTAGATTCTACTGGTGTATCCAAACCATCTAGCAATTCTTTTAATGCTTCGTAAGATTT
GTAGCTTTCTGGTTTTTGCCAATCTGACAATTTATAAGCATTATTTTTAATATCTGCTAC
TGCTTCTTCTACACTATTATAAATTGCACTTGGATTTGCTTCAGCATCACTTTTTGAATA
TTCTATAAACCCATTGGCACCTTTAGTTGCAATCAATTTAAAGTTAAATCCTTTTATAGG
ATCAAAAAGATTTTTAGCAACAGCACCTAGTGCTAATTCTTGTTCATTTGGTGTTAAAAT
AGATTAATTTTCTCACCAAGTGTTTGTGACATATCAAGTAAGAAAATTTTACCTTCATT
TGCTGGGTTTTTTGGATCTTTAATAACTTTAATATTAGCAATGTATCTTGTAGACCTTGC
ATATCTTCTTGCTTCATCTTGTTTGCCAGCATTCCAAAGAGACGCCCACTTTCTTGAAT
TGGGTCAGGTAAACCAATTGTACTTGGACTCCACTCAGCTATAAATCTTTTAGAAGTTTT
AGATCTAACATTGTATTTGAATACTTTCATAATGGTACTCATTGAGCCATTTCGTGAAC
TTCACTAGGTAAGAATCTAATTAAAGCTGCACCATTACCATTTTCATCTTTTGCTAGGGT
ATAAAAACGAGTATCACTTTCATAACTTTTAGATTCGAATGGGTTAGCTCCCGCATTCAT
TGAATTCCAATCAAATTAATGTCCATAAATATCCTTTAAAAAATTAATCAGTTTTAAT
CTATTATATTAAAACCAATTATAAAAAATTAAAAAACTTAATTTAATATTGATTCCATTA
TATTATAAACTTTAAATTATAAACTAAAGTTTAAAACTTAGAATCAAATTAAATCACCAA
AATGTAAAACAATCAAATAATTACAGACTTGCTATACTAAAAGAATGATTTCTAATATAA
TTCTTTCTTTTATCACTCTCTTCAGAGCCTAAGAAGTCATTAATTATATTAATATTATCG
AAATCATAGACATCGATCATATTTTCTAATCCATCCTTCTTAATAACAAAATCTAATAAT
TCTTTTTGCCAAGATCCTAAACCTTTGAAATACTTCGCATTTTCACCGGATTTAACCGGT
AACTCTTCTGTGATGTCATAAGTCCATTAATAGGAGTTTCGCCTTTTAAAACCATTTTA
ACAGGCGTGTTAAACCGACCAAATCTACCTTTGTATTCCGGCCTAAATCTTTCTATAAAC
CCCATCAATAAAGCGCCTATATGAATACCATCTAAGTCAGAATCCGAAGTTACGAGAACG
TGCTCAAACCCACCTTTTACGATGCGTTTTCTTTGTGTTATTCTTTGAGCTTTGTATTGC
TTCAATTGTTCAGGACTTGGTTGTATTTCTTTAATTGAAAATATCCATTTGATCTCCTTTA
CAATGTTATTATAATGTATTAATCCTTAAAATATTCTTAAATTTTTAGTGATTTTAGCAG
TTTTAGTATATTCAATAATTAACACTACAGTGTTATTTTTAATAATTTACACTACAGTGT
```

FIG. 17AB. Continuation of (CJLB-15-1 [organism=Campylobacter phage CJLB-15] partial genome contig_1)

```
TAAATCTTTTAAATTTAAATTTTTCACATATTATATAATATTAAAACTTAAAAATTTTTA
AATCTAAAGAATATTTAATCCAATAGATTTTCAACACCTTGTACAATTTCTTGACCTTCT
TGGCCTATTACAGTATCAACTATTTGTCCAATTACACCTTTATCTTCAATAGGTTCAAAA
TCTGAATATGCAAAAGTTACACTAAACATAGATAACTGATTTTCATTTTCATCAGAAACT
TCTACTGCACCTACTTCAATAGGAAAAGCATTAGTCAAAGCATACCCATATAGTTTTTCT
TTGACTTTGGTTAATTGCCAAATGTTTACGGTTGTTTGATAATTTGCTGGTAGTGGCTTG
CCCATAATCATATTTTTAAGCCAAGAAACACCACCATCAAACTCCCAAGCAGATTTAATT
TCATTAACCGCTTTCAAAGTTCCATTAGCTACCTCCATTAAGTCACCCATAGCACCACCA
AATAAGCCTGCTAAAGCATTAGTCCCTTTAGGTGTGGTATTATCTACTTCTCTCATCCAG
CTATCGAACATTCTTCTAAGTTTCATTTCAGAATCATCAGTTATATTAATAGTGTAAGTA
CCACTTAAGTCTGTTTCACCACGCATTTTATATTTTCTACCTTTGTAGAATATGTCAGTG
GTTCCAATATTTCTTTCAGGTAATGCTGTGCTTTGGCAAAGAACTGCTAATTTTTTAGAA
ACAGCACCTACTACAGCAACTTCTAGTAAGTAAGCATTTGATCTAACTCCTAAACCAGGA
CCTAATTGTTTCTTTATATCCGATAATGAAAATGAAAAAGTACCCATTCTAAACCTTAAT
TATCATTTGAATCATTATTAGTATCGAAACCCATTGAATCGTTGTAGCCAATGGCTATAG
ATTTCAACTCTGTTTGAGCTCGAGTTTCATAGAATCTTTTATTTTAAAAGAATCTTTAA
AAATTATTTCATTATTATGAAAATGTTTAAAATATTTAGCTTCTCTACCATCAGAGCTTC
TAATAATACATTCACAATCAAAGCTAACTTTAGATTTATATTTAATAATTCGTTGTGTTA
AATCTAATTTTTCACCGTTTATAAACCATTCAAATGTATATTTAATATTTGATGGATTAC
TGTCAGTAAAATCACATTCTAAGAATTTTTCATCCCTAATTAAATCATTAATAATTAAAT
CATATCTTGGTTCATCAGAATAGAATTCTTTTTCAAAGATATCACTCTCAACAATATCAG
TAAATGCTTGAACTTTTACAATATCACCATCTCGTGGTGCATAATGTAATTTTTCAATTT
CGCTGTCTTGTTTGATGTCATTGACCCACCAATTAAATTTAAATTTAATAAGTTCTCAC
ATTCAGAATCTATTTTACAGAGTAAATAATCTTGGTTGAATTCTATATCCTTAATAACCG
CTTTGTATTGATTTATAAAAGTTTGGATACCAGATTCTGTTCTTTAGAACCTTCGGAAT
AAACTCTCGTGACTACTGGATTAGCTTCAGTAGATTCTGGTAAATCAGTACTCATAAACA
ATTGAACTAATTCTATTAAATGTTGTTCTTTTATTGCTGGGTATATATTACCTCTTAAGG
TTAAATCAAAAGTGCAAGTTACAATATTAGTACTTAATTCATCCATAGATTCTTGATCTA
CACTAGTCGAGTTTAATTCTAATATACAAGAGGTATCTCCAAAATCTGGTAAATCTACTT
CTTTAATTCTTAAACAATAACTAGGATTAAAATAACTAGCGACTTGTTCTAATATCATAC
TAGCTTCATTCATTCCACGACATTGTATAATTACTTGATAAGTAAAATCATAAGGAACTG
AATTGAATTGATAATTTAATTTTTTAGTTTCACCTTTAATTATTTGTGATTTTCTATATA
TCTTAGCAAATTTATTTTTTGCTCTGTTGATATTAGCATTCATACCAGTAAACAAAAGTA
TACCTCTGGGTAAAACTTGAGTATTACCATTAAACATTTGATTATAAGATAATTGACTAT
AAATATCAAATCTTTCCCTGTTAGCATACTGAATAGGAACTATAGAATACAATGGTTTAC
CATTACTTTGAATAGTTTGTATTTCTAAATTAGAAAATAAATGTATCAAAGCTCCAGTAT
ATTTCTTAGGGTATTAAAATGAAAGAAAGCCATTAAGAATCCTCGGCTTCAATACTAGC
CCATCTAGGTTCTTTTAATAAACATACAAAAAATTCTTGTGTAGGCTCTCTTTTTGGTTC
TATCATTGTACAATCCTATAAATATAAAATTACAATTATATTTATCGAACTTTATTTATA
ATTATAAAGACAATATAAATATCTCTGTTTTCTTTAATAAAATGAATCAAAAAATAATAA
TGATGTTTCCAAATAATATCTTTTAAAAAGTCTTTAGTTGGCACTATCATTAATACAGCC
TTACATATCTAATTTATATTGAACGCATATATATAAGAACTATCGTTTGTTTCTGAACTA
TTAACACTAACTTCAAGTTCATTATCTACAGACTCTTCTACTTTCATACCGTCATCATTT
ACATAATACCATATAGCTTTTACATCAGATACAGAAGTCTGACCCATAATGTCCGCTACCT
ACATAAGTAATTTTATTAGGGACTTTTTCAGATATTAATGTTATTTTTAATTGTTTAGTG
CTAGCGTCAGACCATAATGAACACTGGTCAGCATTTCCAAGATACTCTTTGAATATATTA
GTAACACAATGATATGAAGGGTCGTTATATATTCCAGTAGTAGTAACATCACCTTTGATA
TCATTACCACTAGGAGATAAAGAACCTACTTCAGAATAACTAGCTAGATTACCTAAACCG
TCTAATGACCATAATATCTGACCATTATTTAATCCTTTAACAATTTGTTTTGTAGAAGCA
TACCCGTTGTCAAATCCTAGTTTTACACCACTCATACAACCGCCATACTGTCCACTTCTA
AGTTTAACGTTACAAGTTATTTCTATTTTTCTAAGATTAGGTTTAATCTCTTCACTAGTT
ATTATATTAACCCATTTATTAGCTCCAGCAGTATTGTCTATACACATATACAACTGTTTA
TTAGTTATATCAGAGTATAATGAACCTATTTTGTTAGGGTTTAATGAAAATGAAGGTTTT
CCATTTCCAGATAAAATAGATGAGTTATTATCTATAATATTTTTAAATTAGATACAGCC
TCTTCTATAGGAATTAAAGAAACTCCATCTTTAAAATCTAGTTTAATATTAATAGGTTTA
TTTGTATTATCGTTTTTATTTTTATATTAAACGACCTTATAAGTGTATCATCAGTGTAT
ATTTCTATTATACATTCTTTAGAGTATAATAAAGGATTGGTAGCACTTGTTCCATATAAT
TGTAATTGTATATTTTCTACTTCTTTAGAGCTTTCTAAAGTTACTTGATAGTAAGGATTT
TTTAATCCATCAGAACTTAAAAATACGCAATATTTTTTATTATACTCTCTGAAAGGATTA
CAAATCTCATATACTCCACTATAATCGTATGCACCATTTGTTTTTACTGTAGCTACAGCA
TTACTACCACTAGATAAATCAATACTTGAGATATTAAATCCTGAAGGTTTTGTTCTGTA
ATAGCAATATCATCTTTATATACAGTGTCATCTCCTGTTAAGTTTAATCCTACTTTTTGA
TTACTTCTGTCAGTAACTTCAACTCCAACAGGTTTAAGAAACTCAGTATCTCCTTTAAGC
TTAACTTTAAGATTACTTACTACAACTGTATCTCCAGTGGAGTAACTAGAGCTATCAGTT
TTTGCATATATTTTAAGTCTTATATTTTTAGTATTCTTACCTTCAATATTTGTAAAAGGT
ATTATAGGAGTTTCATTTATGATATCTTTAGTTGTAGTCTTTATACTTCCATCAAGATAT
```

FIG. 17AC. Continuation of (CJLB-15-1 [organism=Campylobacter phage CJLB-15] partial genome contig_1)

```
TCTTTATTTATAATCTGCTTATCATCTGTAATTTTATTACTATCTATGTTTAAATAAGCT
TTGTTATTAAATCTAGTTACACCATTTATTTCTTGATGAGCATCAGATGTTAATACTTTT
AAAGGTTTTAAAGCTTTATCTACTATATCATATACAGAACCACTCTCAGTTCCGTCCCTA
CCTATTACTTTTCTACCAGTTGAAACTAGAAAGTCTATAATTTTTCCTGTATTTTTCTT
AAGTGTATTACTAACGAACTAGCCCAATACGAAGGTGCTCCTATTTGTATAGTATCTGCT
TTAACAGAGCTTCCTATCTTTAGTAGTGTTATTTTAAATGGACAGTTCATATCTAGGTTT
GAACCCATATAATAATCATAACATAAATCAGATACAGAACCCCAATATTCTAACATAGCT
CCATACCCGTATTTAGCAGAATATTGCTTAGCAGTTGAAAATGATATTTCTAATAATATC
TCATTTTCTGCTACTTCATAAGATTCTAATGTTGATACACTATCAGAATAAGTTACATTT
GTTTTACTATTATCAGAAGTGAGAACTGCAATAACTTTAGTTCCACTAGTTGTATTAAAA
GCATTTGAAGATACTTTATAAGCTTTATATGTAATATCTCTTATAGTATCTTTTATATTA
ACATACCCACAATATCCTGTTCCATAGCTTGCACTACCACTAAATGAAACATCTATGTAA
TCTCCATTTTTTAGAGTTACAGGGCTCTCATCAAACATAGATTGCAATATATTATTTATT
GTTTGTTTAAATTCTTTAAGTCTTACAAGTTGTAATTCCATATCTGCAGGCTTTAAAGAA
CATATATTATTTTCTAATAAATGTATTGATTTGATTGCTTGAGATATATTACTATACAGA
ATATCACCTACAGTTTTGCTTACAGGAGTATGAATATAAGTCATATCTGCAGAATCATAA
ATGTTTCTATAGGATTTAGTTCATCAGTTTTAACTGTAAGTTTTTCTGAACCATTTGTG
GTCATAGATATACTTACAATATCCGGAGTATTAATGCATAGTTTATCTATTTTATAGAT
ACTTTTCTATTATTTGTTATATCATTTTGACTTCCAAAATAATAATCATATATTAAATCT
CCGTCTTTTTTATTAGCGTTTCTAGAAAACATAGCTCCATAACCATATCCACTAGAATAA
ACAGATACAATATCGTAAGATAGTATAACTCTAACTTCTCCTTCTTTAAGCTCATATTGT
TTAAGCTCATCAACTGTTTTAGTTATGTCAAAATTAACATCTATATTTTTTGTATAATCT
ACTCTAGATAATATTACAACTGTTTCTTCTGAAGGGCTTACTGTAAAAGACTTATTATCT
GCCATAATAGCTTTATAATCATTACCTATAATGTCTTTTAAGAATACATTTTTTAATGTT
TGTGCAGAATATGATACTGGATTTGCATATCCAAAAGTTATTTCTGTAACAGAATTCTGT
GTAAGTGCTGTATGATCAGGGAGTTTTATACCTCCAGGATTGTCTAAAATATATCCCAAA
TTAACTGCGTGATTTCTTTCAGAAGGAACAGATTCTAGTAAAATATTGTCTAAATAAGTT
TGATCCCCTGTAAATGTATTTGATTCATTAGTTTTAGCCGTTGTTTTGAACTTATCATCC
ACACTATTTATAGCATTAACTAAATTATCTTTAGAAACTTCATTATTTAATGAATTTAAA
TCACCAACAACAGATTTAACTTTATCATTTATTTCTTTTATGTTATTGTCAAATTGTTTT
TTTCTAATAACGTGATTATCTAGTGTTGCATCTACTTCTACCGAAGGTGCTTCTGTAAAA
GTATTAGCTTTTGTAAAAATATTAGCTGCATCTTTCTTTGCATAATGAGTTAAGTCAATT
TCAGGTGGTACTATTGCATCTATTTTATTATCTATTTCTTGTTTAGTATATGTTCTTCT
TTTGTAGCAAGTCTATCTAAATTTAAATCTGTTATATCAGCTACAACGTGTGTATGATTT
TTATCAGCTTTGTTATTAATACCACTTGTAAATTCAGTCTTGGTTACATAATCAGCTGGA
GAAATACCACCACTAGAATTATCTTTAAAATATTTTAAAGTAATTACATGGGTATCTAGT
GTAGGTTCATCACTTATATTTACTTGTTTTATGTTTTGTTCTTGAATAAAAGTATTTTCC
TCACCTAACTTCGCATAATTAATATCATCAATAGTTATGTTTTCAAATTTATGATCAATC
TCTGATTTGTTATAGACACTGCCAGCGTCTGCTTTAAGATCAAGTTTTGAATCAATTTCA
GATTTATTATAAACATTGCTAGCATCTGCTTTCAACTTAACATCATCCATTAAAGCTATT
TCTTTAGAATCGTTATAAGTTGGTCTGGTTCTGACCCATTTAAGTTAATAGGAATTTGG
GTAGATCCTAAATCTACTTTATCCCATTTAGAAACCATAGCAATATTGATACCTTCACCA
GTAGTACTAACACCGGAAATGCTATCATAATTTTTAAGTTGTATAGTTTTGCGAGTATCA
TCAATTTTACTATAGAAAACAGCTTCTTCAAGTCTTCTATTGATATCCGTTATATCACTA
GTATTATCAACTACTTTTGTATTTAAATCTTCAATAGCTTGCTTATTAGCTTCTGCTAAT
TCTTTAGTGTAATCCGCAGTAGATTCAATTGTCGTGATTCTTTCTATTAATGGATTTAAC
TTAGTATCAATCATTTGATTAATAGCAGTTTCATTTATAGTTTCTTTATAAGCATTTAAA
TTGTCAAGAACTTCGTTAATAGCATTAATAATTAAATCTTTAGATTCAGTTTTTAAATTA
TTTAAATCTCCAATAGTTTTACTTAATTGATCTTTAACATAATCTATAACATACTGAGCG
TTAGCAGCTTGTTTAGATTCTGTAGGATTTGGAACATAAATCTTATTAAATGTTTTAGTT
CCTACAATAGTCTGTTCAGTATCTAAAGTTACTGCGTTTTTAAGAATTCATTAATTTTA
TCAATTTCAGCAGTTTGTTCTTTATTAATATCTTGGATAGCATCTAAAAGTTTATTTGTA
TTATCTATGAATATTTTAAAAGCTTCTGAATCTTTCTTAAGTTCTTCTATAGCTTCTTTT
ATAGAATCTATATTATCAAAACTTTCTGTACTACGTATTAAGCAATAGTTCAAAGCATCT
GATAAATCTTTTTCAGTGTATCTACCCAGGATCAATAGGTTAACAAATTTATCAATAGCT
TCTTTTGTAGTATATTTTGGATTTTTTATATATTGATTTGTTTCAATACTTGTAGCTTTA
GAATTATCAGTGCTGACCATCTTGAACCTTTTGATTTTATTTATTTTGATTACTTAAAAT
AAATATATCAAAAATGAGGCTTTAAAATTGAATTTTAACCAGCATACTAATGAATATGAT
CTGAGTGGATCTGTTACCGAAGAACTCATTAGACTTTATGGTGCTCCACTTAAATTAATC
ATTACCAAAAAAATTAACAGGGATTTAACATTTGGTGATTTAGTCATTTTAAAGCGGAC
AATAGAGCTTGTTTTGAAATATTTGGTATGCCAGAAAATTCAGAAGAGTTTGACCAATAT
GAAAGATTGCAAACACAATTTGGTGTCCCATTAGATACAAGTATAGGTTTATATGTTTCT
AAAATTTCCACATTTAATTTAGTTCAATCTTCAATGAATTCTAAGAATGAATACGATGTA
ACTTTACCAGATTCCAGAATTCACGATTTAATAGGATGCTTTAATAATCGTTCCAAGTGGA
AAGATTCTTGAAATTACCGAAATTACGTTAGATTGTTTTGGGTTAAATAACGTATTTCTT
TATAATCAATATAAAAATGTTTATAAATTTAAATGTAAAACTTATGTATTTAAAAAATCT
```

FIG. 17AD. Continuation of (CJLB-15-1 [organism=Campylobacter phage CJLB-15] partial genome contig_1)

```
GATGAACTTGAAAGTGATTTTGTTATTAGATCTGACGAATTATTAGACAAGCAAACACCT
AATACAGATATGCATAACGAGCTTGAAAAATATTTCGATGAATTGAGTTCTATTAAAGAT
AAACAACAACAAGAAACAAAAGATTTTTATACAAATTCTGATGATGTATTTGGTAGGTTC
TAATGAATCCGGGAACTCAAAGTCTATTTCTCACGCTTGTGATGTCAAAGATTTTACTT
TATCTATTCTTAATAATAAATCAAGTAAATCACTTGAATTAAAAACTGGAGAAACAAAAT
CTGGTGAAATCTCATTCAATGGTTTTATCATCTTGTCTTATTTTACAGTCAATGGTACCA
CGGATTTACAATACTATTTAGATCAATCCGGCGATATGCGATTTATTCCTTTTATATTAG
ATGCTAGTGAAGGTTACTATAGAAGAGAATTTCAAGTTGTTAAAAATAATAAAACTCAAA
CAACTGATAAATCCAGTTTTACAATACAAGGTCAAGATTTAATATCTTATTTGTTTAGTA
AATTATATATAGCTAAAACATATAAAAATAAAAAACTTTCAGATATTTTTAAAGATATAT
ATGATACTTATATTAAACCAAAATTAAAATATAATCCAGATTCTGTTAAATTGGAATTAT
CTAGCAACATCGTAATTGAAAACTTCGTTTTAACTTCACGAAAATCTGTATTGGATTTCA
TATTTGAAGAATGTGATAGACAAGGATTGATATTATTTCAAGATAAACAAAAAATTATTA
TGAAACCTTATAAAGAACTCAAACCAAATAATTTAAAACTTCAAAATATACAATATGATG
ATTTTAAAAAAGATCCTAACAACCCTTATGATATTTATCTAGGAAGATTATAAACACAA
ACCAAGCTCTGAAATTACCGAAATCACAAATAATCGCATTTGATAAAGCTACTAAAACAA
TGAAAGTTATGAAAATTAATCTTGAAGATTTAGATTTCGATGTTCCAGTAGAATCTCAAG
ATCACGATGGTTTTGAATATCAAGCTCAAGATATTTGTACGATGATAATATTTTTGCTG
ATACTTATAAATCGTTTTTAGATTATTCTAAGTTAGAATTAGTAGTACCTGGAGTTGTTA
AGGCGCCAGAAATATTCACAAAATACAAAGTATTATTTAAATCTAACGAAAATACTAATG
AAACTCAAGAAGGAGACACTAAAATTTCTGGTGAGTATATTTTAACTGGGTTTATAGATA
AAATAGAAAGTTCACAATTTTATATTACAAAATTGATTTTATCAAGATTCAAGGATACTG
ATATTCAACAGTACTAGCAAACTTAGAAGTTTACACTTTAGTGTCGTTTAAGTTCGTTAA
CACTAAAGTGTAATATTTACTAGTTCTTAAAAGTCAAATGGCAAGTTTGTTCGTTACCCC
AAACCATATCGTAGAAAACAATAGTATTTCCGTCTTTAATTCTAAATGTAGTGCTGCTTA
ACTCTCTTATAGATGAAGGTAAACTGTAAATGTAATTATCCCATTGTGAATCACCATCAG
AATCTTTTAACTTAAAAAAGTCCCACAAATCCTCGTCAGTGTCGTCAAGATATCCACAAC
CTAATAATTTTGATTTGAGTTCATCAATTGAACAATTGAGTTCAAGTCTAAATGATTCAA
AACCTGTGTCACAATTTGAACATTGTAAATCGGAACTAAATAATTTTTCTTGTATTTTGT
TGTGTAGAGCTTCATCGTAGCTGTTATTCAACATAATATTAATAAACTTTGTTGTTAAAT
CTTTCATTTTTGCTCCTTTTAATTTTATATAATTTTATAATAATAAACTTAAAATAAAAT
TATTTTTTTAAATATTTTATACATTTATCAAGCTTAGAAGTTTACACTTAGTGTTAAATT
TAGATCTAAAGTACAAACGAACTAAGTTTAATACTACAGATCTAGTAAATATCATCAAAG
CATTAAATTTAGATTTTTAATTTCTTCTTAAGTCTTTCAAAAGCAGAATCTTTAATTTCA
GTGTCTAAAATATCCATTTTATAATTTGTTATTTCAGATTCTTGCGGGAGAACTTCATTT
TTATCATAATTAATATATGTTTCCACCCAAGGTATAGGGTTCTTATTAAACCCAGCAAAA
ACTTCTTTGAATCCAATAGCTTTTAATCTTTTATTAATAAGATATTTAATATAATTCTTG
GCTAATTCTGGTGTCATACCTAAGAAAGCACCTTTACTAAACAAATAATCAATCCACTTA
AACTCTTGATCAGCAGCTTCTAAATATCTATCAGTTATATTATCTTTAATAGAATTCCAA
GCATTTATAAAGCCTTCTTCAGGAGATCTTGACAATATCTTAATTAGATTTTGAGTTATT
GCTAAGTGTAGGTTTTCATCTCTACAAATTAATTGTAAAATCTTGCCAGTTCTTTCCATT
AACCCTTGGCTATAATGCATACTCCAAATTGTCGCAAAACCAGAATAAAATCTAACACCT
TCTAATATATTAATTTCGACTAACATATTAAGAACTTTTACTTTAACTTCTTCAGTATCT
ATTAATCCTAAATGATACTTTGTTACAGCTTCAAAAGCTTCTTCATATGGTTTTGAAATA
CTATCTGCAAGTTCTAATAATTCTGGTATTTCAAAAGATTCATCAAATATCTTACTTGGG
TTAGCATAAACAGATCTAAGAATATGAGTGTAACTTCTTGAATGTCTTGAAATTTCAAAT
CTTTGCCATTCTGTCATACAAACTTCTAGTTCTGGGTTAGTAACAATAGATCCAATAGTT
TGTAATAAACCCCTGCCTTGAATAGAATCAAGAAAATTAACTTGTTAACACTCTAGTA
TAAGAATGTTTCATTGCTTCATTTAAGATATTGAAATCTGCTTGATCTTTAGTGCACTGT
ACTTCATCTTCTTGCCAATCAAAACCAGCCATTTTCTTAAACAAAGTTTCAAGATAGGA
TATTTTATAACATCATATCTTTGTGAGTTTTTACCTGTTCCAAAAAATAAAGGTTCTTTT
GTAAAATCAATATATTCATTATTATATAAAACGTTCATTAAAATCCTTGGTTCTTAGCTC
TAAGCCTTTAAAATCAATAATTAGCTTTTATGAAATCAATTAATTTTTATGCTTAGGAA
ATGATTCAAAATAATTTTTTTGTATTCTATATTATAAATCATTTAAAAAATCAAAT
TAAATTCTGGTTCTATAAGACCCTCAAAAAATACTATTTTAGATTTATCGACTTCAATTA
AATCCCTAGCATATCTTAAGACGTCATTGTCTTTAAATTCATCTAATTCAACTTCAACTT
CTACGTCTACTTCTTTTGTAACATACATTTTAACTCCTTATGTTTATTCTGAATATTCTA
AATCATTGAAAATTAATTCTTTGTGTAGATCTGGTAATGCATCAAACAACAATTTAGCCA
AATACCGAATCTCGAAATGAGCACCTTTAGATAATCTTAGTTCTAATAGATTTCTTAAAC
TTCTAGCATTTAAAGAAAATCTTAATGAAGTTCTGTAACATTCTGGTAAACAATACTTGG
CGTAGTCTTGGGTAATACCGTTTGTATTGACTATGTTATGAAGTTCTTTTAAGTTTTTGT
GGCTTGCAGCATCTACTAATTCATTATCAGTTAAAACAATAAACTTACTTGCATCTTCTA
ATGTAGAAATATCAGCACCTCTAAGTTCTTTTAGTGTATATCTTGTACTCTTAACACTGA
ATGAAGCCATTCTGTGTCTTGCCAACTCTTGCAAACAAAGTCTTGAAATTCCTGTGATTT
CAAAATTATAAAACAAATGTTCTAATGTAGAATGGTGTTTATGTTTGTGTACTATTCTAT
CTATTAATGCTTTATCATTTTCTCCTACATTATCACCATTAGTATCACATTTACTATGAC
```

FIG. 17AE. Continuation of (CJLB-15-1 [organism=Campylobacter phage CJLB-15] partial genome contig_1)

```
TATCCCAGCAAGTTCTGACAGCGTCAATAAAAACATTGATACCAGAATCTGCTATTAATT
TAACTTTAATATTTTTCACTTAAGCTCCTTAATTTGCTGTATTGTTAAAGTCTAAAATCT
AAGACTTTAGTCTAATATTTAATATTTAGAACTTAGATTCGATAGGTACTCTGTTATTAC
CAAAAATATCCAAATCTTTAAACTTTAGTTTAACTGCTTGGGGTAAAATGTGGGTTTCTCG
AATCTTGATTATACGGAAAACAAAATGATTTAATAGGTATATTATGATTCTCAAAAAAAT
CTAAAGAATCTTGAATATCTTTTATTAAAGATTTAGAATCTTTAAAATATTTATGATTAT
AAGAATGTGAACCTATTTCAAAATTATACATATTTTCCCTTGAAATTTGCTGAATTTGAT
CTAATGTCATATAATTTTCAAAACAGCCTTTAAATGCCTTTTTATGGGCGTTATAGCACT
GTATATACTCTTTAGATTGTTCTCGGAAGATTCGCAAATTATGGACGGATTTACAAAGA
ATATAACACGTTTAAATAACGCAAAATGACTTCTATAATGAAATTGTGTATATAAACCAT
CATCAAATGTGATTATGCTGTCTGGGTCTAAAGATTCTACAGCTTTGAGAACTTTATCAT
TTACTTCGTGAATCATTATAATTTCACTCATTATTTTCCTTGGTTTTCTTAGATTTAATG
TAATTAAGAACGCTTATAAACAACTTCAAACGGCTCCGCAAAACCTAAATTGCTATAAAT
CCCTACGAACTCATTAAAAGCTAAAATAGTTTTGATATGATTTCTGGTATATACTTTTT
ATATTTAGATAAAAACTTAAGTTTTTCATCTTTATCTATTTTTTAAATTCACAAGCTTT
TAATTCAAATGGATTTTCAACATAATAATAACTTAAAGATTTAATATAATCATTTCTATT
CATTCTAGCAGCTATTAGGGTTGCTTTTGTAATAGTATTTATGATCTTGATGCAAATCTTT
TGGATGGTGAACATAAACATTTTCTGGTTTAATGGAGTCTAAAACGTCTTTAATATTATC
AGCTAATTCATTAATATCAGGCATTTTAAAAAATGAATATTTTAAACATTTTTGATAATC
CAAAGCTAATTTATCTTTGACTTTATTACGTTCTGTGTTAGCAGTACTATAATCATTTGT
GATGTATAGAACACCAACAGAATCTTCTAGTAGTATAGAACTACAACCAATTACCTCATC
ATCTGGATGACCTGCAATTATTAAATGTTTTAGCATATTTACTCCTTGTTGATTTTAGGT
TTTAAATTTTATCTCAAATGGTGGGTCAATATAATACAAAATATTTTTAATACCAGTTT
TTAAATTTGTAAAATCGATATGAACAACTTCGCTTAATTTAACAATACTAGGAACTCGTC
TTTGTATTTCATAATCATTTTCATTTTCAATAGTTTCGAATTTATATTTTATATTATACC
CAAAATCATTGAATATTTTTATGATATCTAATGGATTTGCTCTAGCCATAGGATTTCCTA
TGTTAAACACACCGCTGACATTTTGTTTAATTAATTTATAAAGAATTTTATTAAAGTCAT
CTACATAACAATAGCATCTTTCAGTCCCTGTTTTTGGCTCAGCATCGACTCTGATTTTAA
TCACTTCTTTAGGATTGAAAGCTGCTGCTAATACTTTAGCAATGAATCCATTATTTGGAT
TTTGACCAGGACCGTAAACATTAAAAGGTCTTATTATTAAATAATTATTTGTTTTTGATT
GGATATATCTTTCCATAAAAAGTTTTTCTAAAGCATAATTAGATCTTAATTTAGAACTTA
TAATTAAATCACTGGATTCTGAGTAATCTTTAGAATCACCATATACTTCAGAAGTAGAAA
AATATACAATCTTTTTATTGTATTTAGTGGCTAAGTCTACAACAATTTTATCATTTTTAA
AAGATTTAAAAGGTAAGTTTGGGTTGTCTACAATATTTTGAACGCCTAAATGGCTTGCAA
AATGAACAACTATATCACTATTTTTAATTAAGTTTTTAAGCAACCCAGATTTCTTAGCAT
TTTTAATACCTTGTGTACTATCAGTATATTCGCCTGGATTTACATCTAAGCCAATTACTC
TTGGATTTGAATCCAATGAATATAGTATTTTAATAAAGTTAGATCCTAGGAAACCACTGG
ATCCGGTTACAAAAAATTTCATAGACAATTTTTACACCCTTTCGTTCTTCGATTTATATTT
TAGTTCTTTAAACTTAACATTTTAGTGTTTTAGTTCACAGAGATGAAATCTTTAACTCTT
TGTGAGTACTTTGATTTTAGATTTTTAATTTCTTCTACACTCAAGTGTTTTATTTCATTT
ATTTTTTCTATTATATAATATATCAGCTCTGTTTCTAAATTTTTTGGATTTTGAGATTTT
ACAACATTTAATGATTCTATGTTTAAAAATTTAAGAAATTCTGAATCTTCAGTTTTAGAA
CCTACTGGCATATTAGACTCATCAAGATCAATAATAAGTCTATGAGTTTTAGATCCTTAAT
TTGTATTGCAATTCCTTATAAGGTCTGATGGTGATGCCATACATAGGTATCGACTCCGAA
CTATTATTGAAAAGATATGGAATCATAGAATCACCATTTACAGGAACACTTAAAGCAGAA
TCTAAATCAGTTGCAATTCTAATAATTGGATTCGTTTTGATACCAGCTAAAGTGCAATAA
TCTAAAACATTATCAAATCTTCATATTTGGATTCTAGTGGTTTTGAACCGACTAAAATG
TCATACATTATGACTGCATATCCTGCGGTATCAGAATCATTAGACTTGCTTACTCCAATA
GGAAATAATGTCAAAAGAACTCAATATGGTCATCTTCTGGGTATTTAATATTAATCAAT
TCAACCAATTTGTTAATTAAACTAACTTCATCAATAGTATCATTAAGTGCTTTAATTTTT
GGACTTTTATTAGATTCAAAATTAATTGGTTTACTTTTAGTAAAATATTTAATAGAGCTA
TTTATTTTATCGAACTTAATACTGAAATTAAATCCTTTTATAGTTTCTAAAACATAGAAA
TGTGTTCCTAAATTTTCCGGACTTAATAGTGTATCCTCGATAGCTTCAATCATTTTATCG
GTTTTATTCATTGTTTTTAACCTTTGTTTATTCTATTGATAGTATTATATTATGAAAATA
CTTAAAATATACTTAAAATTTTAAGCGAATATTAATACTATAGTATAT
```

```
>CJLB-15-4 [organism=Campylobacter phage CJLB-15] partial genome contig_4
TAAAGCTTAAAGCAATATTAAAAAGTATAAAAAATGCTTGGCTTTTTAGTAGTATATACT
ATAGTATCATATCTAAAGCTTAAAGCAATATTAAAAAGTATAAAAAATGCTTGGCTTTTT
AGTAGTATATACTATAGTATCATATCTAAAGCTTAAAGCAATATTAAAAAGTATAAAAAA
TGCTTGGCTTTTTAGTAGTATATACTATAGTATTATATCTGAAACTTAATATAAACTTAA
ACTCTAAAACGACATAAATAATATAAAAGGTTCATATGTATTTAAATAAAGAAACTAACG
AATCTACGTATACAGCAAAAGAAATTAAATCTGATTATTTTACTAATAAATTACATAAAA
ATATTAAAGGCACTGCTGGTTATGTTATATTCTTTGGTATATTCACAGCAGTTTGTTTAA
TATTTCAATGCTTAGATTATATCATAGATTATTATATACCAGGTTCGGGTATCTTTAATA
AAAACTTTCAAGTCCCAATGGAAACACTAACCACACTATATGCTACCCTATGTTGTGTAT
```

FIG. 17AF. Continuation of (CJLB-15-1 [organism=Campylobacter phage CJLB-15] partial genome contig_1)

```
ATGTGGGTGTCGACAGAACAACTTCTGTTATTGCCACTTTTAAAGGAACTAAAGATTCTG
CTAATTATGGTAACCCAGAAAGAAATAGACATATTATAATACAGAACTTTTTTATATGTT
CTTTGGCTTTAATTCTTAATAGATTTTTTGATGCAAATCTAGGATTAGAACCTTTGTTAG
TATCTTTTGGTGGGTCGATAATCTTATATGTTTCTGGTCAAAAAATTGTTTATCAAGCTA
GTAAGTTTGCACCAGAAAAAGATATTAATAAAAATGGGATAGACGATAGAATAGAAAATA
ATAAAGATTTGATTAATGTTTTAAATGAAGCAGTTAAAAATGATAGACATTTTAAAGTAT
ATTATATAGACCCAAGAGGTGTAGAATCTTTAGAGTTTGATTCTAATCCTAATGATAACA
CTCCTAGTATACCAAATGAACCAGCAGTACCTATTCCAATTGAGCCAATGGTAGAACCTA
TAAATCCAGAATCAAACTTAATAGAATCAAAGAGTTAATCTTTTACCATTAACTCTTTGA
GTTCGTTTGCGTTTTCACTTACATTATAAACTTTATATTCAGACGCTGTATTTAGAACTTA
GTTTAGAACTAACTACTAAATCTGGATTGTCGTTGATATCCACAAGTTTTAAACCTTTAT
GAATTACAATTAATTCAAATAATCTTTTTAAACTCATTTGATTATAAACTTTATAATAAT
CATATATTGGAGCAATTTGATTAAAAACCATAACCACCTGAGTGAGAACCTCTCATATTAA
ATGGTTCACCAATAACTTGTAGAAAACCATTTTGAATTCTAAACGCACATATATCTTTGA
AATCTACATCAACATTGAATTGAAAAATAGCATCTTGGAGATTTATAACACCATCATTAT
TTTTAGTATCACCTGGTAGAACACCAACAATTACATCATATTCACTGAGTGAAACTTTGT
TGTAACTATGAACATTTACATATACTTCTAAATCTGATTTAGGATCTAAAGTCAAAGTAC
AAAACTCTGCTGTAATTAATGGATTTTTAGGATCAAAACTTCTTGAACTGGTCCAATCAC
CAGAGTGTATTTGAATCTTACCATCTATGCTAGTTTCAAGTTTTGTATAATCCAAAACAT
TCTTTAGTGAACCTGAACTATCTCTGAATAAACAAGATAAATCTAAGTCTAACGAACCTT
TAGAATTATCCTTCCTTTTCCAAGCAACGAATACTTGAAATTTAGAATCTATTCTAAGGC
TGGATCCTTTTGGAAAGAATATATCAGTTTTTAAAGAATCTTTAGGTTTAATTGGAGGAA
CCATAGTTTCTAAATCATCAGAAATTGCTATTCTTTTAGCTGAGCCAAAATCAATTAAAT
CTTTTTTAGATTGTAATAAAATTGAAAATAATTTACTTAAGACTTCCCAAAGATTACCGC
TTGGTTTTTTAGCTTCATCAAAATATAAAATATTTCCTTTGATATTAGACATACGAACTT
TACCAGTTCTTTTATAATTAAGAACTAAATCCAATAATTGTTTGAGTGTTTTAGGTCTAT
GATACAACAAAATACTAAAATCATTGTTATTAGTTTTAGCTGCTAAATTAAAAACATTTT
TATAAGCTAAATTTATATTATACTTATAAATTTCAATAAAAGCATTATTAAATTTTACTG
GGTTATTTAGTAAAGTTCTGATTCTATAAGTACCCGTTTGTTTATAATCTCTTTTTAATA
TTTTGTTAAAAACATAGTTTGCAACTATTAGATTTTTATATCTTTTTTGTGTTGTAACAA
TTAAATACTGTATATTTTGCCAGAATTTCTTGTATATTAACATTTCATTTAATATAGTTT
CACGATCCAATTTTAATTCATTAATAGAATTCATAACAAAAGTTTTAATATATCTAGGTA
AATTGAATTCTTTTGTGTAAATTCTATCTAATTTGTCTATATCTAAATCGTATTCAGATT
TAATTAAGCATTTAGTAATAGTTCTGACCGCATTAACATTTCTGGTTTGTATTTTTTAG
AGAATTCCAGAGCTTCACTAGGATTTAAATTAGAAATCAAAGTTTCTAAAGCTAACTTAT
TTGGAATCTTACTTGGCATATATTTAAAACCATATTTTATTATGATATCTTTTTCATTAT
CCGTAGGATTGAATTGAGATTCTAGGATGTTTTTTGTAATTTTTTCAATTTCAGATTCTT
GTATTAAATCTAATTCAACTAGTTCTTTGTTTGGTATTAGATCACTAAAATTAATACTTA
GAGTATAATCGTGAGTATCTAAGTTAAAAATATATCTTAAGACATAGTGATAGAATTGAT
CTTCATAATCTGAAATATCTCTTAATTTATGAGTATATTTTTATAGAATGTTGTGCCTG
CAGCTAATACTATAGATTCTTCAAATGATTTAAGATCAGAATCTGAAGCATTATTAATAG
CTTCTAACAATGTCTGGCTTGGTTTATAACCTTTTAAAAGCAACTTATAAAGAACTGAGT
TTACATTTCTTTGCGATGGTTTTATATCTGATTTATCGATATAAACTTTGTTTACTGTTA
AAAAATTTTTAAAATCTACCATTATATTTCCTTTGTCTAACCATTACTAGTCTTGTTTGA
ATTAACCGCGGTTGTAAGATCTGTTTAATATATTATTGATCTTTTTTATTTCAACTTTAA
TATCAGATATGATATCTTTGTTACTTTCTGGGTCTTTGATCAAGATTGATAATCTTTGAT
TTAAAGAATCCCTGTAATTTTTTAAAACTTTGTCTTGTAACATCTGAATCTCCTTTTTAA
TTTATATAATTATATAATAATAATCTTAAATTAAATTGAAGTTTCAGATATTTTTGCGTA
TTTTTAGTAATATTTAAATATATGTATAGAGGCTCAAAAATCGGCTTAAATCGATTTTAG
ATTTAAAGTGATATTTAAGTATATTTCAATATATTAAGTGGCTTGGGTTCTATCTATAGT
TAAGAAATCTAAGCCTAAAGAAACCATATAAGCTTTATATTGATCATAATTAAAGTCTTC
ACCTTTAGGCCCTTTAAATCCGTGTGCATCACCATATTTTTTACAAAATAATGCTGGATC
CATATTAGGAACTACTGTAATATAATAATTTTGAGCTATAGTTCTTTGAACCTTAAGTCC
ACCAGAACCAGATTCACGAGTATTTTTAGAGCCAGAACTTGAGTTTGAACCCGAATTAGA
ATATTCCCAATAAGTAACTTCTACAGTAAAAGGAAATGTTAGTATATTATTATCCCTATA
ATATCCAGCAATACCTTTAGTTCCCCAGGATTTGCCAGTATAGTGCATATCTTGATTTTT
AATATCTTCTATAGTAGCTTTTTCTTCATAATTAGTATCCTTAAATTCAGTCCCATCTAA
CTTAAAGCCACTCCAAAGATATGTGATCATTTTTGGATGATACAAATCAACATCATCTGG
CAGACCAGAAAGAGTTAAAGAAGTGGGTGTCCAAGTTTTCTTAGGCCTTTAGGGACGTG
TTCTACACCTTCATCAACTATTCTAGCAGATATAAACTCTTCATTAGTTTCAAAAGACCA
AACTATCGTTTGGCTATAATTTTGAACATTTCTAAGGTTCTTAGAATTTAAAGAATTAAG
TAAATTCCCTGCGGGAGTAACGAACTTAGCCATTAAGATCCTTTATTTGATTTGACTATA
TAATCGTTGTTATTTAGCCATCTTATTATAGGTTCTCCTTTATAAGATTTATCCCAAATA
TACCAAGCATATACCATCATACCAGCTTTATAAGTTCCATCTTCTCTAATAGTATCTTCA
AGTAAACCATATCTACAAAAAACATAAACAGTTTTTAATGGAAATCAGTATCCTTGTAT
ATTTCATTATATCTTGAAACCCCGTGTAAATAATTCAATGGTAATAACATTGCAATTTTA
```

FIG. 17AG. Continuation of (CJLB-15-1 [organism=Campylobacter phage CJLB-15] partial genome contig_1)

```
TTATTTGCTATTTGTTTAGCTTTTAATATAAATTCTTTTGCTAAACTAAATGGCGGATTT
GTTATAATATTATCATATCTATCAAATCATCATTAATGAAATCTTTGAAATCTTTGAAG
ATACCTGTTAAACTAAAATCATTGTTTAAATCACAATAATCTACAGATTTATTATAATCT
TTTAGAACTTTGACTATTGCTCCAGCACCACAAGAAGGTTCTAGTATACTTCCTTCGAAA
TTTTCAACTTCTAATAATTGTTTAGTCATACTATAAGGTGTTTGGTAATAGTCATTTTA
TTACGTTTATTTGAGTTTAAGCTAAAATTTTTACCTTTCATTTTTACCTTTCATTTTTAT
CCTTTGGGATATTATATTATAAAATATCTTAAAGGCTTCTTATATAGATTCAAATAAATA
ACATAAAAGGTTCGTAATGAGAGATTTAGCTCTTGGTGCTTACACGCAAAAGATTTAAC
CAAAAAGTCAATACTATTGGTGATGTAACAACATTAAAAACCGAAGCAAAAACTACAGC
AGTAGGAGCCATAAATGAACTTAAAGATAATTATGAAAAAATTAAAAATTCTATAGATAC
CAATACCGCTAATTTCTTAATAGATCAAAAATTAGATCCGGTTAAAGAAGATGTTAAAGC
TTTGCATACACAAGTTGATAATTATTCTATAAACATATAAGCAATCAAATGATCCCACAGC
TTCTATAAATCCTACAATCGATAGTGCAACTTTTTTAAATACAGCTACTGGAGTTATTTG
GACTTGTATAGATAAAACAAAAAATAAAAATCGCTGGATAAACGGAAACGGAGAAGTTGC
TGGTGCACTTCCAAGTAATCCAAATCTTGGTGATATTGGTTTTGGAGTGGGTATTGCACC
TAAAGAAATTACTAACAAATATAATATGTATCCTATGCTAGGAACTTTTACTCCTGGTCA
TATGAATTATGGAAATTATACTGATATCCACGGTAATGTTATGGTTTGGATACCTAAACT
TTATATTAAGACTTCAAATGTAGACGCTGCACCATATTACGGATTAAAAGTTGAAGTTTC
CGCTACTCAAGAAGAAGGTTTTTGGTGCCATAGAGCATTTATTAATAATGGTAAAGAAAT
TCCAGGTTTTTTTATAGACAAATATCTAGCATCTAACCAAGGGGGTATTTTAGGTTCTAG
GCGTAATACAGTGCCTTTAACCTGTGATTCTAAATTTAACTCTGTAGCTTTAATCTCAGG
AGTTTCTGCAAAGGTTGCTTTGGGTAATAAAATTACAGAAGATTCTGATTTAGATTCTGA
TGATTTAAAATCTATTAAGAATAGAAATTCAAGCTTCTTAGAAGCTGTTAAAAATAGAGG
CCCTGAATTTCAAGTATTAACTATATTTGCTTATAATTATTTGATTTTGTTGTCTAAATG
TATATATCAAAATGCTTATAATACAAATAATTTCAATAAATATTGAGTTTGCTAAATCAAG
AACAGATAGATTTGCATTTATTCAAGGTATGAATACTATGCAAAGTGTGCAAAGAGATAT
TCAAGCTATTCATAATTTAGATTATAAAACTGCTGGGTATACGGATGGTACTAACGCGTT
GTATAGAACAGGTAGTGTTTCAGATTCTAAAATGGGTAAAATTAGTCATAATGGTCACGC
GTGCGGGTTGTTGATTTAGTAGGCGGGTTATTTAATCTGGCTATAGGCGCTATGTATGG
TTATATATTAGATAGAAGTTATTTTGGTGTTATCAAAGAAAGCACTAATATAACAGATTT
AGATTTAGAATCTTTAGTAGATACTAATAATTATGATGAAACTACATTACCAGCAGAGAT
TATAACTTATATAAACAGTGACTCTGATAGCCCATTAGGTTATTTTAAGGATGTTGATGC
CAAGTACAATAACACAAATGTAAGAACAACTTCTGAGTATAAAATAGATTCTTGCGGTAT
TCCAAAATGGAGTGTTTTACAAGATGCTACCGTAGACACCACAAGACAAACTTTTCAATG
GAGAGGAAATCCAACGTATAAAGATACTTTAACATTTCCTATAGTAGGTTCAAGTTTTAA
AGATAGTTTTTATTCAAGTGTTCAATTCCAAAAAGATACACAAGGTGTTGAATTTGGAAC
TCGCTGCATATTATTACCCGAAATTTAAAACTTAAAAATTTAAATTTAAAATATAATATT
ATATAATATATAAGAATTAAAAACTCGAGTTTAAAAAAAAATTAAACTCGAGTTTTTAGT
AATTAAATCATTAATTTCATTATAATACTCCTTACGTTTGATTAGATTTTGATCTCGCAA
ATCCAAAAATCTTTATAATTTATTATAGAACCTATACAAATACCCACTAATGGTAAATCT
AATTCAGTTTCACTTGCAATACCCAACCCATTAGAATCAGCATAGATATAATCACCTATA
CTAGGTTTATTTTTGCAATAAACTGGAGTTCTACCTTTCAATGCAATTGGAACACCATCA
CATTCATTATTCAGAATTACACCAGGATTTTTTGAAACAACACCAAATAATTTCATACCT
GGGTTAAATAAATTTACACCACAAGCATCTATGCCTAATATATGACCTGCTTTTATATTC
GATTTAATAGATTCTGGAACTTCATAATACTCAGCTAAGTCAGCATATTTAGCTTGCAAA
GCAGTTCCTTGAAAATTAACAGCATATATATTAGACCATCTTAAAGCTGTAGATCCTAAA
CTAAATTTATTATCTTGAGTAGGGGTATCACTGGTTGAACGTCTCAAGAAATCTTTAGAA
TCTAATCCATCTAATTTATCAGCATCTATTTTACCCAAAGATCCTGGTACTTTTTGAAGT
AATAAAGCAATTTCTTCTGGTGTAAATCTACTTGCTGGTAAGAAATAACCTGCGTGTTGA
CCATCTAATGTATCAGCATCAACTCCAGATAAATGCCCATCCACTTCTTTAATTTTATTG
AGAAATTCAGCATTCCAATAATCGTAAGTAACTCTTTTTTCAGATCAGAATCTATGCGA
TTTAAATAATCTCTTAATCCTTTAATAGAATCAATACCCAAAGATTCAATCATATCTCTA
TTTGTTTTAATCCAGTTAACAATTTCCTGAAGTTCATCTAAGTTTATGTCATTTGAAGTT
AAAATTGTGTTAATATGATCTATTAATCCTTTAAGAACCTTACCTTGGTAAGCGCTTAAC
GGTAATCTGCGATTATCAGATTCTAAACTATCAACGACAGATTCTTCAGTCAATGCTATT
CTAACAAAATCATCAAACTCTTGTTTAGAGCAGAAATAATCTTTGTGTTCACCATCAAGT
CTATCAGCATTTGTAACAGTTCCATTACCAAACCAATGTTTTAGACGATCTTCAACGTGT
TTAACGGTTGTTGGGTGAAAAGTATTAGATTCTTCATAATCTTGCATTGAACTAGGATCA
TAAGGATCTTGATTATCTTTAGCTAGGTAATTACTGGCAGGAAATTCAGTATATTCTTGA
TATTTTGTAACGACCCAAAAACTAGGTTCCTCACTAGGAACTTTATTAACACATTCTTGC
ACACATTTATAATCTACTTCATTATATCTTACAATTTCATTAACCTCATAGTTTTCAGAT
TGATTCCACTCGAGTGGTGATTTTCCGTTTACTATTTGAAATTTATTGTAGATATCAGTT
GTCTCTTTTTAAGACGAACTTGAAATAGATTTATAGTATCTTCAGTAGGTACCATACCG
TGTTTAATAGCATAATCAGTATAAAAGGTTTTTTGATTTTTGTGTGTAAAAGCCATCACA
ATCCTTGCTTTTTGTATATTTATTTATGAATTGTGGTTAATAAGCCTTTAGTATTTACCC
AAAGGCTTAAGTTATTAGAATGTGTATGTATTTTTAGTTTCTTTAATAGATTCTAACGAA
```

FIG. 17AH. Continuation of (CJLB-15-1 [organism=Campylobacter phage CJLB-15] partial genome contig_1)

```
AAGGTTATAATGCCATTTCTAGCTTTAAATGAATTTTGTTTAAGTTTAAAGTTATTAACA
GAATCCAAACTAACTCTGATTGTATTATAACCAGTTATAAAAAATGATTTAGCATCATCT
ATAACTTTATATCTAACTACAATTTCATCAGGTTTAAAGTCTAATTCAATTGTTTTAGAA
CCATCTTCTTGAACTCCTGGAGCCAATACAACAACATCAATTCCCGAACTAGTTTCAGTT
GTTAAATACGAAGTAACTGATGATGGATATGTTTCCATTGTTTCTGAAACATTTTTTAAT
AAATCTTGAAGATTTTTGTTATTAAATGATACGCTAGGCATATCTAAGAATGGTGATCTA
AGAAAATTGTTTAATTCTAACATATAATTCCTTTTTTGTTTTAATTATATTATATTTTTA
CTTAAATAATTCTTAAATCTTAGAGCTTTTAATGTTTAAATTAAAGTTTAAAAGTTATTA
CCATTCTAACTCATCATCCCCTGGTCCTATAGTTCCTGGTAAAAAATCCCTTGTATACAT
AATATCTTCGTATTCTTCGCGTATTATTTGAAAATCATTATAATTGGTTCTAGCTTCACC
CAAGGTATTTATGTATGTAGATTTATTATCATATATAGTTAAGATTTCTCCGGTTAAATC
TTTTCCTATCAACACACCATTTGAGAATAGCTTATTACCTTCATAATCTGTAGATTTTAA
AGTTGATGACCAAACTTGAGAAGTACCAGAACCCGTAACAGTCGTTTCTACTGCTGTCAT
ATTACCATAGAATTCTAAAAATGCAGTTTCTGGTATAGTCAATGTTATTATATTTCCAGA
TATTTCATAACTAGCTTCAAAATATGAATAATTGTCATTATCATCTGGTAAATCAAATTC
TTGTGTAGTCACAATTTTTTGAAAAGTTTCAGGATCTGTTTTATTAGCTCTTGATAGATA
ATTACCAAAACTCGAATCTCTTTCCACAGTTACCATAATTTTAGATAAATCATCTGACAT
AAAACTAGGATATCCATATATAAATACAACTTTTTTGGTATTAGCATTTACTGCTACAAT
TTTAGCTATTTGTATTTTATTCTTAGGACTTCCAATTAAAAATGATGCGTGCGTAATATC
ACTAAAAGTTAATTTAATAACCTGGTTGGTAACAACATCGTATGTAGGTGCATCAGATAT
TGTTTCTAAACTATCAAAATTATCATTAATATACTTAAGATTTTTATATTTAGCTTCCCA
ATAATTATAGGTATTTGGTTTTTTATATGAACCTTTGAAGGAGTCTTTTGCAATTGATAC
AATTGACCATAAAGCTTTGCGACTTCTACTATTTTTACTATAAAAATTATCTTGCCATTT
TGCTTCATTTGCTATGCTTGATAAGCGAGTAATGTTATCATTAATAGTTTTAACCTCAGC
AGCTAACTCATCCTTTGAAACTTTGTTTTCTAAACTGGTTTGAATATTATTTTCAATGTT
TGATAATGATTCAGAAACAGAATCAACAACACCTTGTATACTATTGATATTTTGAGTAAT
TTGATCTTTAAAATTATTAATATTAGTTTGTATTTCAGACATATCAAAATTATTAATAAT
AACTTCAAATTCTTCTATTTTTTAGATGTATTGGTTTCTAATTGTTCTATCTTGCTTGT
TAAATCTTGTTGAACTTTTTGGAGATTTTCTGTTATAGTATCCAAATCAATGCGATCTAA
AGAGCCTTGTAGTCTTGCAATTTGTTCATTGATACTCTGTATAGTTTCAGTGAAATTTAA
ATCTCTGATTGCTTGGTTTATTTTAGAATCTACACCTGATTGCGTTTCAAATAATTTAAT
TTGTGAATTAATAGAATTTAAAGAATCTCGTATTTCTATTAACTTAGCATTATAATTTGT
ATTTAATACAAAATCACTAGCTGGGTGTGATTCTAATAATGCTGAATTTGGTGCAACATA
TGTAGAATCATCCCTATTTAATTTAGAATCTAAAGCAGCTTGCAAGCCTTTGATATTAGC
AATTGTTAAATCATCAAATTTTTCGCGATTTTCTTCTATATAATTAATAATATCTTGAAG
ATTTTTAAAATCATCATCTGTAATATTAATTACTTTCTTTATTTCGTCTATTATACCTTT
AAGAACTTTACCTTGATTAGCACTTAAAGCATCTTTAGTAGAATCTGATTCTAAATTATC
TTGTATGTTTATATGTAAATCTATTTTAGCTTGTTGTCAATGGTTCTAAGTTCAGAATC
ATCATATAAAGTATCTTGCGTTTCTATGCTTTCACTCGAGCCGTCAGCTCTTCTTAAGGT
TATTATTCTACCATTGGCAGTAAGAGCTTGTGTGCTTGGTAAAACTCTGGAATTAGTATT
AAAAGTATCTATGAAATTCTTATAATATGAATTAAAGTTAAATTCTGAAAGCTCACCATC
TTTAATAGTATAAGTAGTATCTGTAAAAACTGGGTCTTTCCCACCGGCTTGCTTTCTAGC
ATCATCCCAAGAAATTTTCTTATTTAACTCAATTTGAGTCAAGTTAGAAATTGGCTTGTC
GATGTCGGCAGTGTTATCAACGTTTTCTAAACCAAGCGTTTTCTTTGTTATATTGTGTGG
GTTTTCAGCTGTATAATGTCTTTGAAATTCTAATTTTGTAGAATTAGAAATTGGCTTGTC
AATGTCAGCAGTGTTATCAACGTTTTCAAGACCTACGTCTTTTTTGTTTAATTCAACGTC
ACCTTGTTTACCCGCAACCGTGTTAACAACACCTTGGATAGGAGTCCATTGTATTTCATC
ATTTACAAGCATACCAATTTCATTTGTATCGATAGCAAGAACGATTTCACCTTGTGTTGG
TTTTGCGTCATTTACAAAATGTTTTTAAGATTACGTCTTAATAAAATACCAGTTTTTAT
TTCAGCCATTTAACCCTACTTTTTGTATATTTATTGCTAGTCAAGCTATTTTAGTTCAA
GCTTTTAAGCTTTAGCTTTAGAACCTTTAACAACATAATATCTATCTATATCTG
CTTCTAATCCTGGATGTCTTAAACGTAATTCTTTTAAGAAATAATTATAAGCAGTTAATT
TAACTTGTCTATCTAATTTCAAATCATTTGGCTCTATGAATTGTGCTGGCATTCCAAAAA
TGATATCAAAGAATCTTTCTTGTGTTAATTTAATAGTTTTTCATCGCAGTATTTTTCA
TTAATTTAACAACACCAATAAAACTATGCAAATCTTTTATTCCCACGTTTGATTTAAACA
TATATTTAAATATTTCTTTTAAATCTGTTATAAATTCTGAATCACTAGTATCTTGTTCTT
GATATACTTGTTTACCTTCGTAATAAACGGGTTCACCTTTATCTAACATAGGAACCAAAC
CAAATCTCAAACCCCGGGTAACACTGAATTGAGCCATTCTAGGTGTGCTTTTATCTGCTT
TTAATTTGATATTGCCTGGTTTAGAACTCTTAGTAGCTACAACTATATTGGATTTGCTG
AAATAGCTCCTACTAACGCTCTTAATAATAACTTATGTGCAAATGCTTTTATAGATTCTT
TGGCATCCTCGAAACTTGAACCGTGACTAAATCTCGCAAATTCCGTTGGTTTCCATCTT
TAAAGTCGGCATTTCAAAATCTATTTGGCAAGCTATGTTTTCGGGTTTATACACGAATA
TTGTTAATAATTGATCTCCTAATTTTTCACGATTTTGTGAAAAGCATCCGTGATATTCAA
AATTACCTATTGTTTTACCTTCTAAAGAATCTAATAAATCCCATAGTTTTTCTTGGTGTT
CAGCAGGTATAACAATACAATATCACCGGAACTTTGTTTATATTTAAAGATTTCTTTTG
GATCCATTTTAGGGTTCATAATATAACTCGTGGAACCATTAAAAACAAGACCTTTTTAA
```

FIG. 17AI. Continuation of (CJLB-15-1 [organism=Campylobacter phage CJLB-15] partial genome contig_1)

```
TCAAAGAATCATTAGCCCAAAGTTTTTCTTTGTATTTGTTTAAAAACAATCTATTAAGAC
TTGTGAATAAATCTATGAATTCAGCTCTAAAAGATTCTATTGACAATCTATTAAAATCTA
TTTTTTCAGCACTTTTAGATTCACCCGTTTTTTTATTGATTGTTGTGGTATTGCCACCTT
CTAAAATAAGTATTAATTCAGATAATTTCATTAGTTCATACTTTTAGTTTATTTATTGTG
AACCAAATCAAGGTATTATTTGTTATTATAGATTTATAAAATTGTTTTCAAGGATAAATT
ATCCTTGAAAACTATGCTTTAAATTTGCGCATTATTTCTAAGAAATTTTTAGGGCCGTCA
TTGTAATAAGTTAATTGTGTTTTCGCATCTTTTAATAACTTCACCATTGTATAAAGCTTG
TCTATTCCGCTGCTGTCTATGATGTCAGAATTAAAAATATCTTCTAATGCAGCCTCAAAT
TGGTTTCGGATAACATTCTCGTATTTTGAAAGCCCCATTTTACTTAAACGAACCCTTAAA
CGATCATTAAATTTTTTGGAGGCGTCGTCTATATTGTAACCACTTTTGTCTAACTCAACC
CAACTTGAACCGGAATCTTTCACTCTTTCTAATTCAGATGATTTTGAATTTCGTCTATGT
GTTTGCTTATCGCGCATATTTCTCCTACTTTCACTATCGATAGCAAAGCAGAATACTCTC
GAAGTCGCACTTTGGTCATTAAAATCTGCTATACACGTTTTGAGCGTGGCTGTTAATGTT
TTCTTTCGATACATTGTACTAAGTATATAGCCAAGATCGCCGTGGATAAACACATATCCA
ATATCGTGATAGATTGAGGATTTTTCATCAGGGTAAACAAAGAGATAATCAAATTCACTT
GATGTGTTCTTTTTAAATTATTAACTTCTGCTGCTGTAAGTAATTTGATGTCGGCGTTT
TGTAAATCTACACGATCGTGCAACGCCTGTATTAAACTTTTTAATTGCTTCCCACCCAAA
CCCGGTATTTTTTGTGCTATATAATTTTGCACATTTTCATTTAAAGTATCACTATTGACG
CTATTAAATAAAAAATCTTTGAATTTCATTTTTAACCTTCCATTTTAAATTTACACTTTT
GTGCTAAAACACTTATAAAAATATTGAATTAACAACTGCAACAAAGTGCATATATTAATA
TCATATCTTCATAATAATATTATATTTACAAAAAGCTGAATTGTATTTTAATTATTTGAT
TCTGGTCTTTGCTAAATAACGTCTATATATTTAGGTTCTTTTTCTATAGTAATATAATTG
TAATTCAGATTTTTGCTGGCAAGTGCCGTTGTAATTGATTTTAGTGCTTACAAACAATCA
CCTCGAATTATCATCATTTTCCTTGTCTTAGTTTTATAATATATTTGTAACTCACACAAG
CTAAAATCAAGAATGTTCTGTAAAAGATTCAAATATCTTTGCATTTTCTTGCACTTCAAA
TGATTTATCATTATATTGGTAATATATACCATCAAAATCTGCAAAATTACAACCCATACA
AGCCAAACAATTTAAATGACAAATAGGCATTTTAGTTCTTTTAAACACTTCACAAGTTTG
CCTTTTCAGGGTTTCTTTAAACTCAGATACATTTATATATTGTTCTAATTCAGTTTCATA
GAAATTAACTACAATTTTTTTATAATTAGAATCTAAACTTAATGTTATTAAATCTTTTAA
AGCATTCATATAATTTAATTTATGTACAGTGTAACGGATAGTTAATTTATAGTTTTTAGA
TTTAAAATAACTTAAAACAAACTCAGTATCTTTTGTAAAATCTTTACCATTTCTGTAAAC
TCTTCTGGAGTTCCCTGATAAATCATAAGATATTTCCAAAGAAAAATGGTTTAATAATTT
GCGGGTTCTTTCTATAAAATAATCAGCATTTTTAGTATTTTTAAAATATGCACCATTTGT
AGTTAATGATAGATTGAATTCTTCTTGGTATGAAATGTTATTTTATCAGTTAAATCAAA
AATATAATAAACAATATCTGGGTTTAAAAATGGTTCTCCCCCAAATATAACTACAGTGCT
AGGCTTATCTGGTTCTCTCTTAATAAGATCTTTAAAAAAATCATTAATTTCTCTTTCAGA
GATATACGTGTTTTTTATTAAACGATCTCTATCATTTTTTTGATAACAATAATCACAATC
AAAATTGCAAGCATCTGTTAAGTATAAAATATTAGATTTAAGTTTATATTTAGATTCTAT
GAGTGGTCTTTTAAAATCTTCATTAAGATTAGAATCTATAGCTGCTTGGAAGAATTCAGC
AAAGTCTTCATCTGAAATCATTTTTGGTGCTTTTTTAACTTTTGTATATCTCGATTCTTT
AGACATTTTGTCTCCTTTGAATGTTTGTGTTTTAAATTTTAGTTTTAAATTTTATATTAT
ATATTATATTTAAAGTTTTAATTTTTAGCATTTGAATTAGTTTGAACTTTAACCTGAGTT
CTAAAAAATGGATCTATATATTTTGGTAACACTGTAGTACCATTTTCTCTATAGGGTGTT
TGACTAAATTTTTTAAGTCTATCCTGCAATCTAAATATATTATAATTCAATTGCATCTCA
GCATCAAACAAATCATTAGAACTTACTAAAATATTTTCAGAATCTATGTAATTTGTTGTG
TATTGATTATTGGTCAAATAAACTCTGTACTTATTATAATAAAACCCAAAATAATAAAGC
CTACCTAGTTGTTTAGATAAAGCTTCGGCACGTTCTTTATTCGATATATTAACAAAGTAA
AATATAGAATTTTTTGTTTTTGATTTAAATCTATGAAATATTGATAAGCATCATTAATG
CATAATTTTAAATTATCTTTAGAAGCTGTCACTTTTGTCTTCTATATTGGTATACATCT
TGGTTATTAACTCCTTTTGTTTTAGATATCAAAAACATTTTAGAAGCATTTTGAATAGGG
ATATAATCCAGAATAAAAGGCTCTAATTGAGTTGATAAATAGAACTTATTATCTCTTGTA
CACACGTATTCTGTGTAATCTACGTTATGTTTAGATAAATTATTCAAAAATTCATTGTAG
AGTTTTATATCGTATTTGTCGATATTATAAATCATTAAGAACCTTTATTATTTTTATTTG
TACACAGAATAAAAGGTTTTAAAATATCATCACTTAACATATATGGTTTGAATTTGTAGA
CTACAAATGATTCAGTCTCACCCGTGATTTTTGGTTTCTTTTAGTTGCTTCTAAATTCA
AGTAATCTAATACAGATTTTTCACGAGTCAAAGAACAATTTAAATGATCTTGAATGATAT
ATTCTAATACATCATAATTGATTTCATCCATTTAGAACCTTTAGCTTAAGATTTAAATAT
ACCCATTTCGTATGCTTTTGTTCTTATCAATTCAGTATTGAAATCGCACCATTTATAAGC
TAAATCAAAATGTTCGATGTTGACGTCGTTATTTGTAACTAATTCATTATTAGATAAATC
AATATCATTTTCTTCAAGTAAATCTAAATAACAAGTCATAAAAATTAATTTAACACGCTC
AATCAAAGGTATCTTTAGCATAAAAAGTATAATCGTCATAAAAATGACTATAAGTTAT
AGATCTCAACTGTTCGTGCAAATCACTATAAACTTTCGTTGTTTGATATCATTTATTTG
AGTTTTAGTTGTTATATTATATAAAAAATAATTACGTTTTGTTAAAAATTCTTGAAAGCT
ATCTACCAAAGATGCTAATGTAATTTTAATATTACCTTTTTTAGGAGCTTCATATCCCGG
GTTTAAGTAGTCCATAATCTCTCTTTTTGTGATTATTTATTTTGTGTGTTTTACACTGAT
GACCACAAACTGGTACCAGCTAGTATTAGCCGGCACAAAATTAATTTGTTTCGTATTCTA
```

FIG. 17AJ. Continuation of (CJLB-15-1 [organism=Campylobacter phage CJLB-15] partial genome contig_1)

```
ATTTCTTAGATTCAAGCTCCTTTAACATTTCGTCAAGTTTATAATCTATAATTTTATTAA
CTTTAGATAATTTATTAACAATATTCGGATTTTCTATCGCTTCTGTTCCAACGTAAGCAC
CAGCCATCAAATACATAGTGCTGCTTCTAGGTACTAAAATAACTACAGCACCAAATATTA
TACCAGCTATCACACAAATTTTTATACTTTTTGATGTCATTTTATATAAACGATCCTCTC
TATCGGCGTGTGATGCCACGTTAAATGCAAAAGACAAACAAAAAACAACAAATGTTAAAC
AAATTACTACTTCAGCTGTGTCCTTAAGAGCATCAAAAACACCAGCTAAATATATAAAAA
CGATAATAACATAATTTTTCCTTTATTTTATAATCAAGTTTAATTGAACGCAATCAAGCA
TTTGAATCCATAAAAGTATGACCCTTGGATTTCAAAAAATCTATGATAACTTCTGGTTCT
ACTTCATCAATACAAGAACAAAATTCAATTCTTCATCATCAGCTTCACATAAAACATAG
ATTTTATCTGTATTATAGAATTCTTCTAAAACATTTCTAAATCAATTGGTTCTGGGTCT
CTAGGCATATATCCTAAACTATCGTAGATATTTCTAAAATATCAACTGTTTCAACATCC
ATTAATTGGTAGTCATAACCAAAATACTCATTAAATCTAGCAACGTACATTTTATCTCCT
TTGTTTTTATCAATATAATTATATAATAATAATCTTAAATTAAACTGAAGTTTTAGTAGA
TTTTAGCATATTTTAGCATTTTGTTCACACTAAGCAAAATTATACTTTAAAATCATTGAC
TTGGCAGGGTTTGTTTGTCCAGTAATTTTACCAGAATAACTATCATCTTGCTCTTCTACT
ACAATATGATATGGTATCTCATTTTTTTGGATGATATTTTTTACTACCTTTTGATAAAGA
TTGAACTTTCTCGGTATCCCCATAATTTTTACAAATCCTATCGGCTTTATTGCCAGGTAA
TCCACTAAAACTCGAAAACACATATGATAATACTTTTAGAAAATTTACATCAGAATTTAGA
TAACCATCTTTTTGAATAAAAAGCTCACTATTCACTAAATCACTGATTCTCTTCGTGTCT
TTATTTTAAAAGCTTCTACCAACTCATTGAATTTATTTTCATAAAAGACTCCAAAATGT
GGTTCCAACTTTGAATCCTTCATTATTAGGATGCAATAGTATTGTTTATATCTACATTA
AAAAGAGATATTTGCAGATATTTCTTTGCATCCAGAACTTGATTAAACATATTAATGTAT
TTCTCACCGAGCTTAATATAATTAGTCTTTTTAGTCAAAGACTCTTGCAGCAATAAAAAT
TCTTTAAAGTTAGCTATTGTATTCTCCTTTTTTAATATAATTTGTGAAATATATAAGAAT
ATATAAAATATCTATAATTATATTATAAGTTTTCTTAAAAAGACTTTAAATGTATATTATT
GGAGAATTTTCTAAAATTATATATGTTACTAAGACAACCTTAAGAAATTGGGAAAACTAT
ATAATTTATATCAAATATTATATATTCTGGACTTAAAACAGTGGCTACAGATACAACAGC
TGGAACCACTTTAAAAAATCAAAGCTTGTGGAGTTCTTAGAAAGCTCAGATAAAGTCTGA
GAAGAACTATGAAGCAAGAAAAACTATTAAAAATGTAAAGAATTTTATAGTTCTTTATAA
TATTTTATAATGGTTTAGTTGGTATTAATAATAATCCAAGAACTTATTAAACCTATAGCA
GCACCCGCACAAACATCTCTAAAATGATGTTTTTCGCAGCTATTCTCGAAAATCCAGTA
AAAACAGCTAAAGCTAATAATATCACAGTAGCTATAATTAAAATTGTATTATATTCATTT
ATACCAAAAAATAAACAACCAAAACCAGCGTAAGCAGCACACGTATGACCCGAAGGCATT
GAATCTTTACCTCCATTGGGTCTAACTGATAATTTAGGAAAGTATTTAGAAACTAATTTC
TTTAGACTAGCGGATACTAATAATTGTCCTGCAGCTACATAAAGCCACACCATAGGTGTA
ATTGTCATATTCGTAGGATATAAAGCTATAAAAAATAAAGCTATCCAAAGAGTACCAAAT
TGAAAAATATCACCTACTTCTTGGATTACGTCAATTTCATCTGGATCTAACCCAAAAAAC
TTTTTGATTGAACCATAATTTATATTCATTTTTAAACCTTTGTTTTTTATTTGAGATTAG
CAATATCTTCAAGCATCAATGCAGCGATACACCAGTTGATTAATAAACTACCATATATAT
GCTCTACACCATTTTTAGTTGCATAATAACAATTATTATCAAATAAAAAATTTTGGTAAT
ATTTATCTAGTTCATCTACACGCCGCAACGCAAACCTGACTTGGACTAAATCTTTACAAC
TCATAGAAGTTATAGGAGGTGTGTGATATTCATAAGCTGGTCTAATGAATACAAAGCCTG
TATTTTGCTGGTCCTCGTACACCCCCAATTCAATTTTAAATATTTTAAATAGTGAATAGC
ATAAAAAATCTACATCAGCTCTATATACTTTATTACCAGCTATATATCATCTTCGTGCG
AATCATTGGTTTTACCCAAAGTATCCTTATAAAATTTTAATACCCTTGCTTCGCGTAACA
CTATGATCCTTTCTATCTATTTATTTAAAAGTGTATTAAGCACTTCAACAATATGATTAT
GATTTATTTTTTTGGCTAATGTTGTATCAACATCTGGGTAATCTTTATTAAAATCTGTTA
AAAAAATTCTAATGCATATATTGCATAAAACCCAATCATATAAATCACTTGTTTTATCAT
AATTAATTATTAAATGTTTAGCAACTACATTAAATTTTAAATCTATTTTGTTATATAAT
CATACCAATAATAACCTAAATGATCAACTCGATTAACACAGAGCTTAATTATTTTGTTAG
TCAATAATAATTTAATTTGCTCTATTTTATTAAAAAAATCAGTTCTTCATTTTTACATT
CAAAACTATAAAAATCACATATATTATAAAAGTTGGATTCACCAACATAAATATGTTTAA
CTCCACTATTATGAGTATTGATCAAATCTACGTCAAAAATTTTTTATTAATTTTACTT
CAGTTTCATCCATATAATTTATAATAGAGTCCAAAATTTATCCTCTTCTTTTTTATAATT
ATAATTAGAGCCTATATGATAATGATGAAAATAAAAATTATGTATATTATATCTTTGTTT
AATAATATCTAAATTTGTATAAGTTTCACCAAACATTAAATCTTTTAAAGGTTTTATGTA
ATATTTTGATGATAGTATATCAAACGACAGCTCTTCTAATTTATGTGGTTCTAAATCTTT
TACTATATTTTTATAAGTACTATATTTTATGGTATTAGCTATTTCAGCCCAATTTTCAAA
TAATTCTTCGAAGCATCAACTATAAAACAAGTATTAAATATGCATTTTGATATATTATG
TTTTCGTTCATCTTGAGCTTGTATATCATCGTATATTAAACAAGAATCAACTAATTCTAA
ATCATTTAAATAATTAGAAAAATCTCTCACTAAAAACATATCTAAATCTATATGAATTAA
AACATCGTATTTGTTTTTAGCATAGATTCTAAAAAAGTGCAACCATATATCTTATTATA
AAAGCCATCTTTTGGTTCAAGATTTAAATCATTATAAATATTTTTTCTATATAATTGAC
ACCTAAGTTACTATATATTTTTTGGTATTTTCATCAACACCATTATTTGTAGGGCATAT
ATAAAAAAATATCACACTGAGTGTATTTTTTTAAAAGTTCGGCGCATTTCAGTGATTCAGT
TTCGTACAATCTTTTATGTTTTTTCTTATCGGTATAAGTATTGTTAGATTCAACTACACA
```

FIG. 17AK. Continuation of (CJLB-15-1 [organism=Campylobacter phage CJLB-15] partial genome contig_1)

```
TATAAATGCAATTTTCATTCATTTGTACCTAAATGATAATGATTGAAACATATATTTTA
AGATTTTCTTTTTTGACTTTGTGAATAGGATCTTGATAAGTACCTAAAGCGTAGTTATAT
ATAGATTTAACTGATATTTCTTTAGAAACAAATATGCAAGCTAATTCTTCGACAATATCA
AAATCTATTTTATCTATATTAATATTTAGCTCAGAATTTATATAATCTAATAGTTTATTA
TTATAATATAAGCCGGTTAATTTCTTACAATATTTGTAAAATAATTTGGGGAATGCTGAG
TTTTTATCATAAATAACTAAACCCGTATCCCAAAAATCTATACCAGATTTTATAACTATA
TCTTTGAAATTATTATGTCTATTAAATATTTCAGTAAATGTATATCTACCACACGAAGTT
TCATATTCGAATAAATGTGGTGGTAATGGTCTTGTTAAATACATATCTAAATCTATTTTA
ATAAACCAGTCATAATTTAAATTTTCTTTCGCATATTTAATAATAAAGGTATATTCCAA
AAACCACATTCATATGAATCAGTTTCGTTGATAAAATGCTCTATATATTTAACATTTAAT
TTTTCTAATTTTTTCTTCGTTTTTTCACTAATAATGTTTTTAGTAAAACAATAACAATAT
ATATCAATATCTTTTAATTCACCAGCATTTTTTCGCCATTCATTAAAACATTTAATAGCC
TCACTCTCATAATCTCTACACCAACCTAATTTAATATTATTGATACCACCATTACCTTCT
ATTGTAGTAATTAACGCTTTTGATACCACCCACAACTCCTATTGCATATACTTAAAGTTT
TACTACATTCTACATTATTATATATAGTTTCTAACGGGTCAAATAAATTGCCTATAATGA
GTTTATCTTTTTGAAAATCCATACAACATAGGCTTAAACCATTTGTATGTATGATAGGTT
CATTTAAAAAACGGCAACCCGATTCAAAGCCTATAGGATCACCAAATCTGTTTACTCTAT
TATCTATTTCGCAATCAACTATTTTTAAGTTTTTTATTTTAATCAATGATTTTATAATAC
CATTAAAATTTTTATTACGAATTATAAATTTCACCTCTGTTATATAATTTTAAGTTTTTA
AATTGTTAACAAAATCATTAAACTTATCTACATTAGTTAATTCTTTAAATTCATTTTCAT
TGTTACCATAACAAGATATGTATAAAAATAATTTTTTATATTTAATTAAATTATAATTAG
CAGAAGGCGTCAACGAAGTAATCAAATGATATTCTTTAATTTTAGACTGTTCTACTATAT
CTAAATATTCATAATGGTTCTTGACTGTAAAGAAATCGCCAACCATAGGTGTTAAATCAA
TCTCTTCAACACCTTGTTCTTCCAACCAAGCAACTATTTTTTTAAATAAATCTATGCTCA
TAACATCGCGACTTACATTATTATTTTGTAACCAACAGAAGTTACATTTGAGTAAACAAT
TAGATGTTATGTGTATAGTAAATCTTTTAGGTATTTTCAATCTTGTCTCACTAAATCTAA
AGTCGAACAATGTATACCACCACCGAATAATTCACAATGTCTTAATCGAACTGGTATCAC
ATCAAAACCATTTTTATATAATATGTCTTGTACAGCTATAGCATCTTTATTTACTAATAT
TTTTTTCGGTGATATGCTCAATACATTCATATCCATACCACGATATGAACATAATTGGAC
AAATGGTGTGTTGTAATCACTATAATCTTTTTGTTTATATTTAAAATCACCATTAGTACT
TATAAATTTCCAATTATGGAATTTTTCAGGCAGATATTCTTTAATAGGTTTATGTAGTGC
TGCATCATTTACTAAAAACACACCAAAATCCAGTGGTAAAATATTACCATCAAGATGATT
ATCTATCATAGCTTCAGTATACCATATTTTAGCATAATCTTTCATTATATTTTCAAACCA
TTTAGCACCCATATAATGGTTATATGTAGAGTAATTACAAAGTATATCGTCACCAATTTT
TAAATATTGAGCTGCATCTACACCTAAATCCCACTTCATAGAGATATTATCAAAATCTCT
AGGTGCATCCCAATCCTTAAGATCCATAGTTTCATCTTTTAACATAGGTAATGGAGCTTT
TATCCATTTATAACCTTTAAACATTTTTTCTTTGAATATATCATACATTGAATCATTTTC
AAAATATCTACTGCGTATTTGAACAGGAGTTTCTACGATCAAATCTTTGTATGTAAATAC
AAGATCTCTAACATTAGAAGCACTAGAATGGATAGATTTAAAATTAGGTGTTTGTATTTG
GATCTTATCTTTAACCTTTTCTGGTCTGTATACTTTAACACCATTTTGTTCTAGTATTTT
AGCTAAATTATCAAGATCTTCATTACGTTCTGCAACTAATTGGCTATTAATACTATATTC
TTTAAAATCTGCAAAATAATAATCACTTATATTATTTTTATAAAAAATTTTAAACGTGGT
ATCAAAACTTCTGGTACTGATTTCTAGTTCTCTACCAACTATGACTTCTTTTAATTCACC
AAATTCGTCTGAGTCATTTAATTTCTCCGTAAAAAGTAAACAATATTTTGTTATCTTA
TTATCATATATATATATACTATAAATGAATCATATAAATTTTTTTCATATTTTTTAAA
TAACCATTTATTGATCCCTGATTCTTTTGCAATATTTAGTAATTTTTAAATATCTCTGT
ATTACGAACCATTAATTGAAAACCCGAATTGTCAACATCCAGCGTCAACTTAATTGAACT
ACGACACCCACTTGGTACTCTTTTAGGGGTTCATAAAATATCGAATTATTTTTAATTT
AGTTTTATCTAGGTTTTTAACAATATTATAAATTCTATCATAATCAAGTTCTATATAATA
TGAATCAATAATATTAGTAGCTAAATCTATAGAATAATTATCTTGATATTCACTAATTCT
TTCTTTATTGAGATTATATTCAATGCATTTTGATTTAGAATCATTGTATACTGAGTTGGA
ATAGCTTATTAATTCAAAATTTTTATTAAATTTATAATAGAATTCAAATTTCATCGATTT
AACATACACTCCCTAAAATCGACAAGTTCAAATTTTGTATTTTCTCTATTTAATTGAAAA
ATAGGATATAAAAACATTCCTTTAATCCCATTTTCGAACAAGCCCTTTTACAAACTTCA
TTACATCTAATATTTTAAGTATGTTATTCATAAAATCAAAGCATTCTTGTGTTGTATTT
TTATTAATATTAATAGTATCGGGTTTATCTAAAAAATAATCTTCTTGTTCGTTGCAAGGC
ACTAGTATACCCATATGATTTAAATAAATTGCGTTCATTGCTGCCTCAGGACATCCAAGC
ACTTCTGATTTATCATTACGCAAGTTATCTTTCATTTTAAAAAATTTAAGTAATTCGGTT
CTAGGCTTTACAGATGCTTTTGGGTCTAAATTAGGCGGCTCGTAACAAGGACATATCTCT
AACAAATCAAATGTGGAATTTTTATACATTTGTTTAATATTGTCTTCATCATCTCTATTG
TAATCAAATTGTATGAATTGCATTATTGTTGTAGCTTCTGAATTCTCTTTGAATATTTTA
TGATGTTCTAAAACATCTGCTAGCTTAGAACCTACTCTATACTTAGAATGCAATTCTTGC
GTAGATCCGTCAACAGGAAATCTAATTATATCTCCTTCTTCATAGTCTTGCCTAGCCTA
GCCCAATCTATTTTAGTTGACCCATTTGTACTTAAACGCATTGTATATTCCTAGTATTC
ATATATTCTAAAAGTTCAAATATATGAGGATATAATGTAGGTTCACAAACAGCACCCATT
AATACAACACGTTTAAGATTAGGTAAATCATTTAAAAAATCTTTTTAGATTATTTAAATCT
```

FIG. 17AL. Continuation of (CJLB-15-1 [organism=Campylobacter phage CJLB-15] partial genome contig_1)

```
AAATGATTTACTTTCATTTTAAAATCTATATTTTGTCTTAAACACATAGGGCATTTTAAA
TTACATAAATTTATTAACGACAATTCAGCAACTTCAATATCTTCTGGTTTTAATGTTTTT
TCAGTATATCCATTTTAAAAAAATTTTTAATATAAGTTGGTTGAGTAGTAACAATCATA
ATTATCCTTAATTGTCATCTATGGTTAATCTGTAGTGGTTCAAAACTTCGAATTTATCAA
TGTCTAGTCTCATTTGCAAGACTGGGTAATCACTTCTGATTTTTTATTACAATCACCAC
AACAACGTATGCAAGTTTTATTCATTTGATACCTTTAGTTATTCTTGAAATTTGTTCTA
TACATTCTTCAAATGTACTATTATGAATTGTTTTATCCAAGAAGTTGAAAGCAAACTCTT
CCATATCATCACAAGGTAATATATGTCCTGAATGATTTATATATAATTGATTTAAAGAAT
ACATAAGGCATTTTATATTTTCAAATGGTTTATTATTAACATAATTATTTAATTGTTCGT
AGCGCTTGCATAATGAATTAGAAGCTCTAATTTCGTCGTGTATAAAAATAGTATCACCAG
TATGTGTCGTTTCTAAATAATCAAATTTATTATGTTTTGATAATTTAATAATTTCATCTA
TATCATTTTCATTATACTTAAAAATTATAAACTGATTTATTGTTGTAGCTTCTGAATTCT
CTTTGAATATTTTATGATGTTCTAAAACATCTGCTAGCTTAGAACCTACTCTATACTTAG
AATGTAATTCTTGGGTAGACCCATCTGTCGCAAATCTAATTATATCTCCTTTCTTCATAG
TCTTGCCTAGCTTAGCCCAATCTATTTTAGTTGAACCATTTGTAGACAATATACTTTTTA
TATTCCTGGAATTATTATATTCTAAAAGTTCAAATATATGTGGATATAATGTAGGTTCAC
CTACAGACCCCACCATATCAATACGATTTATATTTTTAAAATTATTTAAAGTTTCTATTA
ATTTTTCGAAGTTCGTATATCCTTTTGGTATAGCTATATCGATATCATTAGCTTCTTGTC
TCAAACACATAGGACATCTCAAAATACATTTATTTAATAAACCTAATTCTATAGTTTTAG
TTTCATCTACTATGTTGTATTTGTTCATTTATATAATCCTAATATGTTTAGATAAATTA
TATTTTTAGAATATTGTATCAAAATTTTTAATTTATTTTGAGATTTTTCTGGTTCGTAA
TGACAATGATAAAAATAAGCATCTTGGATAGCCTCGTATTCATCACCTTCTATGCTACCT
ATTTCAAGTTTGTTAACACCTTCTATATAATTTACGCACAATTCTTCAAGCAAAGGATAT
TCTAAAGAATTGAGTGATGGATTTTTTGTTATATTTAATTCATATAGTTTACCACATTCT
TTATAATTTAATAATTTATCAAATTGATTTAATAATTGATATTGCTTTTTATAAAATTCA
TCAGAAGGTTTAGATATCATAATGCCAGTATTATACAATACACCTTTTTTAGATTCTAAG
TACTTATGTGAGCCTTGTGTGTGAGGTGAAACTGCAGGTGTTTTAAAATTATCTAAGTCA
GGTAATGCTCTCAATAGCATCATATCTAAATCTATTCTAAGCATAACTGGATTAATATCT
TGAAACATACTTTCGAAATATATACCACTTAGTGGGATATTCCAAAAACCACACTTATGA
TTTTTTATTCTATCGTCAAATGAATGAATATAATTAATATTCAATTTCTCAAAATAATAT
TTAGTTTGATTGCTTATATCACATTTGTTTAAATTCAAACAATATATATTACCATCAAA
TAATCACGTAAACATTTAAAACAATAAATTGCTTCTTTTTCAAAATATCTAGTAAATATT
TTGTTGGTCGTATTAACATCTTTTAAATCTGGTTCTATAGTAGTGATAACAATCATCAAA
CACCTTTGTTTAATTATATATAATTGTACCTTAAAGATTAATAAATTTATGTATATCTTT
TCTTAATAATATCTTTGTGGTATCAATAAAAGCATACATATCAGCACAATCTTGATTACA
ATAAACTTTATTATCATCTGATATATCACTAAGTTTTTTAAAAAATTTTATACCACAAGA
ATATTTAATTTTATTGTATTCTATTGTAATAAAATTATTATAACAAAAACTACCTTTAAA
TAATTTATATATTTTATTATTTAATATATCATCTATTGATAAATTATTTTTTTGCCGTCA
ACATCTAAAATTATATCTTTATGATAATAAGAACTGGAATCACCTAATATTTTAGAGTCA
AGTAAATAATCATCATTTTGGTCTTTCACTAATGTGAAATATAAATCATATTTTTTACAC
CACGATGCCATTTCTATTGCTTTTTTATGATTTTTATAATTATATACTATATTTAAATGT
ATAGTATCCTTTAAATTAAGTATGTTATCTAACTTAGATTTTGTTTTTCGAAATATTCA
CTATGTAAAGACATAGATATAAATTTAAATCTCTTGAATAAAATTATCATTGCTGAGTAAC
ATACCATTAGTATTTAATTCTAAAGCTATATTTTCATTTAAACTTTTTACAACTTCTTCG
AAATAAGGTAAAGTAGTTACTTCACCGCCAGTCATTATAACTTTGATCTTGTATCGTAAA
CTAAAATCATTAAGTTGTTTTGCAACACTCATAATGGTATCTTTTGGTATTGGTTTTCTA
GGTTTTGATGCTCTAAAACAATATGAACATCTGAAATTACATTCGTCAGTCAACACCCAC
TCTATATGGAAATCGTAGTTTTTATAATCTTCGTTAATCGAGTAAATTTAGTCATATTA
AATTAGTCTTACTTCTAGTTATCCTGTGCCCAGCGTTATATTCTTCGTTTTTTAATTCTT
TAGTAAAATAATTCATTCTAATCTGACACCGTTTTGATCTATCAAATGTCTGGATATT
TTTCACCCAAAGTATAACAATAGTAATTACAACAACTTCGGCAAGTAACTCCACATTTCG
GCTCACACCAACGTGTGTTTAAAAATTTTTCAATATCGCTATCAGAACTTTCTATATTCA
CACCCGTATGAACTTCATCTTCATCTAAAGAACCACATATGTTTATATTACCCATATGAT
TAACGTAAATTCGTGTCTGTTAAATGAATCGCATATAACACTGATATCTTTTGTGTTT
TAAGTAATTTCTCATAGAAATCCATATATTTTTAATCTTTGTTGGTGGATTAAATTCAC
TTTGATTTTGTATGCTAGTAGGGTAACACTTCAAATAACTTAAATAATCAAACTTTTCTT
TTTTAAATAAATTATAAATATTTTCTTTATCATTTTGATTGTAAGCAAATTGTATATTTT
GTAAGACAGTAATACCACGAAAATCTGGATTTGATTTTAAACTTCTATGATTTTCAAGCA
CTTTGTCTAATTTAGAATTAACTCTATACTTAGAATGTAATTCTTGCGTAGATCCATCGA
TAGCAAATCTCACAATATCATTAGATTTTAATAGTGACCCCATTTTATACCAATATTCGG
TATTGTGTGTGCTAGCGTTTGTAGACAAGCGAATGTCTATAGGGCGTGTTTTATATACT
CTAATAATTTAGGTAATTCTGGGTGTAATGTGGGTTCACAATAATTACCTTCAATTATTA
TAACTTCAATATTTTTAATTTATCTAAGAAATCAATTAATTTAGAGACATTTACATAGT
GTGGTGATTGTTCATATATTTTTTATGGACATAGGGACATAATACGCAGCGCAAGTTAC
ATCGTTAGACAATCCCATATCAACAACCTTAATATCGTCTAGTGTATAAAGCACATTTA
ACTCCTAATGTTTAGCATCAGAACCATTACCCACAAGTATTTCGTAATTAATACCTATGG
```

FIG. 17AM. Continuation of (CJLB-15-1 [organism=Campylobacter phage CJLB-15] partial genome contig_1)

```
TATCTATGGTATCTAATTCGATATTTTTTGAGTGATTCTAAACACCTATTAAATAATTTT
GGTCTATTGCGTGTTAAAATTAATATACTCAAATCCATTCAATATTATATAAACAACTTT
AATTTATTTATATATTATACAGCTAAGAGTGATCCTAAAAACAACACTATAATTGTAAAA
ACTACACACAATAATATAGCAATAGTTATAGAACCTATGACACTGACTAAATACGAGAAC
ATAAACGTATATAAAACAACTACAAATATAGCTATAAACAAAACAAATAACCCCGTAAAA
AATCTTTCTATTAACTTCTCAAAAGAAAACTCACTGAAAATATTACAAATTCGACTTTTT
AAATTCATTCTAAAATCCTTTATTAAAATTATATTATATAAAGAAATAACTTAAAAGTTT
ATTAAACTATATCATCGAAATAACAAAAAATGATGCAATTGCAAAAACTATGCATAATAG
CAAAGCAATCATAGGTGAGCCTATAACAACACTTAAATATAAAAATACACTTAAATATAA
AAATGTCATAAACATAGTTATACACAAAAAGAATACATTCAAACAAAATAGTACCAAAAT
CTTTTCAAAACAGATTCATTAAAAATTCTACAAATTCGACTTTTTAAATTCATTTTAAA
ATCCTTATTAAAAGAAGTAGAAATTGTGATAAAATCAAAAAAAAATGTAAAACATAAAAT
AAGTCGTTAATTAGCTTACGATTAGCAAATGCGAATACGGTTCGTAATTTGAAAATCTTG
AGTACTTTCGTACCCAGATTAATCTAGGATTTATTTCTTATATACAAATACATTCCAGAA
TCTAAAGTAAATCTAAAATTTTTAGAATTCACTGAGTTTAATTTAATAGTTCCTTCCATC
ACGAATATATCTGCTTGTTTTCTTCCATTAATTTATTAATAATTTTTTGAATTTTTT
GGTTTTATAGCTACGTATTCATTATCTTTACCACGATAACAAGTTATGATAATATAGCTT
TTACCTTGAAGCATTTGTATTCTATATTTAAAAATATAATAATATAAAACCTTTAAA
ATATAAGCAGAATCATTATTATCTTTAAAACAATCTATAAGTTTCATTAAACTCCTTTGA
TATATTTATGAACTAACATTACCAGCACTATTGGAATCCACTAATAATGATATTATAGGG
TCTTCAAGGCTCATAAATCTGGATTCTAAATCATAGTCAAATGCTCTCAAATTAGCACCA
TCAAAACAATCTTTATGTTCAACAAACTCATAAGGGACACCAAATATTGACATTCTTGA
AATAATCTAGGTTTTACATCAAAAAATACAGGATCTTGTATATATAACATTTCATTAAAT
TGTTCGAATATATTAGACATAATATTTAAATCACTTCTAGTTATTTCAGATTCTTTTTA
ATGTATTTTGCTCTGGTATTAATAAATTTTTGATTCTTTTGAAATCTAGGTTTATTCAAT
ATCTCAAAAAATATTTTACTTCTATAATTAACTGATTTACCGACAGGTTTTAAATGCTCG
TATTCCACAAAATAATTACACTCGAGTGTATGATTTTTTGAGCCACTTAAAGCATATAAA
TTCTTGCATTTTAAAAATGGTTTATATCTATCGAAATGATCTATACAGTACATTTCAAAT
AAAATTAAATTATTGATAGACATAAAACATTTTTTAAATATTATAATATTCTTAAAACAA
TCTTTATTAATATTATATTTAATTTCAAGATATTTTTTAACAATCTCAAGAGATTCAAAA
GTAGTATCTATTATAAGAATAATATTTTTATTATATAACCAAGAGAAATAAAATATTCA
AAAGCATTCGAAAGTGACCCATCTATGGGGATTCTCGATTTGCAAGGTCCTATTAAAATA
GCATTCGTATTCATAGCTTTATAAGTCTAGTATTTTCAGCCTTTTTAGTATAACAAGCAT
AGGTTAGAACTTTGATATATTATCAACTTCTAAAAATTTAAGATTACCATCTTCACAAAC
TGAAAGATCTCCAAGTCTACCATAATATATTTTTACATTTTCAAAATAATTTTCAGAAAG
GAAGTTATATGTATCGGCCATACTTTTAGGAGAAGTGTTTATATAAAAATTATTAGCAAT
ACGTTGAAAATTATTATCAAATAACGTTAATTCAACATCTTTGCTTATACTTTCACTAAA
AGAAATAAAATACATATATTACTCCTTAATTAGAAATTTTTATCCACAAATAACATTTCC
AGATCCTTGCGCTACAGCTTGCCCACAACTAATGGCATCACCTATTCTACAAGCAGGTTT
TGAATTGACCATAACAGTACCAGAACCTGTAACAATGCTTCCACCGTGTGGTGGTGACGG
GCTAGGACTTGGGTGTGGTATCATAGGATCACCTTGTCTAACTGTACTAATTGAATTAGT
CAAGACATTCGTAGAACCACTCGAAATTGTATTAGGCGGAAACGAAGAATGCCCTGTACT
AAAATCAACACCAACTCTAGTTAAAGGAGGCATTATTAGCTCCGTTTAACATATCTTTT
AATATCTCTTTATCAGTTTTAGATTTAGTTTTAGCTTTTGATGCTTTAGACTTACTTTCT
TTAGCTTTAGACTCAGTTTTAACATCTTTGACTTTAGTTTTAGTTTTAGTTATCCCGGCT
TCGGTTTCAGACTTTGTATTTAAATATCTAGTTTTGGCATTACTAGCAGATATTAAATAA
TCATTTAATTTAATATGAACGTCAATACCTTTAATTTCTTCTATAATTTTATTGCGAGTG
CATATAACTTCTTCTATACAAATAGCTACTAAAATCAAAGCATAAGTTGCTGGCTCTACG
ACAACCTTACCTGCTGTAATTAAAGACACTATATCACAAATAATTGATATTATTAGTATT
ATATAAAATGAGAACTTAATATTTTTGAATATTTTCATTTAATTCCTTTCATTGAATTTA
GTTTAGTTTAGTTTAGCTTGATGACTCCAGCAGACATAGTAATACTAGGTCCTGCTGAAA
TTGTTTCGCTGCCGGACACATTTATATTCGGTTACCAGAAATTGTTACATTTTCATTAC
CTCCTACTTTACGTGTTCTATCAGAACCTACCTCTAACTTTTCGTTTGACTTAACATTTA
AATTGTGGTTAGCGTCATATTTCTCATTAACGTCTTTTTTAACGTATTCATTTTGTTCAC
CATCGATATGTAATAAATTATTTTCTTGTGTATATTCTTTTTTATTCTTTACAGTATTGA
TAGTCATTTCACCATCTTTATTCATAGTAATTGTAGTACCAGTTCTGTGGTGAAAAATAA
TATTACCATCTTCGTCACTCCATTCTTCGTAATGACCTGTAATACTATCATATACTCTAG
TATTTTTAGGTTTTGTATTTTTGTGTATTTCGTTTTCACTTGCAATGCAGCCTATAACAA
TAGGTAAGTTTGGGTTATTATTGTCTAAAACACAAAATACCCAAGTTCCTGGTGTTAATA
TAACGTTATAACCAAATCCTGGATATTTTCCAGATCTTGTTATAGTTTTGTATCCAGATT
TAGAACCTTTACCATCTATATTGTTGGCATATTCATCAGAACCATCTGAAGGTGCTGGGT
AATAACCAATATAATCAATACTTTGCATAACTTCTGCCCAAGGCAAATCACTTTCCTGTA
TTTGATTATATTTAGTGTCCTTTTCTCCAGAAGTTACTGGGTATTGGCCAGGAGTAGCAT
TTTCACTCATTCCGTGAAGTTCAAATATACGAACTTGAACTCTACCTCCTTTTTTAGGGT
CATCATTATTAACAACAATACCACGATATATTCTAAATTCTGATTTATTCATCAGGTACC
TTTATGTATATTTATAACATTTTAAGCTGCTAGCACATTCTAAATACTAAAATACTTAAG
```

FIG. 17AN. Continuation of (CJLB-15-1 [organism=Campylobacter phage CJLB-15] partial genome contig_1)

```
ATGCTAACAGCATTGCTGTAGTACGTTTAAAAACATTTAATGGGTCAATAAAATCATTAA
CACAAACTAATTCACCCTCACGATTAAAGAAAATATTATCCGGAGTTACCATAGTTGATT
CGCGTCTAAGAATATCAAAATCTCTAGCATCGGTATTGAAAAATGTTTGCGATCCTGAAT
TTCTTAAAAAATCATTAAGTTCATCGAATTTTAAATCTTTTGTATTTGTAATAATTATAC
CCTTTGGGTTCTTTGTATTGAATAAATAATTGCGTGTAGTTAATTCTATAAATTCATTGA
ATTCTTTTAGTGTATCCTTAGATGGTTCTTCATAACCATATTCAAATGGTATAGTACTAA
ACTTGTCAATAATAGAGCCTGAGTTAATAACAATTTTTCTATATAAATTTTATTGTTTA
TAATAAAATCATATTTAATTGAACCAAACTTTATATTTGTGTTAATTCTGGATCTAAAA
TAATTAATTTAATAATATTATCAATAGATTCTTTAGTATCTATAAAAAATAATTCAGTAC
TTAGATCAAAATCATCGGATAATTCGAACTTACCTGGACTTGTTTCTTCGTAGTCTTTAA
AGAAACGAATAATTTGAATACTTGGGTTGACGGCAATATTAGATAATTCAATTGCAGAAA
TCATTTTTAAACTCCTTTAAATGTTTTTTTTTACATAACAAAAAAATTAAAGTCGATTTT
AACCGTGTTTTTGAGTGGTTATAACCGTATTTAGATTCTAGTTTTATATTTTAGAGCCAG
ACATATAACACTAAAGTGTCGTATGCTTAGAACTAGAATCTAAATTGTTTTATTATATA
AAAAAAAAAGCTTAAAAATTAATTAAGGAGCTGTAAAAGCTCCTTGAATTTACATTATGA
AAATTTAGGGTTTAAAAATCTACAATGCGATTTTGGTGTTTCCCAATATTCAACTGCTAC
AACATTGACGTCTAAATCTTTTAACATTTTTTCAGCTATTTCTAACCACCACTTACATAA
GTTTTCACTAGTAGGACAAAAATCAACGAAAACAAAACCTTCTAATTTTTCTTGTATAGC
ATTTTTATGTTTTGTTTGGTTGTATTTAGATTTTATTTCATCAATAACAGATTGTTTAAT
AGTTTTATATCCATATTCTTGAGTATCGAAATATTGTGGATCTAAACCATCTAAAGATTC
TGAATATAATTCTGGTAATTCGTGGATATGACCTGGATCATTAAAATCCCAAACAAATTT
ATGATCAATAACTTCATCAACTAGTTTTTTATAACAATTTAAAAATTTGAAATCTAAAAC
CATATTATTGATTAGTTCATCTGAACCTAAGAATAGTTTTATTACGCCACTGTGCGAATG
ATGATGTCTGCAAGCACAAATACTATCGATACTATATTTTGGATCTAATGTTTGAGTCCA
AACTCTGTGACCCATACAAAAATCAAATTGTTTGTCTATAGTCCATTTAAATGTTTTCAT
TTTTACTCCTTAATTTTCTTTATTATAATATAACAAATCTTAATTTCTATTTAAATTTCG
CATTTCTTAGAACTTAACGCAATATATCTATCACGATTAGCATAAAAGATATCCTTATG
TATTCTAGTATTTTTATTAGTTAATGTATCAAATACTGGAACTACACCTTTAGGTGCACC
TAAGTATTCAATATTACGTTTTTGTTCTTTAAATTTTTTATATATAGATGATGGTAATTT
TAAAATTTTACCGTCTAACATACATTTAATCAAAGATTCATTTATTATCTCGTGGTAATT
TTCTAAAGAATCGTTGAATATACTTTCATAAATCTCTAATTTTCTATTATAAACGTTTAC
GCGTTTTCTTTCACCTGTATTTTTTACAACAACGGAAACTGTGCCAGTAACGTCAGCATA
CCCACATTCACATTCACTATTAGCTCTATTAAAATAATCGTCGTTTATAACCACATTTAA
TTTTTTATGTAGAAAAGCTTCGTAATAAAGTGCTTCTAACCTGTTGTTAAAAACTTTAAG
TATTTTTAAACTGTAATTGTCAGGATTTTTTAAAATATCATTTTTCTACAGCTTGAAGAA
CCGTAACTCCAAAAATCCGATATCAGATCAGTTTGTTTAGAAGTTCTAAATCCTATGTAT
TTTTTATTATCAATATTTGAAGTTACTTCATATACATAAGATTTAAATACTTCATCAGCT
TGATCAATAAAATTATATTTAATTTGAATTCTTCAAAATCTAAATTATTCAATTAAATA
ATCCTATTGATTCCAAACCCTATGGCCGTAACAACATTCAAATGTTTTACTTATATTAAA
CATAAAATCTCCTTGTCTTAATCATTCACTTCAATAGAATCTATATTATTAGTTCCAAAT
ATAAATTCTCCAATAGCATTATAATACTCAGTATCTTTAATAACACAACGAATATAACCA
TCACTTGAAGATTTGAAAATGTGTGCACCACCGCCTAGCACAACCAAGAAATCTAGTTTA
TCCAATATATTGCTATATCTTTCATTTACTAATGCTAAAATTTCTCTTAAGTATTCTTTT
TTAATACCTTCAATTTCTTTAGTATAATCATATTTTTGGCCTCTTAGTTTATAAACACCC
GTATCTAAGATTTCTCTAGCCTCTGGCAATGAAATAGATCTGTTGTGTTTTCATTTACT
AATTTAGCAACTTGCGAAGCTATTTTCATCAATCCGTGTTGTGAAATTCCTTCGAATAAT
TCTGGTGAAGTAACTCCTTTATTAACAAGAACTAAATCTAATGTATTGAATCCAATATCC
ACAATACAATATGTTGAATCACCTAAGTATTCTTTTTGAAGATTTGGAAAATCATTTCCG
AATTTTTCATAACTTAACTTAGCTCCAGCTCCTTGAGGTAACAACATTACATTATAATTG
TATTCAGTACCATCAACCACAAAATGACTTAGTACATTTTGAAAATATCCAGATTGTTTA
ATTTCTGCAATACTTAATCCTGAAACTATTAAATCTACTTTACTGAGTTTAGCAATTTTC
ACTGCGTGATTCAATAACAATGGTCCAAAATATTCTAAATTCTTATAAGTATCTAAATCT
ATGATATTAGAACTTGGTAAATGTTTGGCATCTTCACCTACCATATAATAACGTTCATTG
TAATGAACTATATTATCATTTTGAACACCTTCAAGTTTTTGGTTTGGCCTATAACACTT
GGAAATTTAAACTTTTAATTATTTGACCATCACCAGTGCCTACACAAACTTTAACAAAG
CTGTAACCTATGTCTACACCTAAAATAACTTTTTCTGTTTTCATTAATATTCCTTGAATG
GATTTACATTATTATATATTAAAATTACTTAAAACAAAATTAATTTTTAGTTTTAGCTTC
AGTCTTAGATTCAATTTTAGACTCAGCTTTAATTGAAGCTAAAGTTTCTAAACCAAATAA
CAAAGAATCTACCAAATCGATAGTAGCACCCACTATAGCATTCAACGCAAATTTTAAAGT
AACGTCGTCTAATTTTTGTAGTCTATTTTCACCTAACATAAGCATATCAATTAAGTGTTC
TGTGTCTAAGAGATAATTTGTTTCTGAGGTGTTTATTATTTCACAAATTTTATTTAAATT
ATTTGCAATATAAAAATACCGCTTAAAACTAAATCTATTTCTTCTTCTGTATAAGCATC
TGGGTTTCTCAAAATATCCTTAGCTATAAGAATAGTTTCATAATCTATATCTAAAGATTC
AATTTCTTCACTTGATCTAAAATATTGATTTACATTGTATTTAGGAATTTTGTCCTCGTT
TTCATAGATAGATTCTAAGTAGTCTTCTAAATAAGATTTCAATCAATCTCCTTTAATTTA
AATTTTAAGTATTCAATAAACGCATCTAATCTATATAACTTCAGAGCTTCATCACTTAAT
```

FIG. 17AO. Continuation of (CJLB-15-1 [organism=Campylobacter phage CJLB-15] partial genome contig_1)

```
TGATATTTAAATATTATTAATTCAGCTAATATGCAAGCTATATGATTTTTATTATATAGT
TTATTAAATATATCAATATCAATTTGTTTAAATAAAATAGTTTTATTTTTATATGATAAT
GTAAGTATATAACTATCCTCTGAATTTTTATTAAGATTGCAATTTATTGGTGGTATAGGT
ATACACAATTGTGTTAATAGCATTATGAACCCTTAAACTTTTAATTCTTACTTAATCATT
TCTGTATAACATCTTCACATCTTCTAAAACTTGAACTATAGCTTCGTGTTTTTTCATACC
ACCATCAATAACCAAGATATCAACGTTATTATTGAATATCTCACAGAAATATTTTCCTTG
ATCTTTACCTTCTAACGATTCTTTTAATTTTTTAACGTCCATAGCAAACCTTTCATTATT
CTCATTATCACATTCTAAATCTACTCTTATACCGCAAGCTCTTAGGAAGTTCATTCTTTC
TTGCTTAGAATATTTCGTAGGATACTCTTCTAAAAATTTATTAGTTATTTCATCCCAAAA
TTCATTCGTCTCTTCACTAAACTCGATACCATCAGGTATAATAGCAACACCACTGGCTTT
TACCATAAATTAATTCCTTTATCGAGAAAAATATTCAATCACCAACACAACAGTCATAAC
TATAGCCATAACAATAACATATTCGGCACCAAACGAACACTCACCGTATGTGCAATAACA
ATTAGCATTTAATGTACAATTATTGCATTGTTTATCACAAAATTTTTTATTTTTATTCAT
TTTAGCTCCTTTAATTTATTAATGTAATTATATAATAATAAACTTAAAATATACTTAATT
ATGAATTATCGCTCATCCAGTCTGCTGTTCTTAAAGCATCCTCATAATTTTTAGCAAATA
TGGCCCCTCCTTTATCACCGAAAACATAATACTTATTAAATTTAAACTTATATGATATGT
AATAACTACCCTTTGTTGTGCTTTTGATTTTTATAGGATAGAATATACACATTAATTCTA
TAATCCATTGTTTAATTTTATTCAGAGTTAGCTTCCTGTATTGTAATTTTTGTAAAATAA
CAATGCTGCTGCATCTTTCTTTTCATCCACAAAATCATTGCTTATAAATCTTTTATAGTC
ATTATGAAAATAGATTTTGGATTAGCAAAATATTTTCCATAATCTCTATGATTTATAAT
AAAATGATGTCCATTTAATGTTGAATAATCTACATACTCAATGCTATTGTTTTTAAAAT
ATTTTCAAAATCTGTCATTAATATACAATTAGGTCCAACATTATCTTTGTACTTGCCTTC
AAAAACATCAACATCCAAAATTACCCAATTTAAATTTCTATCTTGATCTGCTTCTGGTTT
TGATAAAACACTATATGATAATGCTTGGATCTTTTTACCGACATCTACATTATCATTATT
AATAAAGTTAGTTAATAACTGATTTACTCTATCATTTAAATGTAACAGAGCTTTTCTTA
GACTTAGGATTTACATTAAAATATGCTCTTGTATATGGTATATTATTAACAATATGTTCA
GAAACCTTACAATATTTTTCAAAATCTTCTTCATTTGAAATATAATAGTTTGCTATTAAT
CTTTCATTATGACTTCCAAAAACATTTTTAAAAATATCTTCATCATCACTAACAATAGCA
TCTTTCTTTCTACTAAATATTTTTATAATATAAAAGTGTCATCATTATAAAATTTTAAG
AAATTATTTTTAATGATTTCTTTATTGCTTATTAACTGTCTCATTTTATCTCCTTTAGTA
AATCACCATCTTCGTGGATATTTCCAATAACTTCCACATTTTTTCTGACTTAAATACTT
TTAAAAAAGATATATCGGGCTCAGCTTTCCTTTTATAAATTTCACCGACAAAGTTTTTGC
TAAAAATTTCTATTTTAGACATTTTATAAGTATCATCTCTTGTAATGTGATAAAGTTCTT
CAAGATCCTCATATTTTAAAATATCACCTTCATAGATTTTATTTCCATTTTTATCAAAAT
AGCCTGTAAATAATTCTATGGAAAACGCATTTTCATTATTAAAATATTCCTCATTTTTCC
AATTATATGGGTGATCTACTGAAAATCCTGCGTGGTCATAATTCTCTATGATACGATTAC
AGTTACTAGCATCGTTATGTTCGGTATTTTCAATATATAAACCTTCTGATGTTTTAATAT
ACTTCTTTTCAATATTATCCCAAATCCTAAAATCAAAATCTTTTAATTTCATTTTTATCT
CCTCCAATTTATTGATAATTATATAATAAGCTTAGATTTATTTTAATTTTATACTTTGAT
GTCAATTAAAATAAACAAACTCAGCTTTATGTTTATCCATTGCAGTCTTTACTTCTTTTA
GGTCATAACTTTCTTTAGATAATTCACAAACGTCCTTGCAAGATAAAGATACGTTAATTC
TATCAGGATCTTCCATAATATAATCTTTTGAATATAAAAAGTTCCAAAGATTATTACCAT
AACTATCACCTTTGTGGGTTATGTTCAATAATGTTCCATTTTTTAAGTCTTTTTTAATAT
CTTTTTGTTTTTATAATAAAAAGCAGTTGATGAAGTCATTTTATCTCCTTTAATAGATT
ATCATCTTCGTGAATATTGCTTATTACTTCCATATTTACATATGAATTATATACTTTAAG
AAAAGCTGTATCAAAATCAACTTTTCTTTTATGAATTTATTATCAAGGTTTCTAACAAA
CCTTTCTATTTTAAACGTTTCATAAGCAACCTACTCTTGTAATACGATAAAGTTCTCCAA
TAAGTTTATTTTCTAATAATTTTACTTATTGGCTTTATTGGCTTGTCTTGCCATTTTTTC
AACTATTTTATATAATCTTTTATATTCGTCTATAATAGATTTTATGATAGCTTCCAGATT
TCTATTACTAATGTGAGAAACAGAAACATAATCGGATTTTAACTCTTTCATAGCTTGCTT
GATTTCATCTATATAATCTTTGATGATTTCTTTGTATCTTTTCAATTCTTGTGATTGGAG
TTCCTCTCTATACCAAGGCATCTTGTCTTATAGCTAAGTAGAATATTGATTTATATTCCA
TACTTCGTTCAGTAAGTCATTATAAAGTTTATAATATTGTTTGTTGCTATGCGGACCATC
AGCAAGCTTGTGTAGAATTTTTAAAGCTTTCTTCCCAAGCGATTCTATATCTTTATAATC
TTTTTGAAGGCCAGACCTGATTTGTTATTGGCTACATTAATCTCCTTGAGCATATCATC
AATAGCAGCTTCATTAATAATGGCTTCATTAATAAATTTCGTAAACGTCATTTGTTACCC
TTTTTAATAGTTTAATTTTATACATAATTATAACAGATTAACCTTATAATAAACTTATTT
ATTACAAATTATGTATTAATATACTTCTTTCCAATATTATAATCTATATACTAAATCCTA
AAATCAAATCTTTTAATCTCCTTTCCGTCTTTATCAAACCAATTTTCATTTTTAATCTT
CTAACAATTTTTTAATTTCTTCCTTTTCTTCCTTTGGAACAAATTTCTAGTATTTTTCTA
CAATTTCTATCTTGTCAGTATTTTTTAAAAACTATTTATGAATTTTTCTTGCTCTGTAT
AATACAAGTTTTCATAAATTACAAAAGCTTCATCTGCTGTAACGCCTTTTAACTCATCGG
CGTAAAATCCAACTTCAAATTTCATTTTAATCTCCTTTGATTTAATTTATCAATGTAATT
ATATAGTAATAAACTTAAAATAATTAAATTAGCTAGCAGAGTCTAATTTTATTTCTAA
GTTCTCAGTATTTGTATTCACTTCAAGTGTGCTAATACCAGAATCTACAAAAGATTTCAT
AGTCTCTGGTTCTTGTTTTGAATCTTTATTAAAAATTTGTTCAGCAAACTCAGTTATAGG
```

FIG. 17AP. Continuation of (CJLB-15-1 [organism=Campylobacter phage CJLB-15] partial genome contig_1)

```
TCCACGAACCACATTAATTAACTCACCACCCCAAGTATTAATTATGCTAGGATTTTTAAC
TGCATTTTGAAGAACTGTTAAAGCGTTGTTATACTTATTAATATATTGATTGTCTATTTG
TGAGTTTGAACCAATTATTATAACTTTACAATCCTTGTCAACTCTTGTTAATATGGTGCT
CATTGACTTAGTAGAGATATTTTGGGATTCATCCACAATAACAAACGCATCCGAAATTGT
TCTACCACGCAAAGCACCAATCCACATAGTTTCGATACCAGATAACTCAATAATTTCTTT
AATACCTTCTTGTATTTTTAAATTATCAATTTTAACTTTTCTTGATTTATTATCATTAGA
TTTTTCAAGTCTTTTTCTAACAATATATTCTAAGAATCATATAGTGGGTGATTAAAAAC
CGCAAACTTTTCGTCATTTCCAGCAAGATATCCAATATCTTCACCTTTATCTAAAGATTC
AATTGAGTTACGTATATAAACAATTTTACTATATTGTTTTTCTTTAACTAATCTGATACC
AGTCGCAATAGCTAATAAGCTTTTACCTGATCCTGAAACTGCAGAAACAACTTGTAAATC
TACATTAGTATCTAGCATAGCATCCACGAAATATTTTTGACGGATATTAATAGGTTTGAC
ATCTTGTTTTTCCAAGTGTTTTTCGTCTATGTAATTAATTCTGTGATTTTGTATCCTTGC
TAGTTTTTTATTACCATCTTTACTCTGTATTAAGTAGTTATAATTTTCGTGTTTATAATC
TGGATCTACACTTAAAATGCTGCTAAGATTTTCTGGTAATTTCTCAACATCGAGAACTTT
AAAAAACTCTGGAACTTCATTAAAATCTTTTTTTAAACCGAATGTCTCAGTTTTTACCCC
TTCAGATATAGCTCTTATCTTGCACATACTATCATATGTTATAAAAATACAATCTGGATA
TAACTTAGCAACTTCTATAATTTTTCTATCATTTAGAATTATTAATAGGTTCATCTGCGTG
TTTATATTCTTTTTTACTAGTAATAGTTACTTTTAAAAGAGAATCACCCAGTGTTGTCTC
AGTATAGTCATTGAATTTATTAAGTTCAATGACATCAAGATTTGATAAAAGTCTTGCAAA
ATTACGGCTTGGTATCCAACTTCATCGAATAATGATTTTTTAGCATCTAATTCATCAAT
AACTGTTTCGGGGATTATAATACGATTTTCACTATCGTATAAACGTGAGAGATTATTTAC
ATCATCTAAAATGATGTTGGTATCAACGACATAAGTTTTCATTGGAGCCTTTTGTCTTTT
GATTTTATTTATGATTTAATAACCTGAGTTTTAAATTACAAAAATTTAAACTTTAGTTT
TAGTTGTTTTAAAAGCTTTGAACTTTAGTTTAGATTGTTTATATGTTATGATATTTATAAT
ATTATAATATTATAAGCTTTAAATTAAAAAATGTTTTATTTTTTAGATTTACTTGAAACT
TTTGAATCCCTAAGCGCTTTCTTATACAAAGCTTCTGCAGAAACACCTATAAAAGTTTCT
GTTTTAGTTTCTATAATTTGTTTCATATTTTCATTAGGTATTTTGACTGCTCTTCTATAT
ATTCTGCTATTAATATAAAGTCTTATTATTGGAAAAAATCCAAACTTTTTGAGCATAGGC
TTAATTCTATACCAATCTATATCTAATGGTTTATTCTCTTTAATATTCTTTTTATTTAGT
CGAAATATGGCATTTAAAAGCATTTTTCTCATTGGTATCGGGCACCAGTGAAAATTTATA
CCTAAGGTATAAGATTTAGATTTTCTGAGTACCAGGCACAATGGAGTTCTATCATATTTA
ACACTGGTATCTTTAGGATTATATTTAAAAATTACTAAATTACCAGGTTTTAAAATTTGT
CCTTTTTCAACCGATTTGGTTTTAATAAGATTTTTAACTAACTTTAAACTATCCATTTTC
TGACTGTTTTGAAGTATTTATGAGTCTGGATTTCCAGACTCTTAAGAATTATTGGTCTAC
AGAAACTACGTTAGTAGCAGCTGATTTACCATCTTGTGGCATATTAAATTCAGATCCATT
AGAAATAATCCAATCTGAGAAGCTAAATGTGATATCACATTCTTGTAATGTATCTAATTG
ATCAGCACCAACACTAATTTCACCAACACCACTTGGCCAGCAGTTTCTTAAAGTATATTC
AGCAACTTCATTTTCTAATGAATCTAATTGACAAAACCGAACTTCTGTAAATAAACCTCC
TGGATTACCAGAATGTGTATTTGCTTGGAAGTTATCACAAGCTTTCATCCAACTTAAGAA
GTCTTTACGAGTTTGGTGTGCATTATCCATATAAAATGTCACAGTCCATTGTGTATCATA
CGAAGTATCACCAGGTATAGGAAGCTTTCTTCCTTGGTTAAATACTTCAATTTGTCCAAT
AGTTACACCTGGAAAACTAGTAGCTTTAGCTAAGCAGTTCAAGCTTTGTAATTCCATTTT
ATGTTGCACTTCTGTTGGAAATGAAAGTTTAACACGGTATTTTGTAGCTTTTGCACCAGA
TTTTAGTGCGTTTTTAATTTCTTCAATTTTGTTAGACATAACTGTTAAACCATTCCTTTG
CTTTTGTTTTATTTATTATTTTGATGATTTTTATGGTTTAAGATTATTTTAAGTTCTAAA
ATTAAAATACGACACTATAGTGTTAAACTTTACACTATAGTGTGAAATCTTCTGATAGGA
GCAAGTAATGGTCCTTCAAAAATATAAGGATAGAAAAGATATACGAGTTCTAAAGAATGT
CTTGAGTTTGTGGTAGTGTTCTACCTCCCAGTCCTTCATAAAAATATTATAGAAGTATCC
ACAGTTCGCTTATCGACATATGTCTTAGCAAGGTAGAGACTATTCTGAACATTGATTAGA
ACTATAAAGACTTCCGGTGTGCTAAGTTTATACTAACAAATTCCCGATTAAATAAGAAGT
ATGTATGGTGTTCTGCACATAAAAGTCTTTATAGTTCTAACATTCTAAGTTTAGAATTTA
AAACTAAAATATAACCAAATTGTGAGCATCTCTCTGTTCAGATTTTTAAACTTTTTAAA
TTTTTTAATCTTTCAATTAAGTTACATTGCAATCTAAAGAAAAAGGAGCACATTATGATG
ATTTTCTCTGTCAGGAAATCCGAAATGCTCACAATTTTGGTTATATTCTAAATCTGTTTA
ACAATGATATTTAAAGATCTAATTTATTTATATTTATAATTATATACTAAGTATCCTTA
AAAGTTCCTTAAATTTTCAAATCTTTTGTCGATAATTTTGACAGCTGCTTTAAATCTTTC
GTCTACAGAACCACTTAAATTAACTACATTAATACCGTAGGTATCTATATAGTAATCGTA
GTAATTACTACAAATATTTCTAAATTCTAAATCAGTAGATCTGACACCATCCGGAACTAA
ATCAAATTCTGGTTTAATATAAAAACTATATCATATTTTTCATTAATTCAATAGAAAC
TATTTCAGCTAAATCTAAAAATACATCAGGTATTGATTTTTAATCTCTACTAAATACTT
AGTATAAACTACAGCATCTAATATTGTTCTTTCGTATATACCATCTTTGTTAAGATCTTC
TATATGAATTTGCAAAGCTGCTTTTTGAGTTTCCATATCACCATCTTCATTTATATTAAA
ACCCAATTCTTTTAATTTTCTTCCAGGCCCTGGAATAATATCCAAATTATATCGTTCTTT
TAATAATTTGGCTATAGTCGTCTTTCCAGAACCTGAAACTCCTGTAAATCCTATTTTCAT
TTAAACCCCTTTAAAACCTAATTTTGGCTATTTAAACCATATCAAGGCCATTAATAGTT
CTAAAATCCATAATATTTAATAAAATAGTATTGGCGGAACCTTTATAATCTATAAGATCT
```

FIG. 17AQ. Continuation of (CJLB-15-1 [organism=Campylobacter phage CJLB-15] partial genome contig_1)

```
ACTAATTTAGTACTTATTTTAGTTCTTAAACCATCTTTAGAATATCTTACATTATATATA
CCGTGAACAATTGGGTTAGAAGTATCTAAAGATACAATCTCTGGAATGTTCTTATAATTT
TTAAATTCTTGAGGAACTTGACAACCCAATAAATGTATTTTAGAATCTTTTAATAGATTT
AATTTATCTAAATGTTTTATAAAATCTATCCTTGCTTGTGTTAATTTAGCTTCTTTAGTA
TCACCTTCGTATTCATAGAAGTAGTCTCCTGAAAAACAAATAGCTACCATATCTGCATTT
TCTTTCATAAACTTAAAGCAATCTGTTAATTCTTCTAAAGTATTACCTTGAACAACGCCT
ATTTTCTTACCAGGTATACTAAACTTAGAAAAGTCTCTAAAAGATTGTATTGTTGCACTA
GCATTACCTAAAGCATCAGGGACTATATAATAGAAATTACTAGGATTGATAGAACCTAAT
TCATTTGCTTCTTTAGCAAACTTATCGTGATCGTATAATGTTCCTAATTCAAATAAAGAA
TTATCTAAATAAACTGTTCTACGCTTTTTAATGAATCTATGTAAAATTGTTTGTATTCT
GGGTAGATTTCAAATAAATGAACTAAAGCATAATCATAATCATTAAACGTTCTTGATTTT
TCTAAAAGACTTAACGGAACTTCGTGAGAAACAAGCATATAACTCCTTTTTGTTTATTAT
ATTATAATTGAACTTAAAGTTCTATGAATCTTATGTAAAAACTAAAACTCTAGTTTAAA
TTATTTTAAAATTTAAGCTTTTAAGTTTAGAACCAAAGTCTAAACTCTATTGAATCGAAC
TCTTCATAAGTAGGTATTGCAAAAGATTTCATCATAGCATCCACAACACTTTTATTAATT
ATTTTACCTGTAGCATTTCTTTTTTCAAGTCTATTTAATATCATTGTATATGGTGTTAAA
AATACTACTGCTTTCTTATGATAATTTCTAACCAAGCTCGAAGTAGCAAATAATCTACGC
CTCGATTTAATCGAAGTATTCGTTTTATCTATTAAAATATTTTGATTCTTTTGAAGTGCT
CTTAAAAACTTATCATTAAATAAAGAATCGATTTCTTTTTGATCAGAATCTGTTAAGTTT
CTCCAAATATCTGAATATTCAACTTGATTGTATTTTTAAAACCGTATCTCATTAAAATA
TCGTCTCTTGATATAGCTGCTTTATCATTCATATAAACATAAGTTGATTTACCAGAACCT
GGTAATCCTACTAATACTTCTAAAACTGGTTCATTGGCAACATTAGATCTATCATAAGCT
TCAATATTTAAATCGGGAAGTTCTTTTGGAACTTCAGTGATTCTACCTAAAGCATCAGCA
ACTGAAAACTTGGATAATAATTTTAAATCTCTATAAACATAACGTTTTTTAAGTGTTTCT
AAATCGAATTTATAAATGTCGTGATGGGCTACTATTTTAATTATATCTATTATTTCTTGT
TTGGTTAGATTTAAATCCAAATCGTGTAAAACATCTAATGCAAAGAACACACCAGCATTT
TCGTGATTTAAAAAATGTATTTTTTCTGGATTATTTTAGATGGTGTTCTAGTTATTATT
TTACCAATATCGTGTAAAGCTGCTCCTAATATTAATACTTTATAATCAGGATCATCTTTA
TATAATTCGTTGACTTTGGCCATAACCATTTCGGTGTGTATACCAACGTTCGGTTCTAAG
TGGTATTTGTTTGGTGTATTTTCAGTGCCATTCAAACATCGATATAAAGCATCAATATAT
TTGTGATTTAAATCTTTTAAGTTCAACATTGTTATCTCCTTTTTGTAATTATAATATATT
AAAGCTTAAAACTTACTTAATATTTTAAAATATATCTAAAAATTTTAATATATTTTAAG
TTTTAATATTATATAATAATATTATTTAAAAATAGGATTTAAATGAAAGTAACTTATAAA
AATATAACGATAGATCTAAACAAAACTTTCAAAGAAATACTCATTGAATTAAAACAGTAT
CCACTTTATAGAAAACAAATTATTGATATTCTATTAAAAGACCCTAAATATAATGGGGAA
TTTCATTCAATATACAAAGACTACAAGGATTTACAAAACAATCCTAATTTTTGTGTAATT
TGTGGAACTAAGACAAGGACACAATATTGTAAGAATGTCTAAAATCACCAGATTTTAAC
AAAATACGCATAGCTAAAATCAAATCTACAAAATTAGAAAGATATGGTGATGCTAACTAC
AATAATATAGATAAACATAAAGAAACAATAAAAGAAAAATACAATGTAGAAAACGTATCA
CAGATACCAGAAGTAAATGATAAAATTAGAAACACCAAAGCCAATACAGATTATACCGAA
ATAAACAATAAAGAAAAGAAACCAATTTAAGTAAATATAATACTGAATATGCGACACAA
AGTGAAGTTGTTAAAAATAAAACAATTGAAACAAATCTAAAAAAGTTTGGAGTTATCTGT
AATTCTCAAACAAAGGAATTTAAAGAATCCGTTCGTAAAACCTGGGATTCTAAATCCGAT
GAAGAAATACAAAGAAATCGCTGATCAAAGAAAACAAACTAATTTGGAACGTTATGGTTAT
GAGTGTGGTAATAAAGATTTAATTATAGAATCTTGGAATTCAAAATCTGAGGAAGAAATC
ATAGAAATAAACGAAAAGCGAAAACAAACAAATTTGGAACTTTATGGAGTCGCTAGCCCA
ACTCAAAGACATTTAAAAAATAATGATTTACTGCACGAGGATTATTTAAGACTTTCATA
AAAAATGAAAGATTTGATGCAGACGCCTGTTCAAATTTTTATAACTTAAGCCCGACAGGT
GTTCTAAAATATAAGAAAAATTTAACGTAGAAGAACCTAATGTTACTAGTATAGCTAAA
ACACAACAAAAATATTTGATTTTATTAAAACTGATATAAAAAAATACAATGTTAAAAAT
ATTATAAAGGGTGAATTAGATATATTTTTGCCTGATTATAACTTAGCAATTGAATACGAT
GGTTTATTTTTTCACAGTAGAGGTTTACATAAACATAGAATGTTTAATACACCTGATTAT
GATAAAAAATATCATTTAAAAAAGACAGAAATGTGTGAAGCTTTGGAGATACAATTATTT
CATATTTTTGAATCTGATGATTTAGATATATGGTTTTCTATGATTAATAACAAACTAGGT
TTAAATAAAAAAATTTATGCTAGAAAATGTATTATAAAAGAATTAAGTTATAATGAAGTA
GTTGACTTTTTAAATGAGAATCATTTACAGAAATCGACAGTTTCAAAAATTAATTTAGGT
TTATTTTATAATAACGAATTAGTAGAAGTTATGACATTTGGTAAGCCTAGATTTAATAAA
AACTATGAATATGAATTAATAAGATTATGCACTTTAAAATATTGTTCGGTTATAGGAGGA
GCTTCTAAATTATTTAAGTATTTCTTAGACAATTATAAACCAAAAGTATAGTAAGTTAT
GCTAATAGAAGATTTAGTAAAGGGTCAATATATAAAACCTTAGGTTTTAAGTTCGTAGAG
AATACTGAGCCTAATTATTTTTATTTCAAAGATTTAAAATTGCTGGCTAGACATCAATTT
CAAAAACATAAGCTAAAAGAAAAGTTAGAGATTTTCGATCCTAGTCTTTCAGAAAGTGCT
AATATGATGCTAAATGGTTATAGAATAATATACGATTGTGGAAATATGAAGTTTCAGTGG
ATCCAAGGATCGTAAAATCCTTGAATCTTTTGTAAATTGAATCTTGGGTTTAGCTTACAA
CAATGCTGAAGTCGTTTGAACCGACATTCGTGAATCTGAGATGAATGAACTCTGCAACAT
AAGTCGGCTTAATATATACGTCTATGACGAGTTGGTTCGCTGCAACTACACTTGCTGGAT
```

FIG. 17AR. Continuation of (CJLB-15-1 [organism=Campylobacter phage CJLB-15] partial genome contig_1)

```
TGTTTGATGCGTCACATATCACAAGGTAGTCTTGGATCCCGCGGCCAGCTTTTACTTGCG
CCAAGAAAGGTTTGATAATACTTACAAGGTAATTTCTTGTAAAACTATCATTGAACTCAA
ATAGACTATACTTCGACATACGCCCTAAAGATCTTTCCAAATGGTTAAACAAGCTAACAA
CGTTTACACGATCGAAGCTTGAAGCTTTAGTTTGTAATGTTTTTTGACCCCAAAGAACTG
CACCAGTGTTTGGAAACATAACTACTGGATTTATACCATTCTTGTAAAGTATCATTGTGT
TCAACATCGTTCGCTACGCGATGTCCGTTCGAAGTAATGGTAAACAACGAACTGCTTTAA
CTTTCGTTAAAGATCAGACTATATCTTGCTCATATCATAATGACTTAGAGCGCCCCATTT
CGAATTCGCTTGAATTCTACTCTACTTGGTGTCTATAAGACCCTTCGATAGTCGTTGAA
CGTTCTCTTTTAAAAAAGAGCTTCGCTGCTGATTAGCATATTGTAAAGTGATTAAAAGT
TTCGGAGTTTTAATCACAAAATGCAAAGTAGAATCTTTTTAAATAGATTCAATTTATTT
ATTTGTTCTACATAAAATTGAATCTTTTAAACAAATTCAATTTATTTATTTTGTATTATA
TAATTATAGATATCATCTATTTCGATATCGCACCTTCTATTTTTACTTATATTTTCAACT
GCTGGTATAAATCTTAAATTTGATATGTTATCTATTAAATAAGCGGGTATATTATTGATA
AATCCCATTTTTATAGAGTATATATGATCTAAATGATACCCATTGTTTTTCAGAGTTCCT
CTTTTATCATAATTTTCTAAAGTTTTTAAATCGTTTTTATTAGTATATCGCCAAACAACG
CGTCTATAGTACTCGAAATCAGGTAAATCTTCGGGTTTAGGCCAAACACCACTTCTTGC
ATTTTTAATTCTGTGTCTATCATAGAAATTTAAACCATTTTCATCTTTTTCGAGATTTTG
TATTTGCATCCTATCATAGAAATTTAAACCATTTTCATCTTTTTCTAATTTTTTAAATG
TACAAATTGATAATGATCTATAATTTCACCGTTATATTCAATCTTTTTATTTTTCATAGT
TTTTGCAGCTTTGATAGCGGCATTTTTAATAATTTCTGGATTATTCTTATAAGTTTCATT
TCTTTTAATAATAGCTAATTTAAAGACTTCTTTATGTTCCTGATATGCTTCTTAGCTAT
ATTGCTTAGATCTTCGTGTGTATATTTTTTACGCTTGGTTTCTTTGGCTTTGTTATAGC
TTGCTGTTTTCTTCTGGTGATTTATTTTTAAAAGTTTCTTTAACTTTTTCACTCTGTGA
TTTTGCTAATACATTGGACATCGTTGAGTTCGCGTGTCTGCTTGAACATCCATTAGAAAA
CCCTTCTCTGAGATTTCTAAATCTTTTCTTATTTCCGCAAGTAGGACAAACTAAATCAAT
AGGCTTTAAATCTTCTATTATATAATAAACTCGTTCTAATATGCAAGCGTTATAATCGTC
TAAGAATTCAGTATTTTTATATATTTCTTCTTTTAATTCTTTGATAAATTTACTATTACG
AGTAAAATTTTCACAGTTTGGATATTTTTCTTTAAATTTTTTAATTTCTTTTAATAATTT
ATATCTAATAGATATCATAAGAATAATTTAAATTTAATTTAGTAGAACATTTTAATTT
AGGTGTTTCTACAAATATGATCAAATGAGGAAGCTCCGACCTTTCCTCATTTAAAGTTAA
TTTTTGCATTTTATTCCTTTGGAAATATTACAACTTAGCCTTCCAGCAATTAAAGGCTTT
TTTCAAGTTACGTTTCCGTAACCGGTGACATACATACTTTTATTATATTAAAAGCATTTT
GTTGCTATCACGCATCGCACCAGTTGGGCTATATGCCAACGCCTCGCAGTTTTTAATGAG
ACCTCTGTTAAGACCAGCAGCTGCATACCAGTTAGCTTGATTATAATTTGTTTGAGCTTT
AAGACCTGCAATATCTGCAGCTAAGTTCAGCCATCTGTAACCACCAAGCTCAGCACAGTA
TTGATATTTGTAATTGCTACACAAAGTTACATATTTAGAATCTATATTTAAAGATTTTCT
AAAATCAAGTGTTTTTTGATTAGCAATTGTAGATTTATAACCCACTGAACAACTTTTTGG
TGCACCCATAAATGCTATACAGTCACCACGAGTAATCGCAATATCAGTAGCTGCTTTTGG
ATAAGTTTCGTTACAAATTAAGATATCAACATCGATTTCTTCTTTGTTGTCAAAAATTGT
ATAAGCGTCTATAATATCGCCAATACCTGGAGCTGAATCCATACCATTTTCAAGTTTAAG
TAAATCTTCACCTAAACAAGTTTTTGGTTTACCTTGAACTGCTTCATTTACAGAAACTAA
GATATAGCTTGACTTGCCATTAATCATTGTTTCTATATAAGTAAATTCATTTTTCTCATT
TTTATCAGTTAAGCCTAAGCTTACAATAAATGATTCTTGAATTTCGTTTGCGTAGATAAC
AATAACAGCAAATTGATCACCATAAGGAATATAATCAAATTGAGAATCTAATGGTATACC
ATCAGTGATATATTTTCCTTTGTTGAAATCATCAGGGTGTGCGATTGCGACATCAATTTT
ATTGCCCCACTCTCCCGGTGTTTTAGCAAATATTTTTAATTTTGCATCTTTATAAACAAA
TGGTTTAGATAATTTATCTTCATCAAATGTATTGAAGTTACTAATGGTATGATCATAAAG
TTCATATTCTGACGCATCGTATTTGGTTTCAGAACCTTCTACAGGAACTTCAACACAAGA
CGATTTAGTAGCCTTAACTAAATAAACTGGAAAACCTTTAGTTGCTTCAACAATAGCTTC
AGAATCCTCAGTTCCTTCATAAGTAATATTTGTGAAAGCTTCACCATTGACTATACTGTC
AGAGATTGCTAAGATTCTGAATCTTGGATCAGTTAAAACATCAGAAAATGCTATAATATC
TCCGCGTTTTAATTCAGTGTTAGCACCTCTAAGACTTAAAATATAATTAGAATCTGGTTG
AGATTCACCTTCCATTAAGTATACTGAAGTGTCTGCATTTAGTTCACCTGGTTCTTTGTC
TAAAGTAACAATAGTTACTTCTTGAGTTATAAACTCTGGTATATCGTAGATATCTGCCAT
TTATTATCCTTTCTTAGCTTTAGATTTTGGTTAGCTCTACCACTTGGATCTGCATCTTC
GGCTTTATCAAAACTGAGAGATTCTTTGTTGGTAATTATGTCGGAAATTTCAGGCAAATC
TTCAATTGTTACTGATATTTGACTTGAAAAATCTTTATGACCTTCTTTTGAAACTGTTAC
ATTAACTGTAGTGTTTCCCGCAGCTACTGGAGTAATTTTTAAAATATTGTCACTAACTTC
CAAAGTTGCAACTTCACTATCTTGTATAGTAGCTTAAGTGTAGCAGATTCTGGTAATGT
AGCAGTTACTGTTTGAACACCTTGATTAATTTTAGCTGTAACTGATTCTGGGCTAAAAGA
TACTCCAGTAATTTCTGGTAAGTCAACTGCTTCAGTAACGGTTACGGTTATAGTTTTAGT
AACTTCAGTTTTTCCTTGAGCTTGAGCTGTGATTTCAATTGTAGTGGAACCCACTCTTAC
ACCATTTACAGTTTTCTTATCACTTTCAATACTTGCAATACCTAAGTTTTTAGAAACAAT
TGTATAATCACTAGCATCAGTGTCGATATTTAACACACCTTGCTCGCCTTGAATTATATT
TAATTGTTCTGGAGAAACAATCAATTTTGTTTGTTCTTTTTCTTGAACGTCGAATTTTAA
TTCAAATGAATTAGTTCTCGAACCTTCTTTGGTAGCTTTAAAAGTTACAATAGCAGTCCC
```

FIG. 17AS. Continuation of (CJLB-15-1 [organism=Campylobacter phage CJLB-15] partial genome contig_1)

```
TACTTTTAATGCAGTTAAAGATTTATTAGATTTGTTAACAAGAACCACATCAGGTCTATC
TGTTTCTACAGTATAAGATTCTGCATCGGTTGTTATTACGTAGCTAACAACTTCATCAAC
ATAAGCACTTACTTGGCTTGGGTCCACTACTAATTGGGTTAATGGTTGATAATCTGGATT
TGGTATTTGCTTAACTTCATTTCTAACATATTTAATTTTATATTCTTTATTAGAATCGTT
GAATTTAAGAACTTGGCCAACTTCGAATTTATCAGTTTTTTCGAATTTAACGTCTACAGA
GTCAGCTTCGATAACTTTAACACCTTCGATTTTACTAGCGTTAACATTTGTTTATATGC
ATTTTCTTCAAATTGTAAGCCATCTAATTGTGTGGGTGTACCATTGATGTCTGCTGCACG
AGAAACATAAATTGCACCACTGTAAGCTAAGAAATTTTGAACTTGATAATAATCATTATA
ATTCTTTGTATTAGGCATACCGTAATTATCTCTGAGTTCTTGAACACTTGAGATTAAAGT
ATGTACACCAACTGGTCCTTTCTCAAAATCACCACCAAAAACGGCAGCAGAGTCACCTTC
AACAGGCGTAATTTGAGATTGATCTACTTCAGAAACCTGGATACCAGGGCTAAGTAAATT
TGCCATTTTAATCCTTTTAATATGATTTGATATTACAAAAAGTCTCTCGAACTGCATCAA
GCTTCGTTGTTGAGCTCTTAAACCAATTTCGATGCCTTTAGGCTAAAACGACTAAAGTAT
ATTGGAATCTTATTATTTATTTAAGGATTTAAAAATTGAATTTTAAGAGTTTTTTCAGTT
TATGTATTAAAAATTAGATTGGGGATTTAACATCCCCAAATTATTGAAGCAATTAAGCTA
AAATAGTTCCTGTTAAATCTACACCGAATGTTCTTGCGTAATTTTCTGGTTCAAGTGGAT
TAGTAGCTAAGCCATATCTTGTTCTTGCAATCATACCTGGTTGTCCTGATTCTTGATTCA
TTACTTTTTGGAAGCTTAATGGTACATATGGACAGAAGAATCCGAGACTATCTTGAGCGG
TTGTACCCTTATAAAGAACAGTGATATAATCAGATTTAGCATATTGATCAACAATTACAT
TATATCTACCATCATAAGTCCCTACATTACCAGTAAATACATCAGTAGCTATATTGCTTG
AACTAGAAGCAAATTTAAATGTACCGATTTGATCTAACATAGTAGCAACTTTTGGAGATA
CAAGCAATGTATTACCTGAACCGCGTCTTGTCATTAACCCGATGTTTCTTGCTTCTAAAT
CTATTTTGATAGCATTACATCTATATCTTTCAATTTCCCATCTACCAGCTTCTTTGTGTT
CAGCACCTGGACTTAAAGTATCAGCGACAACGGTAGCTGTATTGTTTACGAAATGATAA
TCTCACGATCTATTTCAGTTTGCATTTCAGCAGCAATAAGATTAGCTAAATGTTCATCTG
CAAGCACACCGTGTTGATTTTTTAAATCTTCATACATTTCTAAAGTATATTCAGCTTTAA
GTTTTCTTGTTTTTGCCTCAACAGTATCTTTTTCAATTCCAAAACCTACAGTGTTCATAT
CTTCAGCAAGTTTTTCACCGTCAGCTGTACTATATGGTCCTGAATAAGTTTCTAAGATTT
TATGGAAAGTAGCTTCGTTAGAATAAACGTTAACGATTTTAGTTCCTTTATTAGCAGCTT
CGTTTGGAATTTTTTATCGCTAGTTAACTGAACTAAAGCAGTTTTACCATCTTTTTCAA
CGTGTATAATTTTACCTGTCGCACTTGAAGTTGTACCTGTAACATATCACCTTTAGTCA
CATTAGCTTCAAACACAAGAATTTGAGCTTTAGAAACTGGAGATATAGCACCGTCTTTTT
TATTACCTGTATATCTATTGACTAATGCATAAATGTAACCTGTAGGCATTGTTAAAGGTT
GAATACCTAAAAGTTGATTAGCAACTAATGCTGGGTAAACCCTTCTTACAATTGGCATTA
AGATTGGTGTAAATTGAGCGATATCACTAGAGATAACACTTTCACCTACAAGTGCACCTT
GAGATGCTAAAGCAGTGTTGCTGAGCAATGTACTCATCAATACAGCTTCACTTTCATTTA
AAGCAGCGTATTTTGAATCTTTAATATAAGACTCTACTTTTTCATTAAGACTTACATTTT
TATCCATTGTTTTTAACCTTTTAATTTTTTATATATTTATTTTTTAACTGAATTTTAACT
GAGCTTGTTAGTTGAACTTAGTAGTTAGCCCAGTTAATGTCAGCGCCTGCTTTGTTTTA
AAACTTTCTTTGATATCCTTTGAATCCTTTGAATCCTTTGAATCCTTTGAATCCTTTGAA
TCCTTTGAATCATCAGAATCATCAGAATCATCAGAATCATCTTCGTTTGTTTTTTTACAA
GCTTCAAATAACGCTTCTAATTTAGATTCAAAACCTTCACCTCGTTCTACCAAGCTAGCT
AATTTTTTAAATTTTTCACTTTCTACAAGATTTAAATTAGCAGCTAATTCATCAATTTTT
TTAGATTCTTGAAGAATCGCAAGTTCAGCTTTAAGTTCTCTATTTTCAACAACTAATTTA
TCAAATTGATCACTTAATTCAGAATCTTTGTTTGCATAATTTTCGAGTATGTTTGATCCA
GCAACATCTACTAAGTTATCAAATATACTTACTAGAGTAGCAGCCTTTTCATTCTCAACA
ACAGCGTCTAATTTTTCAAGAACTTCGTCTTTAAATTTATAAAGTTCTTCATTAATGAAT
GAATCTATATTTTCAGTAATTTTAGATTCAAGTTCTTTTTTAGCTTCTTTGAACTCTTCT
ACTAACTTGATTTTTTCGAGTTCGATTTGTTCATTAGCTATTTCAACAGCTTTAATTTCA
ACAGCTTCATTAAACACAGATTCAATTTCTGATTTAACTGATTCTGTTAGAACATCTTTA
AAGCTATCGTTGCTTAAAACTTTGTCTAACATTTAGGTACCTTTCTTTGAATTTTTTAT
ATTTATTAAAATCGGTTTAATTTTGTTTTAAGCTTATTTTTTGTAGTGTTGGTAGTGTCA
GTAGTATTTAGTATTGGCAGAATCGAAGCAAATATCAATTTTAACACCAAGTGTAATTTA
TGATATTGCTTATATACATAAAATTAAAAATCATCACTAAAAACAGTTTTTTAGGACTT
TTATAGAATTTATATTTAATAAGATTTGCTTCTATATAATCTTTTAAGTATGCATCCTCT
GATATCAAAAAACCAAGTTCTTCTAAAGGGATATCATTTAAATCACAAAAATCTTGCATT
ATTTCCATAACACATTCATTTTTATGCTCTCTTAAAAACTTGTAGAATTTATTTAATGTT
TTAATTTCCTTTGCTATTAAATCTTGGCTAATATTCATTTTGAATCACCTTTAGTTAGAT
TTACATTAAAATGTTTATAATTACTTAGAACGTTTTTAAGTTCAGCGTAATCATCAAATG
ATATAAAACCTTCATTGTATCTAATATTAATATTTTTGTATTTGATTTCAGTGGTATCTA
AAATATTTTCAATCATTTTTAAATTAAAATTGGGTATTGTGTAATCTACATATAATTCAT
TAACAATATCTATAGTTGAAGCATTCCTAGATTCATTATGTATATCATATTCAGAATTAT
ACATACAAGCTAAGTTTCAAGTTCTTTATCTTTTTGTTTTTCTCATTGATAATAGCTA
AAATACTATTATGAATTATTTGTGAAATATAACTAAAACAAGATACTGATTGGTTTGTAA
TTTTAGATTTTAATGTATGATCGAAGTTATGAATATATTTAAATACACGATAGCAAGCAT
CACTATAAAAATCATCTTGCCAAGTATACCCGGAAAAATTAGGTTTAGTTAATATTTTTT
```

FIG. 17AT. Continuation of (CJLB-15-1 [organism=Campylobacter phage CJLB-15] partial genome contig_1)

```
TAATCATTAGAATAACAATGTTACCAAAATATTCGTGAGATTTTGGTGATATTTTTACAC
CCTCGGATATACTAATAATATAGTCTTTAAGATCTGGATCTTTTGTTTTAATATATTCTT
TTATCTTAATGTCTAAGTCTTCATTTATAGAACCATCAGGATCTTCAGAGCCTAGATTTA
ATTTGAAGTTTTTTTCACGAATAGCTAGCGATTTTAGTTCAAGTTCGTTAGTATAATCGT
GTTTCATACGAGTTTCACTCATTTTACCACCTTTAGATTTTAAACTTTAGTTTTAAATTT
AAATATTAAATATAAATTAAATATATTTTTAATTAGCTAATAGTTCAGCTTTTTTGAAAT
GCTCTAAAGCTTGGTCTGTATTACCATACAAATCTCTGAATTCTTTTAAATACATATCAA
GAGCTTCTTCACACCCAGGTCCAAAAATTCTGCCAGTTATTTCAACTGCTAAATCTTCAT
TATATCCAAATTTTTCCATAGTTCTGAGTTTAATGAATTGAAAAATATATGGAACTAATT
GCTGAGCTTTTTGTTTTTCTGGAGATAATGGTCTTCTTGTGTATACTTCTTTAGCTGCTT
TAGCGCGACGTTTTTTACGTTCTAATAGTAGGCTTGTAAATCTATTATCGAATTTACGTT
CGTGTTTGAATAATTGTGGTGCTTTTTTGCCATTTTCTACAAAATTATTAATGATGATTT
GTTCAAAATCATTGAAAGGTTTTTTGTTAACAATTTTAGTGTATAACTTGCGTAATTTTT
GTGTATTGAGACCTTTTTGGTTAGTTTCGTTTCAAGCTCTTCTATTTGTTTTTGAGTTT
TAAGTCTTGTATTTTGTGTGAATAAACTTGAATATCTAAGTCGTTTGTAATCCAGCTTGA
ATAAATTAAACTCTACTTTTAAACGCAGATATGTGTTAATAATATCTTGATGTTTGGTAT
ACAATTTGTGTTTGTAAGTCAGTTTCATTATTTTCCTTTCAATTGGTATATTATATAATA
TATAAGCTTAAAAAATTCTTAAATTTATTAGAATGGTTTAAATATTTGCAGTCTTCTGTG
TTGATCAAACAAAAAGCCAAGCATTTTTTATACTTTTTAATATTGCTTTAAGTTTTAAGC
ATATGCTAGGATATAATACTATAGTATATACTATGACATATCCAAGCATTTTTTATACTT
TTTAATATTGCTTTAAGTTTTAAGCATATGCTAGGATATAATACTATAGTATATACTATG
AAATATCCAAGCATTTTTTATACTTTTTAATATTGCTTTAAGTTTTAAGCATATGCAAGG ATA

>CJLB-15-5 [organism=Campylobacter phage CJLB-15] partial genome contig_5
TTTAGTATTATCCTTTCGAAACAAATGTGAGCCAGTTTTTACATAGCATTATACTTAA
CCTACTAATTAACCAACCAAAACATAAGCAAAGTAAGGTAAAATCTTTATTTGAAATTTT
TATTTTTATCAAAAGCGTTCTAAAAAAGCCAAATTTTGCTTTAAATTAACTAACACGCAT
TTTAACGCCTTAAAATATCATTAAAATACAAATAAAAAAAGGTGTTTAATGCAAAAAGAA
TTTTTAAACATTGATGAGGTTTTGCAAATTTTAAACATTAATTCTAAAATTTATTTGAGT
AGATATTTAAAGAAAATGGTATAAAAGTATTAAAAGGAAAAGCTAAACCCTATCCAAAA
GATGAAATTTTAAGACTTGCTAAAAAAAGACAAGATGAAAATCATTGCAATTCTAAACAA
AACGAAGTTATTTTGTATATTGATGAAAATTCGATAAAAGAAAAGCCAAAGGCAAATAAA
ACAGAACAAATACAAACGCAAGATGATTTTAAGCCTTTAAATTTAGAAACCATAGAGCAA
GAACTCACACAAAAACTATCAAAGATTTAGAAAATTTAGGCATTTATAATCCTTTAGAA
AATGATATTATTAAAACTTATGTTAAAAATCTCATTTTTTTAGAATGCACAAGCAAGGAA
ATGGAGAAAAAGGTTTTACAACAAGCACAGATAAAGGAACGCCTATTGTAACGCCTGAA
CTTATAGCTTTTAATTCTTTGACTAAAAATATTATAGGCTTAGCAAAAGTTTTAGGCATA
GGCTCTCCAAATCGTGCAAGGCTAAATTTAAAAGATAAAAAAGAAAAATCAGCTTTTGAT
GTGCTTTTAGAAGATGAAAGTTAAATTATGGATAAATTAAGAGCAAGAGAAGATATATTA
AATTACGCTTTAGCTTATATTAAACAAAAAAACAAAGAATTTGAAAACTCGCCCTTTTAT
ATTGATGAGAAAATAGCTAAAAAAGCGGTTTTATTTATTTCTCTTTTAAAGCACACCGAT
GGCGAATTAGCCGGTAAGCCCTTTCAGCTTTTCAAATTTTCAAATCGAGTTTATCATCGAT
ATCATCGCCACTTATTCTAAGGAAAAAAACGCCAGAAGATACTCTTACGCTTTGCTTTTT
ATCCCAAGAAAAAATGGTAAAACAGAGTTAATCGGAGCTATTTTGCTTTATTTTTTATTT
ATTGATAAAGAAAAGGGTAAAAAAATATATTGTGCCGCAAATGAAACCGAACAAGCAAAA
TTAGTTTTTAATGCTGCTTCATCTATGGTAAGCCAAGAAGAAGAATTAAATAAAATGTGC
TATCAATATAAAACCTATAGAGAAATCCGTAAGAAAAACGCTAAATTTGAAGATTTTATA
AAGGTTCTAACAGCTACAAGTGAGACAAAAGACGGCTTAAGACCTTATGTTTTTATTTAC
GATGAGCTTCACGCTGCCAAAAATGGGGATTTATATAAGGTTTTAGAAGAAGGAACGGCA
AGTCGTGTAAATTCTTTATGTATAGTCATTTCAACAGCAGGATATAATCATTTGGAGAG
ATGAAAAAGCAATATGATTATTGCAAACAAGTTAAAAATGGCATTATAAACGACCCATCA
ACTTATGCAAAGATTTATGAGCCTGATGCTGATGATGATTGGAACGATGAAAAAACTTGG
ATCAAAGTTAATCCTGCTTTGGGTTATGGCGTAAAGCTTGAAAAATTAAGAGAATATTAT
CAAAAAGCTTTAGCAAACGCAAATGATGAGGTGAGTTTAAAACAAACATTTAAATATA
TGGACTTCAAATGCTACTTCTTTTATAAAAGATGATGATTTTTAAAATGCAGTTTTAAA
GAACTTGATTTAAAAGGCGATGTTTATGTTGGACTTGATCTATCTGCTACCACTGATTTA
ACTGCTTTAGCTTTAATTTGCGAAGTGGATAAAATCTTACATGTGGATTTTAAATTTTAT
GCACCAGAACTTAGTGCAAGAGAGAGAAGTAAAAGAGATAAAGTGCCTTATTTAGAATGG
GCAAAACTTGGCTTTTTAACTCTCAACGCCAGGTAATAGTGTTGATTATGACTATTTAATT
AACGATATCTTAGCTCTAAATAAAAAATTAAATATCAAATGATAGGTTATGATCCATGG
AATAGTTTAGAAGTAGCCAAAAAGTTAAGCGATGAAAATATAGAGTGCGTTCAGATTAGA
CAAGGTTTTGCAAGTATTAGCGAACCTTTAAAAGAATACCAAATCAGAGTTTTAAAACAA
ACTTTAAATCACAATAACAATCCTATTTTTAGATGGTGTAATTCAAATTTAGTTATTGAT
CAAGATGCAAGAGAAAACATAAAGCCTGATAAGAAAAAATCAAGTGAAAGGATAGATGCA
ATTTCGGCTTTAGTCACTGCAATCGCCACTAAAAACAGCATAGAAAAACCAAAAATCAAT
```

FIG. 17AU. Continuation of (CJLB-15-1 [organism=Campylobacter phage CJLB-15] partial genome contig_1)

```
GTTTATGAAAAAAGAGGTATAAGGTTTTTATAGCTTAATAAATTTAGAAGTAAAAATGAG
TAAAATTATATTTTTCAAGGAGTTTTTTTGATAAATTGTAATGATAAATTTGATAAATGG
AATAATGAAAAGAAAAAACTACAAATAAAAGAAAATAAAATAATAAGCATAGGTAAGATT
TATTGGGTTAGCATAGGACAAAATATAGGCAGTGAAGTTTATGGAAAACATAATGACTTC
AAAAGACCGGTTTTAGTTTTAAACAAAATATACATTGAGGATTATGTTAATCTTTTTGTT
GGCGTTCCATTAACAAGCAAAATAGAAAATAAAACAGGTTTTCTTTATCATCACTTCACA
GATAGTAAAAACAGAAAGCAAGTAGCTCTATTATCACAAGTAAGAACCTTTGATACTAAA
AGAATAATAAGTTATTATAATGGAAAAATCAAAAAGAAGATTTAGAAACAATTAGAGAA
AAAATAACAAAGAAAATAATATCCCCGCACATGGCGGGGTAACTCGTAAATGAGCCAACT
CTCCTTATCAGAAGAAGTCTAAAACCTACTTTTAAAGTTTTACAATTCTTATGATCACTG
AGAAATTATATCATTTTTTTTATAAAACGCACTTTAACGCCTCAAACTTTTTTTAAAATA
AGTAAAAAATAAAGGTTTTGCATGTTCAATAAAATAAGATCATTATTTACAAAAAAAGCA
CGAAATAATGAATTGTTAATAGCTTAGAAATTTTATTAGAAGATAAAATAAAAGCTGAG
GAACTTTCAGCAGTAATTGCCGCAATCTCAAATATTAGCGAGACCATAGCATCTTTGCCA
TTAAATTTATATCAAAGAACAACTGATGGATCAAAACTAGCCTCTAATCACCCCTTATAT
GAACTCATCAAAATCGCACCAAATGAAACAATGACACCTTTTACACTCTTTGAGGCTTTT
ATGGTACAAATGTTAATTTATGGCAATGGTTTTTTATATCCTGTTAAAAAAAGAAACGGG
GTGATTAATTCTATAGAACTCATAGAAAATAAAGACATTAATATCTTTAAAATGAATGGA
AAGTATTTTTATCAAGCTTACTCAAAAAATGGCAGTATTGTTTTAAATTATGATGAGGTT
TTAAATGTGCCTTATCATACTAAAGATGGAGTAAAAGGTATCGCACCGCTTAGAAAAAGC
AAAAATACCACAGAACTTGCAACAGCTATAGAACAGCACGGACTTAGCTTTTTTAAAAAT
GGAAGTTTTACAAGTGGCGTTATATCTGTACCAAATGAATTAAGCGAAGAGGCATATTCG
AGATTAAAACAATCCTTTAAAGAAAATTATAGCCAAAAAAAGCTTATAATATTTCTATT
TTAGAGGGTGGAGCAAGTTATGCACAAACTACAAGTGCGAATAAAAATAGCCAGTTTTA
GAAAGCAAACAATTTCAAGTGATAGAAATCGCAAGACTTTTTAATATCCCACCGCACAAA
CTTGGAGATTTAAGTCGTGCGACTTTTTCAAATATCGAACAACAAGAGACAAATTATATG
GTGCAAACCATAACACCTCTAACAACTAAAATCGAACAAGCCCTAAATCGCTTTTTATTA
AACCAAAATGAAAGAAAAGAATTTTATTTTAAATTCAATATCAACGCTATTTTAAGAGCT
GATAGTTCTTCAAGGTGGGAAAGCTATGTAAAAGCTTTAAGTAATGGCGTGATGAGTATA
AACGAAGTAAGAGCCTTGGAAGAAATGAACCCAATTGATAATGGAAACGATCATTTAATA
CCGCTTAATCTCGCCAAAATAGATGAAAAAGACACACAAAAAGGCAATCAATGATAGAAG
TAAAAGGCTTGAACGAATTAATGAAAGATTTGCAAAGCATAAGTAAAAAAGCTTTGCCAA
ATGCGGCTAAAAAAGGAGCTTTAGAAGTAGCAAAAGAAATCACAAATGATTATAAAAGA
ATATTCCTAAACAAGTGGACTTTTAAAGCAAAGTGTTAAGGCAGTTTCTAGTTATACTT
TAGAAAAAGGTGTTTATCGTGCTGCTTCGGTTGTTTTAGAATGAAAAAAGTAGGTATAA
AAAGATTTGAAAAATTAAAAAATGCTAAAAAATGGACACAAGCAAAGAAAAATGAGAGAA
AACAAAGAATGGATTATTTTGCGAGTGCGTATTATGCTCATTTTATAGAGTATGGATTTT
TTCATAAAGGCGGAGTGAAAAAAGTGCAAAAGGAAAACCAAATATAAGCGGAAAAAACA
CTTTTGTAAAAGGCACTTATACCATGCAAAAAGCAAAAGAGAAAATAGACCCAAAAATGC
AAAGCTTGGTTACAACAAAACTAAATGCTGAGTTAGACAAATTAGGGATTTTAAATGAAGG
AATTTTTAAGCGATTTTTTAATGGGACTAAGCAAGGAATTAAATATAGAAATTTACCCAC
TTTCAAGGCAAAAAACAAAGCTAGAAAAAGCATTTTTAATTTATGAAATCACAAGCGAAG
AATTAAATTTAAGTATAGATGATAAAATCTTAAGCAAAGAATTAGAAATTAATTTGAGCC
TTTATACTCCAAAATACAAAGATTTAAGAGAGTTAAAAAGCAAAATTGAAAGTTTTATTT
TAAAATTTTATAAAAAACCTATTGAAATTTTAATACATGGAGAAGATAAAGATGAAGAGA
GTGGATTTTTTACGAGTGAGATTTTTATCACTTATCGTTTATAAATTTCTTTTCTATGTC
CTACTTCAAGACAAAGAATAGTTAATTTTTCATCAACAAAAAATTAGAAAATAAAATACA
AAAATATAGTTTTATGAAAAATATCTCTTAATACGCATTTTAACGCCTTAAACTTTTTAT
AAAATCTCCTTACATTACTTATATAAGGAGAAAAGATGTCAAAAGACAAAATAATTACAG
ATGCCCTGATGTGCAAGGGCTTAGAGTTTTAGTTTTATCTCGTGCTATGGAAAGTTTAG
GAAAAGAAGCTATTCAAGCAGGATTTTTAACAAGTATTTCAGGTCTTAAAGGTGGAACTA
GAGAAAGTCAAAAACTAAGCCCAATCAACGATAGAGATTATGAAGAAATCAACGCAGTGG
GCAAAAAACTTCAGCTACTGTAAATATGAATTTACTTTATAAATTTGTTAAAGATGGTA
ATTTAGAAAGCTATGAGGGGGTAAATTATTTAGAAAAAGCTTTTGAAGAAAATGAAGAAG
TTTTTATCATCGTAGAGATTAATGATGAGAGAAAAACCATGCTTAAAATCAAAATGAAAT
TAACAGGCTTTGAGCTTCAAAGCGAAGCAAATAATAAATTCAGTGCAAATATCACAGCAG
AAAAAATAGGCGAAGCTAAAGACATCACACCCTTTTAGATTTGAAGAAAGTCAAAATATAG
AACACAGTACAAAAGCTTTAAATGTGGGCGATGTGATGAGTGATAAAAAGGTAAAATTA
TTTATTTTTACCCAAAAGAAAGCACACTTGAAAAACCAGAATTAAACGATGAAGAATGG
TTTATGTTTTGATGAGGTGCGAGGTGTTGTACCAAATCCTAGTACACAAACTTTTAACG
AAAACAATGAATTTATAACCACAAAAGAAGCTGATAAAGTTTGGGAAAAAGAAAATGATG
AAAATATTATTCATGAAAGCAAAACCGAACCAGAACAAGGGCAGACTTATGAGGAATTAA
AAGGAAAAACATTATATTTTTATCCAAACGCCTTAACACTTCTTTATCCTGCAAATGAAG
ATATTCGCAAAAAATACACCATAGATCAAAGCTCAGGCATGCAAGGTGAAGCCACAATGC
AAACTTTTTTAAATGGAAAATTTAGCGATGCTTTAAGAAAAGGAGGTAAAAAATGAAATT
CAATGACTTTTTAAAACAACATTCTTTAAGAGAAAAAGAAATTTTAATCGAAGGTATTGA
```

FIG. 17AV. Continuation of (CJLB-15-1 [organism=Campylobacter phage CJLB-15] partial genome contig_1)

```
TGAAAAATTCACAATTCGCCAACTTTCTATGCTCGAACAATTAGAGATTATGGAAAAAAA
TGGCATAGAAATACAAGAAAATAAAGATGATAAAATCAGCATCGATTTTATTAAGAAGAA
TTCAAATTTTAGAAAAGAAATCATCTTAAAGTGTTTAGTAGCTCCAAAAATCGATGAAAA
AACCTTTGATAATCTCAATCAAGAGGGTTTAAACATTATCGCAAAAGTCGCAGACGAAAT
TTTAAAATTTACAAATGAAGTCCCAAAGCAAGAGAGCAAGGGCGATTAATTTATCGCCTT
GCCCTTGCATTAGGAAAAACCATAGGCGAGTTAGAACAAAGTATAACACAAAGTGAGTTT
AACGAGTGGATGTATTTCTTAAGCACCGAGCCTTTAGCAAGTGATAGAAACGAAATGCAA
ATGAGTATTTTACTTAATATGTTAGCTTCTTTTATGGGTGTAAAATCGACTAATGAAGAC
TTTTTATTATGCTCTCATTTAAAACATACTAAGCAAATACTAACGAAAATCAAAAAATC
GATATTAAAAAATTACAAGATGACTTTTTAAGTCTTTTAGGATAGATGATGATTTATTTC
TATATTGAATTCTTTTTCGTTTGGATAATTTTGCAAAATTTGCTTAAATTCTTTCGTATA
ATCATCGCCAAAAGCATTATTTTTGATAGCAAATTCCAAAGCAAAAGCACTCATAAGCAC
ACTTTTACCTTGCTTTGTTTTTATGAAATTTTCATGAGCTTCTTTAAAGGCGATAAGCTC
TTTTTCGCAACTTTTATAATCATTAAGAAATTTTTCATTTTTAAATATTTTTTGGCTTTT
GCTCCACATCAGAAAAAGACAAAACAAATAAAAACAAAAGCAAAAAAATTAAGCTCTAT
ATATGGAAAAAACATAATTTAAAAACTCCATTTTTTATCTTAAATTCTACTCAAAAAAAC
TAAAAGGAACATAAATGGCTAAAAATGTTAAAATCGGCGTTAGCGTAGATACAAATAGCG
GTGTAGCGAGTATTGGAGGTTTAAATAAAAGTTTTAATCAATTAGGAAATGCTACACAAA
CAACAAATAAATACATAAAAGATATAGAAAAAAGCTTTTTAGGACTTTCAAAAAGCGTAA
TTGACATGAACGCCCATTTAACACAAGCTTATCAGGCTTATAAAACTTTAGCACTTGATA
TAAAAAATTTTGGTAGCTCTTTTATAGAAGCAAGTAAAAGTTTTGAGACTGCAAAAACTC
AACTTGCTTTTATAACAGCCACCACGCATTCAAATATTGATACCACAGGAAAAGCCATAT
CACAACTTGAAAAATGGAAAGCCGCTACAAAAAGCAGTGAAAAAACCTTTAAAGATTTTA
ATGATTTGCATACTAAAACAGGCTATTCTTTGCAGGATTTATCAAGTATGTTTCAATCTT
TTGCCTCCACAGCTTTAAATAATATGAGCTTTGATGAAGCTAAAAAAGCTTTTGAAAGTA
TTATGATAGCAACCTCAAATACTTCCATGAGTGCTAATCAACTTTCAATTACTATGGATA
GTTAGGAGCTGGGGCATTTAGCGCAAGTGGAGATTTAAGAAGATTTGCTGAAAGTTTAG
GTATTACAAATGATGCTATGAGCGAAGCAAAGAAAAATGGTAAGCTTTTTGATTTATTTA
TAGAAAAAACCAAAGAGTTAACAAAATATACAGACTACACAACGCAAACCTATGAAAAGC
AAATGCAAAATTTGAAGCTAATATGCAAATGTTACAAGCTGAAATTTCAAAACCTATTT
TTGATACTCTTAAAAGCTCGCTTATAGATATAAACACTTATATTAAAGATAATGAAAAAG
AAATTAAAGCGGGCATTAAAGCTATTACCGAATTTGCTACTTCTTTTAAAGATTTGGCTA
TTGGTGCAGGACTTGCTTATGTAGCTTTTAAAAGTTTTAATTCTTTTAAGAATTCATCTT
TTTTTACAAGTCTTAGTAATGGTATTAAGAATGTTAAAAAAGATTATGATGATTTAATAA
TAAAACAAAAGAAATGAAAGAACTTGTTATAAATCAAAGGAATTTAAAATTTCAAGCAC
AAAGCTTTAAAGATGCTATCAAAGATTTAGAAAGATTGCAAAGCCTTATGCCACAAAAG
CAAAAGAGGTTAGCAATTTAGCTCCTTTTTATTCTACAAGCCAAAAAACAATGATAAGTG
CTGAAAAAATGCTACTCCAACAAGAAGCCCTTAAAAATATAAGAAATTTAGAAGAAGAA
TTAAGAAAAATGAAACTTTAATTAATGAAAGTATCTTAAAAAGAAATCCTTTGTTAAGCA
CCATAAAAGGCACTATGAGTAATTTAGCAAATTCTGCTTTAAATTTTACAAAGGCTTTAG
CTCCAACTGCTGGGCTTATAGCTTTGATGACTTTTATAGAAAAGCTTTATACGAATTGGG
ATAATTTTGACAAAGCTTTAGAAAAAACATCAAAAAGAAAGCTAGAAAACAAAAGTTCAA
AAGAATTAGATGAGTATGTTAAAAATCTTAAAAGTCAAATGGATGCCTTAGAAGCAAATG
GAAGTGTTTTGGGAGCTCAAATCACATCAAAATTAGATTTTTGGTATATAAAGAAGGTG
TAGAAAGTGTTTTAAAAGGCACTGATTATATGTTTGAAAGTGTTACCGGAAAACAGCTAA
AAATGAATAAAGAAGCTAGAAAAGCTTACGAACAAATACAGGCAAATTTAAAACTAGCCG
AAGAAGCCGCCAAAAAAGCAAAGGAGCAAGAATTTAAACTAGAAGCTATTGATAATCTCC
CTGCTAGTGTTAGCAAAGCCATGGAAAGTTTGAAAGCTTTAAGGATACCGCAAAGCACAG
AAGAACAAGCCGAAAATTTAAGAAAACAATATGAGCTTATCAGCGAAACCATACAACAAA
TCACGAATAATGCAAATTGGAATAAAGACTTAGCAAAATTAGAGCAATATAACGCTTTAG
TAGCTCAAAGACGCATTATGAAGAATATATAAATAAACAAGAAGGAGCAAAGATTAAAAA
AAGAAAAAGAAATCGCCAATCAAAAACTGGCAGAACGCATCAAAGAACAAAATGAAGCCT
TAAAAGAAATTTCACAAATAGGCATGAGTGAATACGATAAAAAATTAAGCCAAATTAATG
AAAAATTAAAAGTATGGAAAAAGTTAGGCATTGATAAAAACAAATTAAAACAAGCAGAAG
AAAGCCTTAAAATTAATCTTGATCTAGAAAGTGCAAATAAAGACTTTGAAGATACTAAAA
ATTTAATGATTGAATTTATGAAAGTATAGAAAATAAGCAGGAAGCTTGGGCATTAAAAG
AAATTGAGCTAAGAGACAAATACAGCAAATTATTAAGTGAAAATCTCATCAAAGAAGAAG
ATTTTAAAAAGATGATAAAAGCCAATAAAGACGCTTATTTTCAAATGGGCAAAGACAGTA
AAAAAGCCATGAGCGAAGTAGAAAAAAACTATAATCAAATGATAGCAAATATGCAAAAAA
CGATAGAAAGTAGCTTTTTTGATGTTATAAATGGGAAATAAAAACCTTAAAGATTTGT
TTAAAGATTTAGGAAAAACCATTTTACAAGATTTTTTAAGTCCTTATATTTCATCACTTA
GTGGCTTTTTATCTAAGGCAGGAGCTGGAGTATTGAGCGGTTTAATGCCTAATTTTGCTT
TTGGTAATGTGAATTCACACTCGCAAACAAATGCTTTTAGCTCAGTTGTTGAATTTGCTA
AAAATCAAGGTTTAAATTTAAATAGTGATGGCAAATATCAAGGTGTGGTTAATGGTGTTG
AGGTAGTCATGGATAAAACAGGCACCATAGAAAAGGAAATAATGCTTTTAATAATGTGA
GTAATATTATAGAGGGTGCAAGTAAATTAGATGGCATTATGAGTGGCGAATGGATAGATA
```

FIG. 17AW. Continuation of (CJLB-15-1 [organism=Campylobacter phage CJLB-15] partial genome contig_1)

```
AAGCGGGCGCCACTTATGATAAAGTTATGAATTGGTTTGGCAGTAGTCAAAATGCAGGAA
GTGAAATAAGTTTTAGTGATGCTTTAAATGCGGATGGTTTTAGTGATTTTTTAAGTTCAA
GTTCTGATATTAGCACTACTATTGAAAATTCAAGCACAAATATTATAGATAGTATAGGCA
ATGGCTTTAATTCTTTATTTGATAATTTACAAGGTTATATCAATTCAATAGGCACTTTTG
GCAGTAATCTTTTAGCTAATGGTTCAGCTTATTTGGCAAATTTTTTAGGACTTGGTGCAA
GCTTTACAAACGGTGCTTCTTTGGCGGGTATGGGATTAAGTGGTGCAAGTAATGCTTTAT
CTCTTGGTTTTGGTGGGGGCTTGGGCTATATAGGTGGCACTTTAGCTAATGCAGCAATGG
GCGGACTTCTAGGTTATGGCATAGGAAGCTTAGGTGATTGGCTTTTAAGGCTGATACTC
ACGCAGGAACAGGTGGTGCGATAGGTGGTGCATTAGGTAGTATTATAATGCCTGGCATTG
GAACTATAGTAGGTGGGCTTTTAGGATCAGTCATTGGCGGTATTTTTGGAAAAACCAAAG
TAACAGGAAGCGGCTTACAACTTTGGGAAAATATAAATTTTAGTGATTTTTTTACAAATT
CTAATTTGCAAGGTTATGTAGACTATCAAAAGAAAGGATGGTTTAGTAAAAAAAGCTGGA
CAGAGTATAATAATTTAAGTGATAAAAAAATCAAAGAAATCAATCGTGTTTTAGAAAACC
AATACGCAACACTTGTAAAATTAAATGCCAATTTAGATAAGTTTGAATTAGTAGCTGGAA
AATACGCTAATAATTCTTTATTTGATACGGCTTTGCCTACTGCACTTTTAAAAAGCTTTT
TAAATATCGATGATAAAAGCGAAATCGATGCACAAATTGTAGCAATACAAGAAAAGGCAA
AAGCAAATAATATAAGCTATGCCCAGCAACTTTCTAATCAATTTGGTACTTTTATGCAAA
TGCAAACTAGCATTTTAAATCAAATTTATAAAAATGATCCAACAAAACAAGCAAAAATAG
CTTATGATGATACCATGTATGCTTTAAAAACTGCGATGAGAAATTCCACAGGTGGATTTA
GTCTTTTTGGATTAAGTGAAGAAAGCTTTAAAGATTAGGACAACTTAGTGCCGAAGCAC
TTAATAAAGCTTTCAATGAGAGCTTAAGGCAAGATTTTAGCCCTGAGAATTTAGAAATTT
GGCAACAATTAACACAAGCTTATACGCAAGCACAAGAACAAGTTAAAAATCTTTTAAATT
CTATCATACAAAAAACACAAGAACTTATGCAAATCAATCAAAGCTTTTTAAGTGCTAATG
GTATTTCAAGTAGTATTTTTGAAGTTAATCATCTAATGAATTCTTACGCAACCTTAATGA
GCGGTTTAAAAGATGATTTAAATGATAGCGAAAAAGAAATGCTAAAGGATATTTTTAGTG
CTAATGATAAGCTTTTAAGTTTAGGTTATGAGGGTTTAAATGAATTTTTAAGCACGGGTA
ATACTGAACTTAGAAAACAGCTTGTAGATATCATTACACAATTTAAACAAATAAGCGACA
AACAAGGCGGTTTAATCTTTTCAAGCGAACATTTAAACAAACTCGCTGAGGTAGAAAAGC
TTATTAATGCGTATGAGAACAAAGATGAAAGCAAAGAAGCAGATCAAGTAAGGTTAAATG
AAAATAATAAACTTTTAAGTAAATTAAATAGCGAACTTGGTATTTAAGTTCTTTGGGTT
CTTTTAGCACTAATTTAATCAATCAAAGCATAGCTACAAGCGGAGAGCGTGGCGCTAAACT
ACGATAAAATTTTAAAACAAGCTAAAAATGATTTTAAAAATGGCAATCTTACAAGTTCAA
GCTTTAGTGCCTTGCAAAACGCTGCAACGCAAAAAGCAAACGAGATCAAAAATCAAGCTT
CAAGCTTTGCAGAGTATCAACTACAAATGCTTAAAATGGCAAATGAAATGAAAGATTTAG
GTGGTGAGGCAGATTTAAATTCAATACAAGATAAAATAGAAGCCATTACAGAAGAAAATA
AAAAATTACAAGAAAAGTTAGATCAAACTTTAAAAGACACTTCTAATATGACTTTAGAAG
AGTTAAAAGAGTATAAAAAAAACTCTTATTGCACAAAGTGAACAGCAGAAATTGCAAAAATGA
TCGAGTATTTAGGCGAAGAAAAGCCCTATGGCTAAATATTTACAAGAAACGATTAAATCTA
TAAAAGATGGCGCCTCTCTTACAGAAACAACGCTTAAAAATTTAGAATATGCACTTTTGC
AATATCAAAATAATCAGGTAAATATAGATAAAGATTTAAATAATGAGATTAAAAATCCTT
ACAAAAAAATGAAAGCTTTTGCAGATGGCGGGATAGTTACACGCCCTACAAATGCTTTAA
TTGGAGAGAATGGTTATCCTGAGGCTGTAATTCCTTTAAAAAATGGCAAAGGTTTAAAAA
TCGATGCAAGTGGAGTTTTTGAAAAAATAGGCATCGCTTTTGAAAAAGCTATTAATAAAG
GTTTTAATTCTTTTGAAGAAAAACTAGACTTAATCGCTTCAAAAATTTGACAATGTAGATA
AAAGTGTAAAAAGAGCAAATATGGATTTAAGTATTTTAACTAAACAAACTAGAGAAATTG
CAGAAAATATTTAATAAGGAAAGAAGATGACTATAATTAAACCTTTAGAATTTGAAGTTT
TACAAAATTTAGCTAAAAAAGATGAAACGCCTTTATGGGATAAGGAAGTAAGTTATAAAA
ATAATGAAAAGTGCAATTTAAAGGTTTTGTTTGGGTAAGTGCAAGTGATGAAGATACGC
ATGAAGAACCTGATGTGTATTTTGATAAATGGGTTAAATTTGCACCCATCAATGAAAATG
CTTTTTTTGATGATGAATTAAATACTCAAACAAAATGCGATAAAGCTTGGAGTGTAAAAT
TGAAAGTAGATGGGGTATTTGATACTTTAGCCATTTTTAAATTTAGATGTTTCAAAAATAA
AGATAGAAACATTAGATGGCAAAATCATTTATGAAAATCAATGTATTATAAAAATCTC
GCACTTGGTGGGAATATTTTTTTAGCAAATTTAAAGTCAATAAAGAAGATTTTGTGTTTT
TACCTTATCCTATTAACTCAGAAATTTTAATAAGTTTTGAGCCTGCTAAAATAGGGTGTA
ATGTAGGACATATTTTAATAGGAAAAAAAGAATTTGCAGGTGTTACAATCTATCCTGCAA
ATAGCACTTATATAAATTACTCAAAAACTTCAACAAATGAATGGGGAGTAACAAATGTAG
TAACTGGTAAGAAAGCAAAATACTTAGAATTTATAGTTGCTGTAGAAAAAAAAGACTTTG
ATTATTATGATGATTTAATAGCAGGACTTTATAATACTAAAGCCTTATTTATAGGAGATG
AAAGCGAATTGGGCTTTAAAAAATTAACTACTTTTGGAATTTTAAAAGATTATTCTGCAC
CTTTAGAGGATCAAGATTATATGCAATATAAACTAAATATTCAAGGTTTGATTTAAAAAA
TAAAAAATATCTTCTAACACGCACTTTAACGCCTTAAAAATTTCTAAAATCCTTATAAA
ACTTCAAAAAGGATTTTAAAATGAGTTTTAAAAACATAAGAGCAGATACCGCAAGACTT
AGAAGCGTTAGCGAAGAAAATATGTCTTTAAGCTTTGTCATCGGTTTCAAATTCTAATGCT
TGTTTGCGTTTTGATTGGGAGCTTGGGGACTATATAGAAGAAGCTTGATGTAAAAGGTGCG
AGATTTGAAAATCTTAAAACTCTTTTTAAAGATCATAAACCAAGCGTAGATAATGCTATC
GCAAGAATTGAAAATATAAGAATTGAAAATAATGAGTTAGTTTGTGATTGTATCTTTGCC
```

FIG. 17AX. Continuation of (CJLB-15-1 [organism=Campylobacter phage CJLB-15] partial genome contig_1)

```
AAAGACGAAAAAAGCTTAGATATCTTTAAAAAATATCAAGATGGAATTTTAAGCGATGTG
TCAATTGGTTATAGAGTTTTAAAGCAAGTTGTAGATAAAAAAGTTCGCCTAAAAGGGTT
CTAGTTACAGAGTTTGAAATTTTTGAACTCAGCGCTGTTTGGAAAGGTGCGGATAAAAAC
GCTAAAAAACGCTTTGAAGAAGATGAAGAAAAAAGAAAATCAAAGCCTTAAGTGAAGCT
AGAGAGCGAGAACTTAAACTTTTAGAAATATCAATTTAAACAAGGAGAAAAAACAATGCA
AAAATTAAGACAAGAAATAGGAAATTTACACGAACAAATGGTGGCTTTATCAAATAAGGC
TAAAAACGAGCAAAGAAGCTTTAGTGCTGAAGAAAACACAAAATACGAAGCTTTAATGCA
AGATTTTGAAAGTAAAGAAAAGAACTCTCAAGAGCTGAAGCAGAGCTAGAAGAGAAAA
ATATTTAAATGAGGTTGTAAGCCCTGTTTTAGGACAAAATCCTAAAGGAGAGGATGAAGA
TTTAAATGAAGAAATCATATGCGTTCTTTGTGAATTATTTAAGAAATGGAAGTATTGA
CAATATTTTAAAAAGAAATGTTTTAAATGAAAGCACAGCAGAGCAAGGTGGGATTTTAGT
CCCTACAACTTTGCAAAGTAAAATAAGAGAAAAATTAAATGATCTTAGTGTTATTAGAAA
GATTGCTACAGTGCAAAAAAGCTCTAGCAATCAAATTATACCTGTTTTTGATGAGATGGG
GGAATTTCTTGGCTTGGCGAACAGGAAAGCTTTACTGAAGTTAGTGCTAAATTTAGTTC
TTTAAGTATAGGCGCACATAAGCTTGGCGGTATTATTAAAATCAGCGAAGAACTCTTGAG
TGACAACATTGCAAATCTTGAAAGTTTTATAGTGCGAAAAGCCGCTGAAAAGATTTCAAA
AACAGAAGAATTAAGTTTTATTAATGGAGATGGAAATAAAAAACCAACAGGACTTAAAAA
TGCTAAAAAAGCGTTTACACTTGCTTCAAATCAAGGTATTACAAGCAATGATATCATAGA
TGCTTTTTTCAGTTTAGACAGTGCTTATCGTAAAAATGCCACTTGGCTTGTAGGAGATGA
GTTTATGAAAGCTATTTATAAACTTACAGATAATGATAATCGCCCATTGTGGCTACCTGC
TTTAAGTGCTAATGGCTATGACACAATTTTAGGTAAAAAGGTAGTTTATTGTTCTGGTGT
TGATGGTTTTGGTGCAAGCAAAGTCCCTGCATTTTTTGGAGATTTTAGTTTTTATGAAAT
TTGGGATAGATCAAGTATGAGTTTTACAAGACTTAATGAGCTTTACTCTCAAAATGATTT
AATAGGTATTAAAGTGCGTTTAAGACTTGATGCAAAGCTTATGGATAATTCGGCAGTTTG
TAAAATTGTATGCCCTGCTTAAAGGATGGAAGATGAAAAAAGTAGTTTTCAAGTGTTGTT
TAAGCGGTAATATTTTTTATAAAAAAGGTGATGAGGTTTTACTTGAAGATAGTGAAGCCT
TAAGGCTCTTAGAAAAAGGCATTGTGGAAATCGTGGAACAAGAAGAACAAAAACAAAATA
CTGATGAAAAATCAAATACAGATAAAAAGCCACAAGAAGATCAAGAAATGCAAGAAAAAC
CACAAAAACAAAACGAAAAGAAGATAAAAAAGGTAAAAAATGAGATTAAAGGCATTAAA
AGATAGCAAAAAAGAACTCATAGACATTCAAGAATTAAGAGACTTTTTAAGAATTGATAG
CGATGTTTTTGATGCAAATTTAAAACAATTTTTAAAAGCTGGAATGAATGAATTTGAAAC
AAGAACCAATCGCATTTTAGCTTTAAATGATTATGAAGTTGAATTTTTTAATGAAAGGGT
GATTTTAGCTCCTTTTAATGCTTTAAAAAATGCAAATTTTAAAGCCGAGTTTAAAACAAA
TGGTGGTGTGCTTTATGCAATAGGTTGTGGGAATATGATTGTAAATTTAGGTTTTGAAGA
ATTGCCACAAGACATAAAATTGTGGCTTAAAAATTATGTTTTAATGGCTTTTGATGGTGT
GAGTATGCCTAAAATTTCAAGTGCTTTAATCACTCGCTACAAAATAGCTTATTTTTAAAA
GGCAATGGCAATGAAAGCAAATGGATTTAAGCATAGAGTTAAAATTTACAAAAAAGAACA
AAGCAAAAATGAGTTTTTAGAAAGCGATTTTACCGCAAGATTTACTTTTTAAAGAAGTTTA
TGCAAGTTGTAAAAATCTAAGTGCGGATGTTAAAGAGTTAAATAGTGGCTTATCTTTAGT
CGCTACGCATGAATTTGAGCTTAGATTTTTAGAGCTTGATTTTTCTTATTTTCTAGTTTT
TAGAGATGAAAAATATGAGATTGTAAGCTTGAAGATGAAAGCCAAAACAAGAAATTTTT
AAAAATAAAAGCAAGGAAATTTCAATGAATAAAATATCTTTCATTAATACTTTACCTAAA
GCACCTGATATGGCTAATCCTGTTGATTTTGACAAGGATGCTAATAACTTTGTTAATGCG
CTTGTTCCTTTTTCAAAAGAACTTAATGATTTTATTAAAGATATAAATATATTAAGTGCT
TCCTTGATAGAGCTAAACTCTAATATGATCTCTTATACTAATTTGGCTTTAGAGCAAATT
GACAGTAAAACAAATATAAATATCTTAAAAATAGAAAATTTTTGCAAAGATTTTCAAAAT
GTTTTAGAGCAAAAGCTAAAGAAAGATTAAAAGAATTTACCGATGAATGCCTAACCATA
GTTGAAAACAAAGGCTATGAGATGATAGAAAGATTAAATGACAATGGCGTTGGAGCTGAT
TATATCGCTATTTCTCAATCTCTAACTCATAGCTTAAGCTTAGAACGCTTTATTATGGAA
AGAGGTTTTATTAAACTAAGAAAAGAAGAAGCCCTAAATTTAGATGATGTGAATTTGAGT
TTAGAAGAACAAAGAAGAGATAAAACCTTGCCCAAAAGCTTTAGAAAATATCACAAAC
ATACTCTCTTCACAAAACGAAATTAATTTAACTTTAAAAGGAGAAAACAATGCTTGATAA
CTCAAAAATAAGAAGCACAGAGCTTTATGCTACGCTAAGTCAAGCTACTAAGGATGTTAC
AGCCATAAGAGAGTGGCTTTATGCTTCAAAAGATAGGATTGATGAGCACATTTTAGAAAA
TTTAAATGCTTTTGATGAAAAAGTAAAAGAAGCTTTACAAAACTATGAAAACTTAAGCGA
TGAAAAACTTAATATGCTAAAAGAACTTTATAAAAAAGTGGTTTATCCTTTTGATTATGT
AAGTGATGAAGAACCTACAATGCCCAATGTGAATGAAACTTGGTTTAAAACTGATGAGGC
TAAAATCTTTAAATTTATTAAAAAATCCACAAATCACTTTCTTACAAAAAGAAAGACCTAA
AGAAAGAAAATTAATGATATTTGGTTTAAGCCTATGGATGATGTTAATTTACAAGTAGG
CGAATTTATCTTTGTGAAAAAGTGTTGAAGAATGAAGCTTGGATAAACCCATCCTTGCC
TGAGAATTTAGAACCTGCATTTAATCAAGAAGAAGCTCCACAAAATGCAACGCTTGGCGA
TATTTGGAAAAAGGGGATGAATATCTTGTTTATATTAAAACCACAAGTGGCAATTCTTG
GACTAGCCCTGAAAACCCAAGCGAATATACACCTACTTATGAAAGCGAAGAAGAACCAAG
TGAGGCAAAACTTGGCGAAATTTGGAAAAAAGCAAATGAGTATTTAATCTATGCAAGAGT
GACTAACGATACAGCTTGGATTTAAAGTCTGATCTAGGGCTTGATGCTTTTATTTGGTT
TAATGAAGAAAAAGAAAATATAAACTTTATACTTTCACTTATAGGGGATTTGAAAAAAGA
```

FIG. 17AY. Continuation of (CJLB-15-1 [organism=Campylobacter phage CJLB-15] partial genome contig_1)

```
AGATGAAAAGAAGAAACAAGCAAAAATGAAATAAAGGATCTGGAACAAAATTTAAGCAA
TAAACAGGAAGAATTAGAAAATATTAAAAAGCAAATCGAAGAAGCATTAGCAAAAGACCC
ACCACAAAATGTAGATAACCTCAATGAGAAAAGACGCAATTAGAGCAAGAAATCACAAA
GATGCAAGAAGATTTAAATCATAAACAAAATGAATTAGAACAAATACAAAAAGATAAAAG
TTTGGTTAGTCAAAAAATGCTTAGTGATGCCCTTAAAGAAAAAGTAGGATTAAAAGGTGA
TGAGACTTTAAATGGAAATAAGACTTTAAATGGAGATAATATATTTAATGGCACAAATAC
TTTTAATCAGGCATTAACTTCTCGGGCCGATCCAACAAATGATAATCACTTAACTAGAAA
ATGGTATGTAGATTATGCTGGTGGAATTAAAAATCTTGGCACAACTGGCAGTATAAATCT
AGATTTAAGACAAGCTCAACATTTTATTTTAACAGCAAATGCAGGAACAAGCATAGGAAT
AGCTAATTTTGGAGGAGTAGGAAAAAGCGGAACAATAACCATAAATAATTGTCAAAATGT
AGTAGCTTTTAATGCCCCTTTTAAATTTAGAATAGCTCAAAGTGGATTTAGTGGCACTGA
AACTTTTGCTTATTTTTGCATAGCTTCGAATAATGTAAGATTAGTAAGGACTTAAAATGA
ACTGCCTCCTTCTTTCTAATAATGGCATAGCACTAAATTTACCTCCATCTTTAGGAGGCT
CGGTTGCAAATTATAATTATATGTTAAAGCTAGACATGATTTATAAACAAGCAGTGGTAT
TGCCATCAAATATTAATAATAAAGAAGTGGTTATGTTAGGCGAAGTTTGGACGACTGGAA
ATATGTCTAATAAAACTTCTGCAAATACTTTGCATATCACATGGAACAATTTTAACTCTA
GTGTAGAATTGCATGCTTTAAGTAAATATTACACTGCCAATGCAAAAATCAAAGTAGAGA
AAAAATTCAATTTTGGAAATATAAACAACTTGCAAATAATGCTAAGTTCTTGGCAAGCG
GTAGTGCAAATGCAAGTGCTGGTTGGAACTTAAATGATGGGGATAGATTAAACCCAAGAG
CAAATTTAACATTATACTGGAATTAAGAAAGCGTAAATATGTTTTATGATTTAAAAAATA
AAAGTTTAAAATATGATGATATTTTTTAAAAGATGTAAAAATACAAAACGAAGAAGGTG
AAATTGATGCACAAGATACTTATTTTTTAAGTGCTTGCGATGATAAGCTTTTAAAAGAGC
TTGGTTTTGCTAAAGTTAAAGAAGAAGAAATTCCAAGTTTTAATGAAAAAATTGAAGAAC
TTCGCCAAATTCAAACTTATGATGAAGAAAATAATCTTTATATTATTTCTTATGAGATTA
AAGAAAAAGCATTAGAAGAGTTAAAAGAATTAAAATTAGAAGAACTAAAAGCTATAAAAG
AAGAAAAGCTTTTGTTTATGCCTTTTAAAAATACTATATTTCAAATTGACACGGAAGCAA
AAATTAATATTAGCGGAAAAGTTAGCGAGATAATGTTAGCAAATCTCAATAATACTCCTT
TGGAAAATATTGCTTGGATTGATAAGATAATAAAATCATTACATTTAACAAAGAAGAAT
TTTTAGAATTTGGGGTTGGTATCGCTAAATATACTGAAAGTATTATTTTTAAAAATGATG
AACTAAGAAATAAAGTGAAAAATGCCACATCTTTAGAAGAATTAAATTTAATTGCATGGG
AGAGTGAAAAATGAGTACTGAAAATATAATAAAAGAAGGTGCTATACTCGGTTCTTTAAG
TGGATCTGCATTATTAGGATTGATGGTTTTTGTCTTAGCTGGGATTGCATGGCATTTATA
TAAAACTTTACATAAGAAGCTGGGGAAAGAACAAAAGAACTTATAAGTGAAACCAAAAA
TACTAATGTTCTTATTAGAGAACAAATTGCAGTATCCAGAGCAAGTAGCGATAGTTTGGT
TAAATTTATAGAAACACATTGCTCAAAAACCAATGACAAGCTAGAAGCTATAGAAACAGA
TCTTATGAGAATGGATGAAAGGCTTGTTAAGCTTACTCAAATAAGAAATGATGAATTAAG
AAGTATTTTTAAAAAAAAGGAAAACAATGACTAAAACAGAATTAAAAAGGGTTTGTGTAA
AGCCATACGATAAGGACAGGTTTGAAGTGATCAAGATTATGAGTTTATTTTGCCAAATT
ACAAAGGCATTGTACCACAAGGTTTTAAAACTGATGGAGCGAGTATTCCACGCCTTTTTT
GGTCTTTGTTTCCACCTTTTAAAAGTGAGTATTTTAGTGCTTGTGTAGTGCATGATTTTT
TATGTGAAAAAGCAAATCAAGAAAAGATTACAAACTTGCTGATCTTGTTTTAAAAGAAG
CAATGCAAGCTTTAGAAATAAATAAATTTAAGATTTTTGTTTTTATTGCTCTTGTAATT
TATTTCATCAGATCAAATGTTTAATAAAGGGGATAAGATGAGCGTGGATTTAAGAGAAAT
TGCCATAAAAACAGAAGAAATCAATAAAGATTTTAGTGAAGCTTTAGAAATTTTAAAAGA
ACTTTTTAAAAATGGAGTAAAACCAAGCGATGAAAGTATTAAAAATGCTATAAATGAAGT
TTTAACAAGTTTTAACTTTATAAAACAAAGTGAATTAAAAGAAAAACTAGAAGCCTTGCT
AGAAGAGCTTGGCATCAATGCAAATATCAATGAAGAGAGTTTAAAAGAAGTTGTATTAAA
AGTTGTTTTAGAAAATCAAGAAAGTTTAAAAGGTGATAAAGGAGATCCTTTTACTTATGA
AGATTTTACAGAAGAACAGCTTAAAAATTTAAAAGGGCAAGATGGAGCTAAAGGAGCTGA
TGGTAAAAGTGCTTATGAACTTTGGCTTGAAAATGAAGAAAACACGGGAAAAAGTCAAGA
TGAATTTTTAGAAAGTTTAAAGGCTCAAACACCAACAAAAGAAGAAGAAATTAAACCTATTAT
AGAAGAGATGCTCGAAGATATGAAATTAAATTTAGGCATTAATGGAATAAAAGTATCTAA
TTCTATTCCCACTCCAAAAACAAAAGCTAATGTTAATGATTTAATTATAACTTATAATGA
AAATGTAAAACAACTTTGGCTTTGTGTGGCAAGTGATGATAAATACACAAGTTGGATTAA
TTTGCTTGGAAATGAAAATATTACAGCACAAGAGTTGATTATTATTAGTTTTGATACAAA
TTTAAATAGTGGTCAATATGGCGGATGTTTAAGTGATTTGCGTTTTGGTTTTGAAAATTC
TTTAGCAAGCACTACGCAAATTATAAAAGGACTTAATGAAGGCAGTTTTTTAATCACTAA
AGATGGAATGGGTTTAAAATCTAAAAATTATACTGAAGTTAGCGTTCTTTCAAAACCAAG
TAAAAATCAAATAGAAGGAAATATCAAAACGAGCGGAATTTATAATGATCCTGCTTGGCA
TAATATTACCAATGCTTTAAAAAAATATGATGGCAATGCAAATGAATGCTGTCTTTGGGC
TTCTAATATAAAAATAGTGTAAGTATAGAGCTTTTTACAAATGAAATTCCTATGAGTCT
TTTTTATAGGCAAGCTGGATATTATGGAAATGTCAATCTTTCAAATATAAAAATGCAAAA
AGCCCTTAGAGTTCAAAATGAAATTATAGTCGAGAGAAGCTTTATAGGAATAAAAAAGA
AATTGATAAAACTACCTATGGTGATAATGCTTTTTTATTTGAATTTGAAGAAGAAAAATG
AGTTTAAATCTAAAAATAAAATACAAAAAATAAAAGAAAGGAATTATAATGAAATAAC
AATTAATAGAAGATACACAGGAAAAACTTGCGTTATTGGTAAATTTAAGGTTTTAGATGA
```

FIG. 17AZ. Continuation of (CJLB-15-1 [organism=Campylobacter phage CJLB-15] partial genome contig_1)

```
TGATGATAAAATTCTTTTTGAATGTTTTTCTTTGGAAGAAGACAAAGAAGGTTTAGAAAG
TGGCAAAGATTTAAGAATACCTGAAGGAAATTATAATTTAAAAAGACATAGTCCTTCACG
ATTTGAAAATACTTTAAGAAGTATTACAAAAAAAGATGATGATACAATGATAAATGTTTA
TAATGATGATGTGCCATCAAGTCGTGCAATTTTAATACACTGGGGAAACACTGATAAAGA
CACACAAGGTTGTATCTTGCTTGGGCTTACCAAGGATAATAATAATGAAAGTGTCGGTCA
AAGCAGGCAGGCTTGCAAAGAATTTTACGACTTAATGCATGGTAAAAATCTTGAAGACAT
TAAATTAGAAATAACAAATGAATTAGCATGAAAGGAGATAAAAGTTTAAGTAGGTTAAAG
TTTACACCCCGCTTTTGCGGGGCAAGGCTAATAAGCCTTGACTATAATTACACAAAGTAG
TATAATTATAATTATAAACTTCTGGTATGACATTTATATCACCACCTTTCGCGGGTGGAA
TTTAGCCATAGGGGTCAGACCTACGGCTAACCCTTAGGGGTATTATATAAAAACCTTAC
TTAAACTTCTAAAACAAATATGATAAATCTTTTATTTGGAAATGCAAAGCTTTATATAGC
CTTAGCTTTAATGGCAATCTTAACAGGGTATTTTTATCTAAGACTTGATAGCACTCAAGC
AAAATTAGAAAAAGTCAAAGTGATTTAGCTTTGGCTTTAAAAATAAATGAAAATAATCA
AGAAAAATTAAAAGAATTAAATCAAATTCATAAACAGAATTAAAGGCTTTAAATGAAGC
AAACAATCAAAAAATCAAGTACAAGAAAGGGTGCAATATGTTAAAGAATACATTTATAA
AAGCAATGAAAATAATATTACCAAGCTTTTTAACGATGTCGTTGATAGGTTGTGGGATGC
AAACTCAACAAGTAGTAACCAAAATAGAAATTCAAAAAGTAAAAATTCCGCAAGAACTAC
TAACATTAAGTCCTCTTGAAAAGCCAATAGCAAAAAATGAACTAGATATTTTAAATGCTT
ATTCTATGCTTTTTTACAAATACAAACAGTGTGAGATACAGATTAGAAAGATTAAGGAGT
TAAATGAGGAATGATCCTCATTTACATCTATTCTAGAACTTCTGCTTTGTATTTTTCATA
CTCGGCTTCACTGATACACCTTTTTTCTTTCAATCCTCTTAAAAATTCTAAATCTCTCAT
TTTAGATATTTTTTGTTCTCGTCTATAAGGTTTTTTAACCGCTAAATACAAAATACATCC
AAAAATGCCAAAGAAAAACCCAACTATACCCCACCATAAGCTGCTCATATTTCTTTGTTT
AGCATCATAAGAAAGTTCAAAAGCACATACAACAGCAAAGATAAAATACACAAGTCCTGC
AATTTCCATTTTTACTCCTTTTTAATTAAAAATTGTCACATTTTACTTTATATATTCTTA
AATTCTCATTTTCTACATCGTGATTAGGCACTTGGTAACATTCTTTAAAATTATCACCTT
TTAAAATCTTAGTGTAAGAGCTTGGAATAGCAATATTGTTTTTATTCTTTGTGGATTAT
TGTCATAATTAACCAAATTTAAAACTTCTAAACTTCCAAGCTTTAAAGCTACTTGTCTTT
CTCTTTTTTCAATTTTATTCCAAACTCTTTGATTGATTTGTGGATTTTGTGGAGTAATGT
TGCTCATTAAAAAAGTGCTTCTTTGAGCTTGAGTTGTTTTTCTCATTGAAGCATTAGAAA
GAGTGTGTCCCCTGTCGTAACCGCTGTTTTTATAATCACTCCATGTGGTGCGGTATTTT
TAGGAATATTTGTATCATCTTCAAAGCGTGGGCGTTTTTGATTTGTTCGCCCTTTTAAAT
TATCCGCTTCTAATCTATAAGCTACGGCTTTAGTGCCTTTTAAAGAATAATCATAACAAT
TAATATAATAAATTTATCCAAAACTTGTGAGCAGTTTTGTTTAGTAAAATACTTGGCAA
AATCTTCGCTTGGTTTGTATTGTGTATAATCAGCAAAAGCTAGAGTGGATAATAAAGATA
AGATTATAAGTTTTTTCATTTGTTTCATACCCTTTCAATTTGATTTAAAAATATCTTTGC
ATTACAAGAGCAAACCACTACACCTATAAATACATAATTTTTTAAAGCACTTTTTTTTAT
TTTTTTATCTCCAAAATTAAAATTATCACTGCTAATAACTATATCATCATCGAAAGCATT
TTTTAAAATACGTTTGCAAAAAAGCTCGTTATCATTATCGCGAAAAATTACTACATCAGC
ATTTCTTATCTTTTCTAGTGAATTTTTAGTAGTATCTATGATGATAAAAGAGCCATTTTG
TATAAAAGGTTCCATGCTTTCACCATAAATTTTAATCATATCATATTGTGTTTTATAAGG
CACTCCTAAAACATCAGTTAGAAAAGCTTTATCTATGTTTATAAGCTGAAAATTTTCATT
TTCATTTGCATTGCCAAAACCTGCACTTGCACAAATGTCTGGAAAATAACGAATGGTTAT
AGTATCTTTGTGGTGATGAATAGAGACTGAATTATTAGCCTTTTTTAACTCATAGTATTT
TTTCAATGCTTGAGCTGAAAGTTGTTTATTGTTCCGCCAATTATTTGCATTATTTTTTTT
ATATCCTAATCTCTCTGCTACTTCTTCTAAACTTTTTACATTAAAAAAGTTTTTAATTC
TTCTACTAATTCATAATAATTTTCCATAAATATAACCTTGAAAATATATTGACATATATT
TAAAATTAATATATAATTCTATACATAATTAATTTTTAAAAACAAAATAATTATTTAACT
AAGCAATAAGTATGCCAAGTTTTAAATTAAAATTGTATTATGTTATTTTAAGGATTTGAA
AATGGAGTATTGGCTCATATTTGTATTTTTCTTTTCGGGTATTATATTTGTTTGATTA
AGGCGTATTACGCCTTAAAAATTATTTTTTTCTTGCTCGGGTTTATCTCCTCTAGTTTT
TGGGATTATGGGTGTAGTAGTTCCAGTTTGTGGAGTTGGTTTTATTACTTTTTCTTTATT
GTCCGACATAATTATTCTCCTTTTACGATTTGTGCACCACTTGTTATTATAGCAAAAAA
AGATATACTAGCTCCAATAACAAGAAAAACATAAATTTACCAATATCTTTACTCATATT
ATTAATAATTTTGTTATTTTTATCGAAAGCATCTAATATAGAAGATATCATGGCATTAAT
TCCATTTGTATGTTCTAAATTATCTGAATTTAATTTAGACATCTCACCGTATTGATCTTG
TGGAAAAGCTATTGTATTATTTATTTTTAAGGCAAGCAAGGAAAGAAAGCGCAATATCC
TAGAAATATAATTGAAACACTAAAAAGAATAATAGTAAATAGATCTGTATGGGTTGTTTT
TATATAGTTATTAAGTATAGTGATGTCACCTGCTATTATAAAAGTGCAAAGCCACATGTA
TAATTTTATAGTTTGAAATTGTCCAGGGATTATACTTGTCAATTGAATATCTAAATCTTT
TCTTTTACTTTCAAGTTGTAGCTTTAAATTCTTTTCATAGTTCTCAAATGAAATATTTTC
TTTATTTTCTGACATTTTAATTCCTTGCATAGTATTTTTATAATTATATTAAAAACTTAA
TATATTTATAATTAATATAAAAATTAAAAATATATATTGACATATATTTAAAATTAATAT
ATAATTCTACACATAATTAATTTTACAAAATAAAATAATTATTTAACCAAAGCATAAAGT
ATGCCAAGTTTTAACTTATAAAGTTTTTAGGGGTAAAAAATGATAGAAGCAAGATCAATT
TTAGATGTTTTAAGTTTTAGAAAAACTGAAGAAAAGGAAGAGCTTAGAAAGTGTTTTAAT
```

FIG. 17BA. Continuation of (CJLB-15-1 [organism=Campylobacter phage CJLB-15] partial genome contig_1)

```
TTTAGTGATGAGGTTTTTGAAAAAGGACTTAATTTTTTACATACAAATGATGAGATAAGC
ATAGAAGCTGTGAGTGATGGACTTTTTGAAAAAACGATTATCAGCATAAAGGTTTCAAAA
TGAAACAAGCGATAAAGCAAAAATTAGGTGTTAGTAGCATAACAGAAGCAGGGTTAAAAC
TAAATTTAGCTCACAATGTCTTAAATAGTTGGCTTTCAAATAATCTTACAAATGCAAAGG
TTGAAATAGCCCTTTTAAAACTGGGTTTAAGAGAGGATGAAAGACTAATAAAACGCATAG
AAAAGCTAAAAAGCGAGTATAAAAGAACGAAATCCGTAAGCAAGCCTATGAAAAATATA
TGAGAGAAATTAAAGTTTTATTAGAAGAGATAGAGGCGGCTTAAAAGCCTCATTAAGCAC
ATTTATCTAAGCACTTTAAAATCGCATTTTTTAAAGTGATAGCAAAAGTGTGCTTAAAG
GGTTTTTGCAAAAGTTGCGTTAAGTGGATAAACGCCTACAATTGCGAACTTTAAAGGTTT
GATATTTTTTAGATTGCTTCACTAGCCTTTTATGGCTAGTGTGTTCTTATATTCATTGCA
CTCACAGGCGACGGTGTGGAAAGTGGGCTTTTTTAAAGCTTTGTTAATTTACCAAAATAC
CAAAAGTCTTTTAGACTTTGAATGCAGGTCCTATGTTTTGGTTAGTGTTTAAATGAGGAC
TAATGAGAATTCTTTTAAAGTCCTCAAATTTATTTATTTCTTCTTAAATTAAGCCATCTT
TTAAGATGGCTCTTAAGTCTTCATTTAAACACTAAAAAATTTTAAGGAGAATAAATGAAT
TTAGAACTTTTTAAAAAGATGAAAATAAAGAAATAAGCTTAACTTCTTTGGAAATAGCA
GAGCTTACAGGCAAGGAGCATTTTCATGTTATAAGAGATATAGAAACTTACTTAGAAAAA
GTGGTTGAAGGGGGTATATCCAAATTTGGAGACACCTACCAAAACACACAAAATAAGCAA
TCTTACAAGTATTATCGCTTACCAAAAAGAGAAGTATTGATTTTAGTGAGTGGGTATAGC
GTAGAACTAAGAGCAAAGATAATCGATAGATTAGAATACTTAGAAAATGAGCTTAAAAAA
CAAAGTTATAAACCGCTTTCATTAAAAGAAAGTTTGCAAATGCAATTAGAGCTTTTAGAA
AAAAGTGAAAAACTTCAAGTAGAAAATCAAAGCCTAAAAAACGAAGCCGAACAAAATGCA
CCTTTAATTCATTTTGCAAATCGCATTCAAAACACAAATGATGCTATTTTGATAAGAGAT
TACGCAAAAATCTTACACGAAAAAATAATCTTGAAATTGGCGAGAAAAGACTTTTTAAG
ATCTTGCGTGAAAAAGGATTTTTAATGAGTGATAATAAACCTTATCAAAAATACATCGAA
CAAGGACTTTTTAAGGTAAGTGAAACGACTGTTAGCACCATTAATGGCGATAGACTTGTA
AGCACGACAAAAATAACAGGTAAAGGGCAAATAGCCATTTTAAAAGCGATTTTGAAAGCA
AGTTGATATAGATTTAAGCGAATATGGAGACAATGAAACTTTTAAAGATGAAATTCAAAT
GCCAAGCGATAGAGTTGAAATAGAACTATTTACAGGATTTTACGATAAAAAAGGAAATAA
GATTTATGAAGGAGATATTTTATATTCTTTTGAAGGTTGTTCTGAAGATGAAGCTTTTAA
ATATAAAGTTGTTTTTAAAGAAGGAGCTTTCTATTTAGTTGAATGTGGTGATGATGGTGA
AGAATGGGATGAAGATTTACTAAGTGAATTTTGTTTAGAAGAACTAGAAATTGTGGGCAA
TATCCACGAAAATGCGGAATTATTAAATGAAAATAAACCATCTTGATTTATTTAGTGGCA
TAGGTGGTTTTGCTTTTTGAACTAATAAAATAAGGTTTAAATATGGATAAGAATTTAAAA
AAAATTACAGAATTAAAAATAAAATGTAAAAATTGCGATACAAAAATCATTACAAAAATA
GGTAATGTTATTAAACTTGTCCGCAATGTGGAATAAAGTTTATAGATGAAAATTTAGGA
TATAATCTCTTTGAAATTTTAACTGAATTGTTCAAAAGTGTTAGCAAAAATAAAAATGCA
GAATTTTATTTTGTTTGTAAAAAGGAATGTGATGGAACAAGAAATCGCCAAGATAAAAAA
GTTTAAACTAGAGTGCAAAAATTGTGAAACGCAAATCATTATAGATACTCACAATAGTAT
TAAAAATTGTCCTGTGTGTGGATTGAAATTTTATGACAATTTAGAAAGTCCTTTTGAAAA
TTTACACGAACAAATTCTTTTAATCAATAAAAATAAGAATGTAAAAGTTTATTTTGTTTG
TGAGGAAAAGAAAAGAGGTAATATAATGCAAAGCAATAAGACTTTAGGCGAAAAGCTAA
AAGATAGCATAGATTTAGCTGATAAAGAAGCTATAAAGCAAAGCGTAGGTTTTGTTTTTT
CTTTGGCTAATAAGATTTTTTAATTTAAAAGGAGAATTAATGACAGAAGAGAAAGAAAAT
ATTGTTAATTTTAAAATAAAAATTATCCATGAAGAAAACATAGAACTTGGGATAATGGCT
AATTCTTTGTTAAGTTTTCAAAAATTAATGGATAGTTTTATATCAAAAGAGCACGGTATA
ACACAAAGTAAAATTTTTTTAGAAAAAGTTGAAACTGGTAGTGATATATATTCTTTGGTT
TTTGAAATAGCAGGAGAAGTTTTGCCTATTATTGCACCTATTCAAGCATTAAATGAATTT
ATAGAACTTATCATATCTTTTAAAAATATCAAATCAAAAGTATAGAAGAAATAGAAGAA
AATCCGCATTTTACTAAGTATAATGCCAATAATTTAAAAAAATATATTTGCACCCGTTACT
ATAAATCAAATACTTTTTTTATCAATCATAAAGGTGAAGAACTTTTGAGAATAAATAGT
GATGAAGCTGAGCTTATTTATGAAAATGCTAATTACATTTGCGAAAAAAAGGAAATTGAA
TATCAAAAGATACATGAAAATGCTTTGATAACGATGTATAAAACTACAAATAAAATAGAC
AATAAAACAAAACATAAGGCAAAGTGCGATGCTTTAAGTCCTTATGCGGTTGATGTTAGT
TTTAGTGATGAGAAATAGCCGAAGAAGTTTTGAAAAATCCTTATGGATTTAATTTTTA
GTAGATTTAGAGTATTATAAAAACGATAAAAATAAAATCATTTTATATAGAATTTTTAAC
ATAAAAGATAAAATATCTTTAGAATAAAAGAAAGGGAAAAATGACAAGTGAAGAATTAAA
ACAATTTTGTAAAGAGCAAGGCTTAACTTATAAAGAGTTAGCCGAGTTAATAGGTTTTGG
TGAAGGTGCAGTAAAAAATGCCATTTCTACTGAAAAAATAAGTTTTCAAATGCGCACACGC
TATTAATATGCTTAAAAAAATTTTTGAACTAGAAGCAAAATTAGAAAAAGCAGAAGCTAT
CAAAAAAGACTTTAAAGCGTGGATTAACGAAAATTAATCCACAAAGTAAATTTAAATTAC
TTCTTTATCTACAAAAAATAAAATAAATTATTATAACCTTGACAATTAGTAATTATTAT
GTTATAATTGTGTTATCAAAAGTAAAGATAAATTACTTTTGAAATAAAAGAAAGGAGTAA
AAGATGAACGCTAGTGATGTGCTCGAGTTAATCACTGCTTTAATCTGCTTGATAACAGCC
ATTATCAACGCAAGAAAGCATTAAGGCAAAGGGCGAAAGCCCTTATCATCTTTTACCTTT
TCTATTATATCAAAAAGGAGTTAAAAATGATTTTAGAAATTATAGTTTTAGTATTAGCG
ACTTTATTATGTGTTTTATCGGCAAAAGTTTATAGGCTTGAAAAAGAACTTAAGGAGCTT
```

FIG. 17BB. Continuation of (CJLB-15-1 [organism=Campylobacter phage CJLB-15] partial genome contig_1)

```
AAAAATGAGTAACAAACCATACCTAGAAAACGAAATAAAAGCTTTAAAATATCAGCTTTT
AATCGAAAAACAAAAGCACAAAAAGACTAAAGAAAAGGTTTTTAAGCTTAAAAATATACA
AGGGGAAAAATACGAGAAACTAAAAGCAGAATTTGCCAAAAATCAGCTTTTTGTTTTTAG
AGATGATGAGCTTTTTCTTTGGGTGGAAAGTTTAATGCGAGAACTTAAAACTAAAATTTT
ATGCACTAATGATGAGCTAAGTAAAAAAGCTTGTGATATATTAGTATTTAAATTAGAAAA
ACGAAGAAAAATTTCAACTATTAAATAAATCACCAGTTTAACAGTGTTTAGGACATTTT
AATAAACCCTAAACACTCATTTAATGTCTAAAAAAGGAAAAAATGAGTTTTAAACCCAT
ACAAAAGATAATGATGCATTTAAAAAAGCACAAAGAGCAAAGGTAATAGAAAGTTTAGC
AATGCGTGGCTATGCACTTGTAAAGATAAGTAGCAATGGCTTTTTAATGAAAAAAGGTTT
TGAAAAGGATATTTTATGCAAACAAATCATAGCACAGGATACGACAGCTTCCGTTTCGTT
ATCAACAAAAAAACCTTTTACAAATACCTTAAAAAGATGGGGGCTTTTTGAAAAAATGCGA
AGCACAACAAGAAATAAAAGCATTGATGAATTTGCAAAAGACAAATTCAAAGGCATAAAA
ACCAATGATAAATTTTATCCTTTTAAAATGCGTTATATCAATATAAAACCTAGAAATAAA
AGCCTTTCAAATACTATCATTATATTAGATAATTCTAAGGCTTGCTTTGAGCTTTCTAAA
AAGAATAAAAAAGCAAAGATTACTACATAGAGGTGCAATTTAATGGGCTTTATCAGCCT
AGTAAACAAATAGAAGCTGAAGTGTGGAAAATTTTAAGCAAATGATAAAAAGGTTTAAA
GCTTATAGTGTGGATATTGCTTGTGATTTTGATGATGATCTAGCAGTATCTAAACCAAGA
GAATTTAAACACCAAGAAAGGTTTAGCAAACTTAAAATCTTTGGCGATTTTCATACTTAT
AAAACAAGTATGTATATCAACAATCCTCAAAGTAAATACTATAAAATTAGAACGCATTTTA
CTTTATGATAAATACGAAAAACAAAAGCACTATCACAAAGAAAACATTAAAAGGGAATTT
GTGCGATGGAAAGATTAGAGCTTACATTGAAGATAAAGGATAAGTTCTTAGATAGAATA
GAAAATGATATCAATGATGCATTGGATCTTATGCAAGATTATTTAAGAATGATAGGAATT
TGGCATTTTAATATGAGAGTGATACTTGAGCAAACAAAGTATTTAAACAATCCACGTTGG
GCTAAGACATTTAAGCCTTACGCTTTGGCAAGTTAGGAGGAGAATATGAAAGTAATTTTA
TTTTTAAAGGGACAATAAAATGTTCAAAATGCAACTTAGAATTTGTGCCAAATTCTAAAT
TTTTTAAAGGTCTTGATGAAATTATAGGCGATGTAAAAAGCGTGAGTTTAGATGGCTTTT
GCCCTGAATGTGATAATAAATTAAAAGCTACTTTTGAAGTAGAAAAGATCACAAGGGAGC
TTAGCAAAACTTATACAATGAGGTGTTAAATGAATATTACAAGAGAATTAGAAGCTTATG
ATTTAGCAAAACTTGTTTAAATAATGATCTTAAATACTTTTTTAAAGATGCAAAGATTG
TAGGGGAAAATAAAGAAAGAAGACTTTGTTTTTATTTTTCAGATTCTTTTGTTTTAGCTT
TATTTGAAAAAGAAAAAGAAAACATTTTACAAAGACTAAGAGAAGAATACAAAAAGAAAT
TAGAGTTTTACAAACGAATTGATTTGGTGTTTTATTCTATTGCAGCAAAAGGAATAAATG
AGCTAAAAGCAAGAAGTAAAGAAGAACAAGAAGTTTTAGAACGCGGACTTTTAAAACTTG
AAAATATAATTAAAAGGATAAAAAATGAAAAAAAATACTAATCAGCAATTAGAGCAGTTA
AAGGAATTAAATCAAGGTGAGTTAAACCAAGAGATAGAAGTTTTAACCAAAAGAGCTTTA
GCAATTCATAGATCTATACAAAGAGTTAAAGATGAAAGAAGCATATTAAATCAGAATATC
AAAGACTATCAGAGCGAATTTAATGAAATAATGGAAAAAATAGCCTTTTTAAAAGAGCCT
AATTTATTTAATCAAAAAGGAAGTGATGATGTTTCACCCACAGCTTTATAACGACCACTT
TCAAAATTTTAAAAGATATAATATACCAAAAGCACAGCTTGTAATAGCTGATATTCCTTA
TAATTTAGGCAACAATGCTTATGCTTCATCTCCTGAATGGTATATAAATGGGGATAATAA
AAATGGAGAAAGCAAAAAAGCAAACAAGGCGTTTTTTGATACAGATAATGATTTTAGAGT
TAGCGAATTTATGCACTTTTGCTCAAAAATGCTTATAAAAGAACCTAAAGAATGCGGTAA
AAGTCCTTGCATGATTGTTTTTTGCTCTTTTGAACAACAAACAATGTTAATTGAAGTAGC
TAAAAAATATGGCTTTAATCATTATATAAATTTGGTTTTTAGAAAACAAAGCTCATCTCA
AGTTTTAAAAGCAAATATGAAAATAGTTGGAAATTGTGAATATGCTTTAATCTTATATCG
TGAAAACTTCCAAAATTTAACAATGATGGAAAGATGATTTATAACTGCATGGATTGGCA
AAAAGATGAAGGTATTCCTAAAGTACATCCCACACAAAAGCCTGTTAAATTACTAGAAAG
ATTAATCACTATTTTTACAGATGCAGGTGATGTTGTTATAGATCCATGTGCTGGAAGTGG
TAGCACTCTTTTAGCAGCTACAAATTTAAACCGCAAAGCTTATGGCTTTGAGATTAAAAA
AGACTTTTTTAAAAGTGCTAATGAAATTATGTTTAAACACATAGAAAGAAGCTTATTTGC
TTAAGTTAGAAAGGATAAAAAATGAAAGAATTCAAAGAATACATAAAAGCTAAAATAGCA
TTAGAAAAAGAGCTAGAAAATACGCAAGAAATGTTAAAGCAAACGATAAAAGAAATGTTG
CTTTTAAGAAACGACAATGCTTTTAATCAAAATGCAAACGATGAGATGTTAAAAGCTATT
AATAAAAATTGGAAAATAACAGCTTCGCTTGAGAGTTTAAGTGATACATTAGAAATTAAA
GTGCTAGAACAAAGCACGAGCTATAATCGCTTTTGTTTGGTGATGTTTGATTTTAATC
AGCAATTTTTTAAGCTATGAAGAGCAAAAAGCAATTATTGCAAAATTAGGCTTTGATTTA
GAGAAAGGAGTATGAAATGGCAAATTTGGTAAGATAGAAAAATTATTATCAACAAAGA
AGTAGCCGGAGTATCTGGGATTTACTCCGCTAAAAATTCGCAAAATGAGAATGCGAGTAAA
TCAAATAAATTTAATTTTCCTAAAGGGATTAAAATAGGTTCTACTTTTAAATATGAAAA
AGCCGAAATTGATAAATGGTTGCAAACTTGCAAGGTGATTTAAAAATCCCCTGCAAGTTT
TTCGATATAATCTCCCCACCACTGCATTAACTTTCTTTTTAATTCTATATTTTCACTACG
ATTATAAGCTTTTAAAATGGCGTTTTTTGCTCGTGCTAAACACTGCTCGGCTATATC
CATACTCACACCATGATCTAATTGATGTTCGTTGGCTAAACTTCTAAACATAGCACGAAA
GCCATGTGCACTTTGAATACCTTTATATCCTAGTCGTTTATTGATATTACAGGTGATATT
CTCGCTATTACACCCATTTTTTGAACTTCCAGCAAATATATAATCATTGACTTTCATTTT
CTTTTGTTCTTTTAAAATTTTAAGCGCTTGAGAATTTAAAGTGATAATATGTTCTTTTCT
```

FIG. 17BC. Continuation of (CJLB-15-1 [organism=Campylobacter phage CJLB-15] partial genome contig_1)

```
CATTTTCATTTTTTCAGCTTTAATAGTCCATATAGCATTTTTTAAATCAATTTCATCCCA
AGTTGCTTTTATAACATTACCGGGGCGTTGTGCAGTCAAAAGATTAAAAAGCATTAGATT
TTTATGTGTTTTTTTAAGATCTGAATTTTTTAAGGCTAATATATATTCTTTAATTTTATC
GTTTTCTAGTAGAGTTGGCTGATGAATTACTTTTGAAGCTTTTTTAAAAACTATGGAATT
ATCAATACTTGTCACAGGGTTATTTTCTACGATTTCAAGTTGCAAAGCATATTTAAAGAT
TTTGTTAATCCAGCCTTTAGCTTTTATAAGTGTAGGGATTTGATGCTCTATGGTTTTAAG
TGTTTCGATGACATGTGAACGCTTGATGCTTCTATATCTACATCTTTGAAATTCTTAAA
AACGCCATTTTTGTATTTTAATCCTCTTTGTATTTCTTTTAGACTTAATCCATCAGCCTT
ACATTTTTCTAAAACTTCATCATATATATCGCCAAATTTAAGTCTTTTAGCGTTTTTTAT
GTTTTGTCCTTTTGCTTTTAGCTTAAAAGCATTTAAAGCGATTTCTCTAAGCTCTGCTAA
GGAAAGTAACGGATACTCTCCTATTTTTATATAAGTATCATTTGCTTGTCTTATTTTAAA
TAATTTTTTACCACTAGGATAAATAAAAACATATAAGCCTTTTAAACTCGGATCAGCAAA
TTTTATAAATTTTTTATCACTTTCGCATTTAATGCTTTTTAAAAAACTATCGGTAAGTTT
GTTAATTTTTGCCATTAATTTTTCTCTCTTTTTTAGTGTCTATTTTGGTGTAAAAAGTAG
CCCATTTTGTAACCCATTTTTGGAAAAGTGACCCACTTTTTTAAGAACATTATAGCACAT
TTTGGAATATAAAAGAACGATATAGAACAAGCTTTAAAACATTTTATTATAGGCATTTGA
TTAATATATTAAAGCAAATAGGGATTTGATAAAAAAGAGTAATGGTGGATTTAGCAGAA
TATTAAAAAAAGTATCTAAATACCTATAAAATAGATATTTTATATTTTATAGTAACCCAT
TAAATAACCCAGTTTTCTAATATGATTTTTAATATTAAAATCCGATTAAAATGCCTATA
AACATATTTCTTAAAATCCGATTAAAAATGATATGTGCTTTTATTAAAATCCGATTAAAA
ACAATACGATAATCTTTGCCAGTGCTTTTTAATATAATAGTGTTTGTATAAAAATATAAA
AAATGGTTTTTGTTTTTTTGCTTCTTAGTAAAGAGCAATAAGTATTCCATAATTGCTAA
TTTAATCTTTGATTAATAGTTTTATTATTTTTATATATTATAATTTTTAAATAAAAATA
TCATTCCTTAAAGCTTCGTTTGTTAATTACTTAAAGACTTCTTATGTTTAATAAAAAGA
TATTATTGTTAATGCAGTTCCCGTTAAGCTTTTTGCAAGTAATTTAGGTTTGTATGATAA
TTTTTATAGAAATGTAAATGAGCTTAAAAGTGGTTTTAAAATCAAACAAGTAGGAAATAA
TTTTTTTGTTTTGCTTCCTGATTGGTTTATAAAATTGCTAGAGATAGGATATGATTGTTA
TGTGATTAAGCCTTATGATGATTTTAAATATGAATTTAAAGTTGAACTTTCTAAAAAAAC
TGAAATAGGATTTTACAAAAATGACAATTTATAAACTTTGCAAGTGTGGTAAGAAAATAC
AAACTCATTTAAGAACTTGTGAAGAATGTGATAAAACTTTTAAGAAAATAGCAAACAAAA
GATATGATTGTTTTAAAAGAGACAAAGCAAGTTCAGATTTTTATAACAGCACAGCTTGGA
GAAAATTAAGAAATGCTTTTATAAATAAAAATCCATTTGTGCGAAGTGTGGAAAGTTTG
CAAAAATTATAGATCATATTGTGCCAATTAAACAAGGTGGCGAGAAACTGAGTGAAGAAA
ATTTGCAAAGTTTATGCATAGTTTGTCATAATGAAAAGACTAAAAATGAGCTTAAGGGAT
GGGGTATGTAATCTCTATGAAATTCAGCCTATCCTTTTCGGTGTATGGGCTGAATTTCAT

>CJLB-15-6 [organism=Campylobacter phage CJLB-15] partial genome contig_6
TGTCGGCGGAAAAATAAAATTTCCATTTGGAAAAATAAAACTTCCATAAAAGTGGAAATT
TTATTTTTCTACAAACCTTAACTTAAAATATAACTTTATTAAAATAAACTAACAAAAA
ATTCGTTTATGATGTTCATCTTCTTTAACAATGGTTTTCATATCCAAATAATGCTTTACT
ATATATTTTGGAATATTAAAGTCGTAATCAGAGTGTGGCTTTAAATCAAAACGATTAAAA
GGTTTGTAATTTTTATAATATTCCCTACTGTTAAAAAATCTAGGTTCTACTATGTCAAAA
CTTGATGTGTCTCCATAAAAATTTGGTGGATAATACATATCTATACTTTCATCATCTTTT
AAAAAATAAGTATTATATAAAGCTTCGCTCAACTCATCACCCCTATGCATTATTTGCATA
GGAAAATAGCTTCCTTCTGGTATTTCATTTAAAAAGAAGTTGATATAGTAGCGATAAGCC
TTTAAGCTTAATTTGCTTTTTATTTGAACGGGATTTGAAAATTCGTGTAAATATCTTTTT
CTAGATCGTATATCTTTTTTAAGATATTCAGGAAGCTCACTTTGCCATTTTAAATATTTG
AACATTTGCTCATAAACCTCTTTTAACAATCCAATATCATTACAATCTTTAACTGTATAT
GCCAATATTTTTTCATACTTGTTAAGCTTTAAAAAATCGTTCCAAGTTACTGGAAAACAT
TTGTATAAAAATTCTTTCCTAACAAACTCTCCATAATCAATTTGGCTAGTTTGAATTAAT
CCAGCCGTGCAAGCTAATTCAACCTCAACATCTTCATTCTCTGGAGTTTTATGGTAAAA
ATTTCATGTGAAGTTGTTTGAAATTTGTTAAATTTCAAGTCCTTTTTTCGCTCTTTTTCT
TTTTCAAAATTTTCATTTATTTTTTGCATTCTTTGTTTATGTACTTCATCAATTTTTTGC
ATTTCCTGCTTATATTCATTCCAAATTTCTTTTACCGGCTTATTTGGTATTCCTTTTATT
TTTCTATATAAATAATTACATAAGAGAAAAATAAAAATAACTGCTAATATCGATAATACT
ATATTCACTTTATTTCCTTTAAATTATATAATAGAACGCAAAACCTTACCCTGTATAATG
ATTTCAACTTGTGAGTCTTTTAAGTCCAAACTATAGCTTTTATAATCCTTATTTACACTA
ATAATATCTAAAACTTTACTTATTGGATCTAATTGCAAAAGTTTAAACCATAAGTTGATTA
TCAAAGTTTAAAATGTATAGTCCATCTCCTTGATACTCGTGTATTTCTTCAAATATAACC
CAACTATCAGGTAAAAGCATTGGAATCATAGAGTATCCATCAACTTTGATAGCTTTTACA
TTTTTTGGAGTTGTTTAAAAAAGGCTTTACTAAGTTCAAGCATTTCACCTGTTTCGTAT
TCCTCTAATCCTATCAACTCATTACCTCCACCAGCAGAGGCTGAAATATTAAGTTTTGGT
ATAGAATAAAAATTAATTTCTTGTTTATTTCTATCTTTATTTAGTGCATTTTCCTCTTTA
TCAATGTAAAATTTTTACTTAACTTGCTTATATTATCAAAATATTTTTTGCTAATAGGT
GTTTTGCCTTTTTCTATATTAATAATTTGCTGTCTTGTTAAATTAAGCTTATTACCTAAT
TGTTCCTGTGTAAGTCCTAATTTTTCTCTTATTTGTTTAAAATCATTTGCGGTCATATAT
```

FIG. 17BD. Continuation of (CJLB-15-1 [organism=Campylobacter phage CJLB-15] partial genome contig_1)

```
TACCTTTATAAAAAGTAAAATATTTAACATATTTTATTGACTAATGTAAAATTTTTTACT
ATAATACTTCAATTAAAATTGAAATTTTATCACAATTAAAAATAAACTTCAATTAAAATT
GAAGTATTGAAGGAGAAAAAATGATTAAAGCATATTTTGAAAACAATGCTATTAATGTAA
AAGCTTTTGCTAGAACTCACAACATTAGCTACGATATTTTACACAGAATTATCAAAGGCG
AAATTACAGGTGAAAGAAATACTAAGGGTAGTACAAAAGCGGTATTTAAAAAGCTCTTAG
AGCTCGGCATCATTAATGAGCTTCCGCAAGGATTAAAATAGTGTATTTCTTAGAAACCAA
AGAAGCTGCACAAGCTTTTAATGTAAGCACAGGTGCTTTGAGACTTGCAGCAAGTAGAAA
CTCAAATAAATACGAGTGGTTAAAAGTAGATAATGAAAAAGGCGGCAGGGGTGGCAAAAA
ACTACTATTTAAAATAAGCAAAGATAAGCTTTTAACCGCCTTTAACCAAGAATTAATCAC
TAAAAATACTTTAATTTATGATGAAAAAATGCAAAAAGTTAAATTGAGCGAAATTATTAC
TACCGATAATTTAAAAACTATAAATAATAGTTTAAAAACTAGTAATTTAAATTTAACAGA
GTCAAAAATAAATGATGATTTGGCTGTTTTAAATTTAAAATTTGAAAATTTAAGCGATGA
ACTTAAAGAAGATGCGAAAAGTAAAGTAAAATTACTTAAACAAGTAGAAAAATATATTGA
AGGTGGTCTTACACTCAAAAGAGCATTGTTTTATGTAATGTAGAATGGAGAAATTATTC
TAACTGGCGTTCAGACTATAAAAGTATGGCATTCTAGGCTTAGTCGACACTCGCGGACT
TCACCGCAAAGATAAAACTAAACTTAGTGCTTGGATGCAAGAATATGCCTTAAGAGAGTA
TCGCACCTTTGGAGCAGGTGGATTTAATTTCACTGAGCTTTGGTGGCAAATTCATAAAGA
AGCAGCTACTAAAGAAAATTATGACTTTATAGGTTTTGACTTAGGGGAAGTAAAGCCACT
CTTTAGTGTAAAAACCTTGCAAAACTTTATTAAAAACTACTACAAAGATAAACCATTAGA
ACATTGCATTATTACTCAAGGCTTAGATCGTGCAAAATCTAAGTTTCTCCCTGCACAAGG
AAATCAAGAGAGCTATATGACATGAAAAACATGTGTTGGCAAATCGATAGTTCCCCAGC
TGATATTATAGTAAGAGATGATGAAACCTTAGAGCCTTTCCGCCCTCATATCTTAAGTGT
CGTTGATGTCTTTAGCGGTATGGGTGTGGCTACTTTAGTAAGTAAATCAAATTCTTTAAG
TTTGACGCGTCTTTTATGGAAAGCTATAGATAAGTTTGGTAAGCCTGTATATGATTAAAGG
GGATAATGGAAAAGATTATCTTTCTAAAGATTTTCAAAGCTTGCTTGATGGGCTTAATAT
TACCTATGATGCAGCTATTGCTTATGCAGGAGAACAAAAAGCTTTAGTTGAAAGACGCTT
TGGGACACTTCAACATGCAGGAATTTCTAAAATGCATGGACATATTGGCAATAATCTTGC
CAAAAGAGAAATGATAGAGCAAAAAACTCCTAAAAAAGATAGACGTGCTAAAGATGAATA
CGGCTTTGCTAAAAAAACTAATCAAAAATTACTTCTTACCTTTAGCGAAGCTTGTGAGTT
TTTAGAAGCTGAAGTGATTAAATGGAACATGAGCAAAGTTCGTCGTAAAAAAGGCATTAA
AACTCCACTTGAGCTTTGGAACTCGTGCGATAGAGCTATTGTAAAAATCTCTTATGAAGA
ATTTTTGTTTAACGCTGGAAATAAAGAACTTAGGGTCGTGGGTAAAAAAGGCATTAACTT
TGAAAGTAGAGTTTATAAAAGTGCTTTAATGCCAAGTGTTGGCACAAAAGTTAAATGTGT
ACAAAATATCGATAATATTAAGAGCTTTTCATTTATGATTTAAGCGGAAACTTCCTTTG
TCTAGCACTTGATGAAAGTATCGCTAAACTTAGTAAAGAAAGCTATAAAATGCTTAAAAA
AGGTTATGAAAGTGAAGTTAAAGCGATTAAAGAAGTGCTTAAAAAAGATGAGATTGCCGT
CTTTACTAAACTTAATATTAAACAAGACTTACAAGATTTCAAAAGTGCTTTTGAAAACTC
ACTCGTAGAAGCTAAAGAGGTGCATCAAAAATCCCTTGCAAAAGAAACTTTAAAAACTCA
AAGAGAATTAGAAGAGATTAAAAACAATGCTAATGCGGATGAGCTTATTTTAAACGCTAA
AAAAGAAATAAATAACGATGAAAGCGAGTTTGACATGGAAGCTTTTGTCGAAAAGAAATA
TTTTGCTGGTTAAAAATTGTTTAAAGCTTGATTAATTCAAGTTTTAAAGAGTTTTTACTC
ATAAAAAACAAAAGGATAAAAAATGCAATTAGTAGAACTTACTAAAAAGTTTTTAAGCAC
CCAAAACATCTCTCAAAACAATCTCTCCGATCGTTTAGGGATTAATAAAAGCTATATGGT
GGGCTATATGAAAAAGGAAGTAGCTATAAATACGCTTCAAAAGTAGAGTCTTTACTTGA
AAAATACATTAAAAGCTTTGTGGAAGAAAAAAGCGTGAAAGAGCTTCAAACACCTTTTAT
TGCCACTAAAGATGCAAAAGCAATTAATGTAACCATTGAAAGTGCCATGAGCAATCGCGA
AATGGGAGTGATTATTGGCGAAGCGGGACTGGAAAAAGCAGAGCCATTAAAGAATATGC
CACTAAAAATGGAACAAGAGTGGTGCTTTTTGAAGCTACAACAGAAACTAGTAAAAGAAT
GCTTTTGGTGGGCTTGAAAATAAACTCAATGTGTGTTTTAAAGGTTCTTTGGATGATAA
GATTAGAGGCATTGCTAGCGAGTTAGCAAGAACTTCAAAGGTTTTAATTATAGATGAGAG
TGAGCATTTGCCGTTTCGTGCTTTGGAGTGCTTAAACGCATATATGATTTTTCAAATAC
TGCTTTAATCTTAGTAGGTACTAGAAAACTTAAAAACAATCTTACAGGCATTGGCAGAAA
TGATTATAACGAGTATGGACAGCTAAGCTCTAGAATTGGTGCAAAATGGGAATTAAAAGG
ACTTTGCTACCAAAACAAAGAAGGTTTAAAAAATGAAGATTTAAAAACTCTTTGCTCCTA
TTTTAATATAGAAGATAAAAAAGCAATTGATTTGGTTTTAACTTAGCTCGTGGCAATTT
TAGAAAAAGCGAAAAGCTTTTAAAAAGAGCTTGTGAATTTGCAGATGGAAAAGCGGTTGA
GCTTAAACACATAGAAGCCGCAGCTTCATTTTTAATGTTGGGATAAAAATGACCTTTGAA
GAGATAGCAAAAGAACTGGGTATTTCATTGACGCGTGTTCATCAAATCTATAAACACGCT
ATTAAAAAATTAAGAAGTCCTAAAAATAAAGATAAATGGCTTGCTATCTTTGAAACTTTA
GACTTAATAGAGCAAGAAAAAACAAAAAGAAACAATTTAATACAAGGAGTAGATCATGAC
AACAATGATTAAAGGCGAAAAAGCAGACTATAGTGCTTCATTGTTTGAAGTAAAGGTGC
GGGTATTTATTTTAAAAAAAGCGGCACTTTTGTGGATGTTTTAAAAGGAATTTATCCTGA
TTATATTGCACAAAAAATTCTTAATTTCATTTGAATAAAAAGCTGAATAAAAGTGCTTG
ATTTAAAAGCACTTTAATTGCGTTTTTCTTTTTAAGTCTTTTTTTAAGAAGACTTAAAA
AGGGTAAAACCCTAAAATCATCAAAAAAGGAGAACAATGCCATTAGTTTATATAGCAAGT
CCTTATAAAGGCTTAGCTGTGCAAGAAAGCAGACGCAAATCATTAGCCATAAGCGTTGCC
```

FIG. 17BE. Continuation of (CJLB-15-1 [organism=Campylobacter phage CJLB-15] partial genome contig_1)

```
GAGCAAGAATGCTTAAAAATTATACGTGAATGTGAAGATTTTACGCCTATTTCACCCATA
CTACAATTTAGCTATTTGGAAGAGAATAAACACAGAGACAAAGCTTTACAAATGGGGAGA
GAGCTTTTAAAAGCGTGTGATTATATTTATCTTAGCAAACACAAAGACGCTAAAAATTCA
ACAGGTATGCAAGAAGAATTAGCCTTAGCTAAAAAGCTTGGCATTAAAGAGCTAGTTTTG
GAGTTGCCCTTACAATAAGGGCTTAAGGATAATCAAGAAAAAAACTAAACACGCAGTGCT
TTTAAGATATGGCGTAATTCTTTGGGATTATCAAATTAATAAATTTAATTTAAAAGGAGA
ATAGATGCAAATAAATAATTTAGAAGATGTTAACTTAGCACTTAAAAAAGTGGCAGAACT
TAGCGTAAAAATAGAAAAGATTAATGGCGAGGTGACTTTAGCTTGTAATGAGATTAAAGA
AGCTCGTGCAGGAGAGATTAAGGTTTTAAGTGATGAACTTAAATATATAGAGCAGTGCAT
TACAACCTTTTGTGAAAATAATAAACACGAGTTTGCAGAAAAAGAAGCAAAGAATTTAC
CTTTGGCAAGATTGGCTATCGCTTAAGTAAAAGTGTATCTTTACCACGTGTGAAAGAAAA
ACTAGAAAACTTAATCAAAGCTTTAAAAAGCTATGGACTTAATGATTGCATTACTTATAA
AGAAGAACTTAATAAAGATGCTATTGCAGAGCTTGAAGATAGCACCTTAGTAAAGCTAGG
ACTTAAAAGAGTTGTAAAAGATAATTTTAGAATAGAGCCAAAGATTGAAAGCTTGGAGAT
TGAAAAATGAGAGAGCTTTCCTTAGCGACTTTTAAACTTTTAAATAGTGTTTTTAAAACA
AAAACAGCTCATTTTAATGGCTTTTTAGAACTTGATTTTAAAAATAAGCCTAAGCTAAAA
AAGCAAAGCTTTAAAAGAAAAAAGAAAATGACTTCAAAGCAAAAAATTAGACTTAAAAGA
ATTTAACAAGTCCGCTAAGGCGGATTTGATTAAGTTTTTAAAACTTAATTTAAAACAAAA
GGATAAAAAATGTATGTCAATGTAAGCATAGATGCGAGTGATTTAGAAGATATAGATGCT
CATGATTTGGCTGAACTTTTTGAAGATTTAAGCACAAAAGAGCAAGAGGAATTCTTTGGA
ATTATCCATAAGGATATCAAGCCATTAGAAAGAATAAGAGCTATTCTTTCTAATTTGTCT
AATGATGAAGCACTTAAACTTTTAAAAGAACTTAATAATGAGTTTAAAAGCGATGAGGAA
TGGCAAAAAACTATAAAAAGTATAAATGGAGGTAACAAATGAAACTACAAGATTTTGATT
TTAGAGTTTGGGATAAGCATCACAAGGGTTGTGGTAATAAGGATTGCAAATGCCAAACAA
AATATGTTTATGGTGAAGAAGCCAAAACAAGGTTATCTGAGTTTAAAGAGGATTGTGAAA
TAGAGCTTTTTACAGGGCTTTATGACAAGAAAGGTAAAAAAGTATACGAGAATGATATTG
TTAAAGTTAAAAGTCTATACGATTACTTTTTAGCAAAAATCAGCATTCACAAAGAAGGGA
CTTTTTATTTTGAAGGAAAAAATGGAGATTACATAGGCTCTTTAATTTATTTAGTTGAAG
ATGAAGGATATACTATTGAAACTATCGGCAATATCCACGAGAATCCTGAACTTTTGAAAT
GTTAAAAAATATTAAAAATTTTAACATAAAAATGAAATATGTTAAAAAAGCCAAAAAATT
TAACAAAGTCCATTGATTTAATGGGCTTGATTAAGTTTTAGCAAGGAAAAAAGATGAATT
TGGATTTTTTAAATGAGTTTAAGTTAAAAAATAAAGATTTAAACGAGAAATTAGAGTTTT
TAATCCCTGATTTTTTAGTTAAAAAAGCAATAACTATTATTTATGCAAATGGTGGAAGTG
GAAAAAGTTATTTAAGTGCCGCCATTTCTAAAACACTTTGCAAAGATACAAGGGTTAAAA
GCATCGTTTATGTTGACATGGATAATCCTTTAAATGTTTTAAATGAAAGAGGTTTTGGTG
AACTTATTTTAAATGAAAGCAAATTCACTTATATTCACAGATCAAGCTTAAAAACTTCAG
CTTATGAGCTTTTAGAAATGATTGAAGGCAAAGGCGTAGCAGGAAGCTATGAAGGGGTTT
TATTTGTACTTGATTCTTTACGCAATTTTGCAGATATTGATAATGATACTAAAATGATGT
CTTTAATGTCTTTACTCATGAATTTAAGAGAATGTGGGGCAACCATTATGGCTTTACACC
ATTCTACAAAAGATGGCAGAGCTTTTAAAGGCTCAAATCATATTAGAAACTCAAGTGATT
GCATGTATTTTTTACAAAAAGTGGCTAACTTAGAACAAGGCTTTGAAGTATTGCTTAGTG
TGCAAAAAGAAAGAGCAGGAATTAAAGATCAAGCCTTTTTTATCAATACAAAAACTCTAA
ATATTAAAAACACCGACTTGCAAAACGCTAAAATCAGCGATAAAGAAGAAGCTTTTATAG
ATAAAGTTTTAAAGCTTTTAAACGAAAAAAGCCTAAGCACAAGTGAGATTTTATCGGCTC
TTGATGTAAGTAGGAGTGATAATTTTTCAAGGAATACTTTAGAGAAATTTAAAGGTGTTT
TTTGGGAAAGTGAGCTTAGCGGAGAGAATGGTCGCACTTTTGTTTGGAAAAGTTTAAAAG
CTGACAATAAAAACAGCAACGACAAAGAATTAAGCTTATTTGGAGATGAGTTATGAAATT
TAACCCTCCAAGCAAAGAAGATTTAATTAAAGCCATTGATGAGTTTAATGCTAAAAACTC
TTGCTCTATCCCTTATTTTATAGCAGATAGCTTTATAAATTACTATAAGCAAGACGATGG
AAGATGGCTCATGGCTAATAAAAAGCCTTTAAAATGCTGGAAAAGAGCGCTTAATTCAAC
TTGGCTTCCAAAGTTAGCGAACAAATACAAAAATAAAGATAAGCAAAAAGCTTTAGCTTC
TTGGCTAGAAGAGGAGTTTTAATGGATAATGCAAAAGAGGCACTAAAAGAGCTTTTTGGT
ATTAGTGAAGTTCAAGCAGTGGTATAGAAAAACTTTATTTTAAAGCCAAAACACCAAAA
GATATATTAGGCTTTAAAAAATACTATGATTTAACCATGTTAAAAAAGCAATTTGTTGGT
ACAAGCTATGAAAAACTTTCTCTTGTGTGCGCCTTTGCAGAGCTTGATTTAAACTTAAGG
TACAAAAATATAGAGTCTTTTTTAGAATGGCTTTCATTTCATTTCAAATCGTTTTATT
TTTCAAACAAAAAAGGAGATTTCTCATATTCTTTGTACTTAGATATTATGATGGTAAC
ATTGTTTATGATGAGTTAGGAAAGCCTGTTTTAAAGCATGTTGATTGTGGAGATAATCTT
TATTTTATTAATGCTAATAAAGAGCTTTGTGATGAGCAAAGAAAACCACTGAATGTAGGA
GAGTTTTATAATAAGCTAGTTGAATATATGTTTAAAAACCAAGATAAAATTATTTTTGAT
AATAAAATTGAAATAAGCCCTGTTATTAAAACTCAAATTCCTAGCCAAACTAAAATAAAT
AAAGATTACGAGCAAAACTATTTAGAATACAAAAAGAATCAAAATAAGCTTTATAATGCA
AATATTGATAAATTCACTTCAAAACTAGAGCAAATTTTAAAGGCTAAAAAATGAATACTC
AAAACACTTTAAAAAAGCACTTAATTAAAATCATTCATACTTTAAGAAAAGATGCTAATT
TAAGCGATGATGAAAGCTATCGCTGGGTTTTAAATCAAAGATATGGCAAAGCTTCAAGTA
AGGATTTAAGCATAGATGAACTTAGGGACTTTGCTATAACTTTGGGCTATGATGAAAAGT
```

FIG. 17BF. Continuation of (CJLB-15-1 [organism=Campylobacter phage CJLB-15] partial genome contig_1)

```
TTTTAAAAAAGCAAAATACCAAAAAAGCAAGGTATTTTAAAAAAGAAAACACTAAAAGCG
GAAGGGCTACAAAAAAGCAACTTAATATGATACAAGCCATTTGGAGTAAAAATGCTAAAA
ATCCTACTCAGTGGGCTTTAAGAGAGTTTATTAATAATATTGTAAAAAAGCGACCTTTGC
ATCTTTGGTATTTAAGTATAGAAGATGCTAATAAAGTTATCCTAGGGCTTAAAAATTTAG
AAAACAACAGCACACATTAAGCCAAACGAAGCTAATGTTGTCTCATCAAAACAAAAGGAG
ATTAAAATGATTTTAGAAATACATTCTTACGATGCAGAGTTTTTTTTAACCTTAGGCATA
GAAAAACACTCACAAATTGCCTTTGCTGCAAAAGAACAAGCCTTGAAATAATGCATAAT
GGAATCACTCATCAGATTAAAACTGATAAAGATTTTGGGATTTTGCTTAATGTGGTTTGT
AATATCAGAGAAAAACTTGATGAGAGTTTTGAGGAAGAAGATAAAAGCTTGGTTATTGAT
ATAGATGAAATTGTGGCTAAAGTTTGCAAAGAATTAGAGTAATGCTCTAATTCTTTTTTC
TTTCTCATCCATAGGGTATTGTTTATCCCAAGCCTCCATAAGTTTTCTTTCTTGGTCGGA
TAATCTGATATTATAAGTTTTGCTCATATATAAATAGCTTCTTGCAATCCAGCCTTTAGA
ATAATTTGCAGGATAAATCTTTTTGCTTTAAAATCAGTATAAACCTTACAATTTCCATA
TTGAGTATATTTTAAATTAGTAGGAGCCTCAGCATATCTAAAATTGCTTCTATCCCCATT
TATCTCTCCTATGGCTGGAACTAGGTTTTGTTTATCGGCTTCCATTTTTGCAAAAGTTGG
ATCATTTTTACAAGCTTTTCTGCCACCTTCTTTCCAGCAAGGTAAATGCTTTCCAAAGTT
TTGGGCGGGCATAATATGCTCCCATTCTATGCGTTTGATTCTTTGGTTAATTTTTCCTTT
TTTGGTGTATTCGTTTCTAGGAGCATATAAATCACTTTTAATCACTTCAAAACTAATATA
TTTTCCTTTTTTATTAACCTTAAAAGGTGCTTGACAATAAAAATCATACCAGTAAGAGCT
CCCTAGATCATTATAAAATTTTACTAATTCTTTTTTGCTTTCTTCAAAACTTTTAGCATT
TAATAAGCTTAAAGCAAGTATTAAAACGCTTATTATTTTTTCATTTATTCTCCTTTTTA
TTTTTTAAAATTATACCCTACTAAATAAAATTTAACTTTTTTGCTATAATTTGCAAAAAC
ACTCAAATAGGACTAGCATTGCTTAGCAATAACGAATACTTTGAATATTTTATTGATTTT
GTGAAAAATAACGACAAACGAGAAATCTTAAAAGAATTTGGCGGTGCAAATATTTACATA
CCAAGCTATAAAACCTTACTTAGAGATGAAGAATTAAAACAGGATTTTAAAACACTCATA
AAACAGGGAATAAGCACTAAAAATGCAAGTGTGGAATGTGCTAAAAAATACGATTTAAGT
TTAAATGCGGTGTATTTAATCACTAAAGAATTGAGAGAAAATTTAGAACCAAGTTTGTTT
TAGCTCTCAAACTCCACGCTAATTATATAAGCTTGGTCATTAAAACTATGACTCACGCTT
TTAATACTAAATTCATAATGATCCATATTAATATCTTTAATCTTAAGTTTTCCACCTGCT
CTTATTTCACGCCCAATAAGCTCACATCTTCCATTTAATCCACCTTTTTGAAGCTCATTG
AGTTTTGCTTGTGCTTTTTTAAAAGCTTCATTATCATTTTTGTTGTGTGAGATTTGCATT
TTATATATATTCTCCCCACTTCCTACTTTTATGCTTTTTATCTTTGCCTCATTTATATCT
TGCCATTCTGCTATTACGGCACTATATTCATTTCTAGCACTTTCTGAAATTTCTAATGAA
ATACATTCTTTTAAAGCTATTTCAAATAAAGGTAAATTTTCATTCTTGCTTGTGATATTA
GCAGCATTATCGCCAATCTTACCATCTTTTGGAGTAATGATTAAAGTATTTTCTTTTACA
CAGCAAATAAAACCATAATCAAAGCATATACTATATAAGAATTCTAAATTACTTTGATTA
TTTTGTAAAATACTTACTATATTTTGATCCTCTCCACTTGTTTTGATTTTTAGATTGTTT
TCATTTGCGATTTTTCTTGCTATGGTAAAAAGAGTAGTGTTTTCAAAGCTTCTTGTCTTT
TTCTCTTTTATATTAACGCTGCCTTTTCCACTAAAATTAATAGCACTTGCTCTAACTTCA
GTAGTATTTGAAGTATAGTTTTTACTCACTACATTCACACTAAAGCTTCCACATTTATAA
AGCTTTTCAAAGCCAAGCCAAAGCTCTAAACTATCCCCAAAAAGTGGCTTGGAATAAAGC
CCAAAAACACTTAAACTTATCTCATCACTTTCAGCTTTTTCTTTATCTTCATAACTAATG
TTAATAAGATTTTTAGAAAGTTTTTCTGTGATATCCTCACCTTTGGCAATAAGTTTAAAC
TTAGGTTTTCTTACCATAAAGCCTTTTCCTTGCTTTCTTTGATTTTAATACTAGGTAAAA
TCACTTTATCCCCTGTTTTAAAAGAGGCTCTAATCTTGGATTGGCTAATAAAACTTGAT
TAAAATACAAAAGTGTCCCATAATGCTTATAGACTATACTATCAAGCCTCTCGTTGTTTT
TAGCTATGTAAATCTTACTCATCAAAATCCCTTTCTAAATCCATGCTAAAGCTTTGTGCT
ACAAAGCCACTTCCATCTACAAATGCACTTCTGTTTTCATTTAAGGATAAAATCACAAAT
TTACCATAATACTTTCCATTAGCTCCTGTTAAGATAAAAGATCTTTGTTCTTTTGCCATA
TTCTCAAGCTTATCTAAATAAGTATTTCTATCCCCTTTTAAAGGTAAAGTTTTGCCTTGT
ATTTTAATCTTTTCGCTTTCTTTAGAACTTGCAAATAAAGCATTATGATTATTAAGCCTA
TTTTGACTTTGTATGTTATATTCTAAGCTTCTTTCTAAATTATCAAAATTTAAAGCTTTA
AACTCAAATTCTCCTAAAGCTAAAACCATTTAAACTCCTTTTTAGTTTCATCAAGCTAAA
ATTATCTTAATTAGATAAGGTTGATACCTAAAATGTAGTAGTAGGATAGTCCAAATTAAT
TGGGGTATGTATTGTGAGTGCAAGTCTCACCGCCTTATCTGATCTTAATATATGTCTTAT
TATCTTTATTAATCGCTTCTACTTTTCCTAATGTAACTATTGCATTGGTTTTACCAAACT
TCTTTAGCTTATAATCAGGGGTAATTACAATTTTATTGATACGACTAGCATCTTTTTTAT
CTTCAAAGAAATACAATAAAGAATTATTTGCATTATCCCAATAAACTTCCTTTTGCTTCAT
CTAAAACTTTAACAATTTGCTTGATTTCATCCGCGCTTAAAGCCTGATTATAACTTGCCT
TTCTTTTAGGACTTGCGTGTAAAAGATTGTTTTTGCTCAGTGTAAAGTATAAGTCTTCTA
AGTCTTTTTTATTAAGTTTTTCTAAAAACTCTTTGGTGCTTTTATCCATTTTACCTACTT
GTATGAAATTGATAGGATATTTTGATTATCTTTAATGATGACTTCATCCACCATATCAT
CTAAGCTTTTTTGCCAAGTGTACAGTTCTTTTTGATGAGTGAAGCTTTTAACTTCTTTTG
TTTTTTTAGCCGCTGCACTTAACATATCAAGTTTATAAAGTTTTGAATGACTTCAGTGT
TTTTTTTGTTTATAAAGCTCATCTAAAAGCTCTTCATCATTAAAGCCATTAAATTCGCTTT
CTTTGGCATTTGATGGTGGTATTTTTAGGCCTTTAACTTCACTTTCACCTACTTCTAAAA
```

FIG. 17BG. Continuation of (CJLB-15-1 [organism=Campylobacter phage CJLB-15] partial genome contig_1)

```
CATAACACCTGCAACCATAATCATGCATAGTTACATGCGGATAATGACTATCCCAAAAAG
GATCATCTTTATGTAAAACTATGCCATCAAAGGCTCTGTGTTTGTCCCTAACCAAAGAAT
CTTTTTGGGTGCAGTATTTAAAATAAGGTTTAGTGCTTTTCATTTGATTTTCATAGATAG
CTTTAGCTTTAGCTTTTCTTGAGTTTTCCTCAAAGATTTTTTTTAATCTTGCACTATTAA
AATGAGTTTTTTTAACTTCACCTGTTTTAGGGTTTATAACTTCCTTTGAACCCCACCAAC
CTTTAGCTTTTAATTTCTCCTCTGCAATCTTACTCCAAGTGCTAAATTTATCCCCATTTT
TAATAGCATTTACTAAAGTATCTTGCATATCTTTTAACAAGCTTTCATCCATAAGCTTAG
CAATAGTAAAGACTTTTTTATGGGTGAATATGAAAGTTCATCATAATCAAAACTAAGCT
CTGGCTTTTTATTTTTAAAAAATCAACAGCTTTAGTAGGTTCTGAAAAAAATCCTATTT
TTGCACCTGTCATTTTAATCCTCCAAGTATCCTAAAATACTGGAATTATTTAAAGCTATA
AAAAGATGTTTTCAAACTCGCTTTGCTCTAAACTAGAAAAATTTTCTTTAAGTTTATTG
AGTGCCTCGTTAAAATCTTTACAATCTTTTACAATGCTTTCAAATTGCTCTTGAAAAAAC
TTTGACATGCTCTCATCGACTTTTAAGTATTCTTTTTGTTCTAATCCTTTGTCAATAAAA
TCTTCTTCAAAGCTCTCTAACTTTACTTTGTTTTCAAAGACTTTTTTATCATTTTCTAAA
TCTTTAAAGTCTTTTTTTTCTAAAGTCTCTCTTATAAGCTCACCCTCTACATTATAAGTG
TTTTTAATGTATTCTTCATCAAAGCAAAAGCCCATGTTAAAAAGTTTTAAGTCCCTTTCG
CAAAGCTCACTTTTTGGTTCTGCTTCGCTAAAAAACTGCACATAGAGTTCATCTTTAAAA
TGATTGATTTCTTTGAAAAACTTAATGGCACGATTTAAAATAAAAAGAACGATTTGTCCA
TCTTGGGCGGCTAAATCTTTTCTTATTTGATTATGTGATTCAGCCGCTGCTAAAGAACCT
CCGCTTACTTGAGAACTTAAATTAGCTCCTAAAACCACGCTTCTTATTTGATTATCTAAG
TAATCTATTATTTCATTATAATTTGCCTTAGCCTTTGGCTGGATTAAATCAAGCTCTTCT
TCTTTATCAATGACCGCACTATCGCCATTTAACATTTGATGAATTTCAGAAGCTAGTGCA
TCAGGATCGCTATCTGTTTTTGCAACTGCCCAAGGAGAACCAAATCTTTCTAAAAACTCC
ATCCAAAACTTTAAACTTGCATTTTTAAGCTTACTGGAAAATAAAGCTTTGTTAATAAG
GCATCGCCATTTTTAAATAAAAAATTAGAGCCAAAAAGTCCATAAAATTGCTTTTTTATCT
TCCACAATTTCTTCGCAACCATTGCTATTATAAACTAACTCATCATTTTCATTAAAGCCA
AAATTTCTAAAATCTCTTTGTTTTAAGATTGGATAGTAAAAACCATCTTTTAACTTGTAA
TTAACTTCAAATACATTAAGCCCATAAAGATAGGTTTCTAAGATTTGACTTAATAAATCA
GGATTGAAAAGATACTCAAAGCTTTCTTTTATTTTTCGTTTTCACAAACGATTTGAAGC
TCTTTTGCTAAAATCACACTCCTTCGTGATTGATGAGCTTGAGTAAAGCTTAGATCTTTA
AAAATCATTTTTTGATCGTTCTCGCTGATTTTAAGCACATTTAAATAGCTTGAGTTTATA
AGAGTGTTTATAAGACTATTGTTTTTTAATATCACTTCTCTTTTGGATTTGATTTCTTTT
TTCATATTTTTCCTTTAAAAACGCCTTATTCTTGAAACAGAGTTAAAATGATGCTTTCTT
CTTTTAATGCTACTTTTAGTTCTTGCTAATAAAAATGCTCCTGCTAAGCTATCAGGTGCA
TCATCATTTTTCCCTTCTGGAAATTCTAAAAGTTGATTTATAAGCATAGTTTGGCTTTTA
TGTAAAAAAGCTCTTCATTTTCAAAAGCAAGGCTTAAACTCTCAATGCGTTCAAACTTG
CTAACGCTATTATTTTTACCACGCAAAGGCAAAAAAACTCCACTTTCTAAGCTTTTTTCT
TGTAACCATTTTTTTAAGAAAAATTGACCGCCATTAGTTTCAATTTCAATCAAGCGACAT
TTATAAATCTTTTGAAGATTAAAAATGGTTTTTATAATGCTTTGTGCTTTTAAGATTTTT
ACGATGCTTTCTGCTACATAAAAAACCCTTTGCACCTTTGCCAATAATGGTAATCGCAGTA
AAGTCACTTTTTGCTTTTTCTCCTGCTGGGTCAATATACATATAATACTGATTAATGGCA
GGTAAATCATCATAAAAATTAATGCCATCAAGGCTAAAGATTTGATTTTCACTTCTTGGA
TTATTGAGTTGCTCTTTATTAAAAGCTTTTAGATTTTCAGCCCTTAACTTCATTAAATCT
TCTAAGCTTTTGGCTTCTTTCCAAAGAACTTTTGCCCCTTTATCCATTAAAACTTTATTT
TTTAAATAAAATTGATGAGCGGTATTAAAATCAGCATTTCTATAAAGCATGGCGTATTCA
TCCCATAAATCAAGCCTTTGTGGAAACTCTTCGATGGAACGGAAGACTTTAGGATTCCAA
AAACCAAGCTTTAATTTTCTAGATAACACGCTATCATTATGTAAAATGGTTCCAATATAA
AGCACATCTAAGCTTCCATCCGCACTCCCTAAGTTTAAAACCGCTTCATCCACCCAATCT
TCTAATTTATCCCTTTGATCTTTACTCCTGACATTAGTATCATTTCTAAATCATCTAAA
ATAACTAAATCAGGTCTTTTAACCCCATATCTAACCCCACGAAGTCTTTTACCACTGCCA
AAGGCTTTAATCTTTACGCCATTATTACTTACAAACTCTCCTACGCGCCAAGTCTTGCCA
ATTCCTACTACTTCGGGAAAATCAAGCTTTAAATGCGGATTATCTTCAAGCTCTGCTTTA
ATAGCTTCAAGCATTCCTTCCATAAGTTCGACCGCATCTGAAATCTCTACTATAAAGCTT
TTATAATTAAAAACTAAGCACCACAAAGGAAAGAGTTGTGAAGTGTAGGTGGATTTACCA
TGAGCTCTTGGTGCAGCTATGGCGTGTTTTCACCTTTACTTTCTTTTTTAAGTGCGATT
TTTGTAAAAACTTCATTTAAGTGCAAATGTAAGCCACATTCTCCTTTAATGGTAAAATAA
TGCGGAAAATAAGTTCTTGCAAAATAATCAAAATCCACACTCGCTCTTTTAATTCTTTCT
TCTTTTAAAGTAGGATCTAAATGGCTTTCATGCAAAAATTGAGTTTTTAATTCATTTTTT
AGCTCATCCATCCATTCTAAAAAGTCTTTTCTTTGCATAGCACCTTTTAGTTCATTTGGA
GTGTTTTCGTGCTTTTGTTCGTTTGAGATTAAAAACTCATCGAGTTCTTCTTTGGAAAAA
AGCATTAAATATCCATTGCTAAAATTTCTTTTTCTATCACTCCACTTTCTAAAAGTGATA
CAAGTTTTGCTACGCAATCTTTATCATTTTTAAATGACTTATGATAATTTCAACCACTT
TTTTAGCAACATTTAAACGATAGCTACTTGGATCTTCTAATCTTGCAACCTTTCTCATTT
TTGAAAAGCTATCGCCTATCCTTTGCAATGGCTTCAGTTTTCTTTTCTGCATTCATTTTTT
CATCAGTATTTATATTTTCAATCGCACAAAACATTTGCTCAGTAAAACTTTCATATAATG
AGGCACTTTCTTTATCTTTTATTTTTGAAGTTAAAAGATTAGCTTTTTGCTTATCCCAAT
```

FIG. 17BH. Continuation of (CJLB-15-1 [organism=Campylobacter phage CJLB-15] partial genome contig_1)

```
CGCCATCTTTGGCTTTATAGTTTCTAATCGTTTTTTCATTGCGGTTTAAAATTTTTGCAA
TTTTAAATATATCAAAACCTGCAATATAAAGTTCTTTTGCTAAATCTTTTAAGTTGTTTT
GAGACTTCGCGGATGAAGTAAATTTATCCTTACGAGCAGGAGTTTCACTCTCTGCACCCA
CCTGAAGGCCACACCCGACCTTTGCCATCTTAGGCTTTGTGGTGGAAGTTAAATTTTTAG
CCATTTAATCTCCTTAAATCCATTCTTTTTCTTTTAATTTTAAACGCTCTAAATTTGTTT
TGTGGAATAAAGTTATCTTCGTTGATTTCAGTTGGAATTTTTTTATTTGCCATTTTTAAA
AGTAAATCATTAGCCCACTCTCTAATCTCTTCTAAGCTTTCTTTTGGAAAATCATTTCGG
CGTTTTAATTCCATAATTGTAAGCTTTACACAGATATCTTTTAAAAGAGGAGTTGGGTTT
TTAGGTATCTTTATAAAACTTGCAATATAACTTTGTGCATCATTAATAGCATCATCAATC
ACTTCTTTATCACAAACCCCGTCAGCATTTAAATCGCTAAGCTCTGCTATGGCATGAACG
CTTAATTCTTTGATTAAATCCTTTTCATCTATCATAAAAAAATGCGTTTTAGTTTCTGTG
ATAAGCTTTTCTTCTAAAATGTCTTGATAATTCATTTAAAAAAACCTTTTTTAATGTGGT
TAAAATATGGTTAAATCGTTTAAAATCTTTTTCTAATATCTTTTTAGCTTTAAAAGCAT
TTTTTGCCTTTAAAGCTAAAATTGTGCGTTTTACTCTAAAACAAGCTTAATAAGTCCATT
TGGTCTGGTGCAAACTGGCATGGCTCTCATTTCGCCTACAATTTCAATTCCAGCCCCACG
AGGTAAAATCTCAGGCTTAGAAACAAACATTAAACTTGGTGCTTTTCCTAAAGCATCAGT
ATGATTTGCTCTTGTATAATAAATGCGATTAGAATTATCCTTTGGCACAACCATACCCTC
AGTGCCTTTTAAAAATTCAACGCTTTTTCCATTTGTATTTTTATATTTTGCACTATAACG
GCGATATTTGGTGCCATATAAAATTAAGGACTTATCTTTCTCATCCCTACTTGCAAGATG
ATTTTTATAAAGATCTTCGCTTAATGCCAAGTTAGAAATAGCCGCAAAAAGTTCATTTCC
ACAAAGCACTTCATAATCAGCACTTGTTCCAAATTCATCAATAATTGCTGAATCAATCGC
ATCACAAACACTGTCTAAAGTCACACTCCCATCTTTTTTAACACTAATAGCTTTCTTACT
TGCACTTCCAAAATCAAAAGCACATTTCCTTTGCCATCTAAAATCTTGCCAAATAAAGC
ACCATTTGCCATATATTCAAGCGTAGTATTAAAGCTTTCTTTCATTTCTTTAACCAAAAC
CCCAAGAGCTCCACTTAAGCTTTTAGCCTGAGCTTCTTGCAATGCTAAAGACCTTAAGA
ATTAATCTCACTCGCACTGATTCTTTTTGCTAATGCAAAGCGTGGTAAAGGTATATTTAA
AATATAAGCGTCTTTAGTATTTTCTAAAGAATGTTCCCCATTATCTGAAATGCTATTTAA
AACAATTCCAGCACCTTTTATAATTTCAACCCTTACGGTGCTCTCTAAACTTGGGATTTT
ATCCTTAAAAAAGTATCACTTACAAAGCGAGGTGAAGCTTTGGTTTGATTAATAACTTC
AGTTATTTTTGTACTTGAAAAAAGTTCCAAAAGTTGCTCTAAATCCATTTTTACTCCTTA
GTATTAATAATTAAATTTGCATAAAAGCCTTTTTAACCGCACTTACATGAACGCCTTTT
AAATTGATTTCTCCTGCTAATAAAATCCCATAAATTCCAGAACTAAGAGCGTGATCTTTA
AGCATTGCTAATTTAACATTTTCTTTTGCACTAATATCTTCATTTGGACATTTTTTAAAG
CTTTCTCCAAAATCTTCGCTGATTAAAAGCGTTCCAAGAGCTAAGCTTCCATTAGTTTCA
AGATCTATTTTCGCATTAATTGAAAACAAATCTTTATTGATAAAACTTTCAAGGCTTTTT
GGCATAGCAATTAAAGGATCATTGCTTAAGCTTTTTGGTGTGACCTTTGATGGCATTTCT
TCTCCTTTTTCATTTATAAATTCCTTAGTGGTTTCATTTTCACTCACAGCTTCTTCATTG
ACTAGGTTCTCATCTTCTAAAGACAAAGCTTTAGGTAAGTCTCCAGTTTCCAAGTCTTCA
TTTTCTAGGTTTTGGGTTTCTTTTTTAGCTTTAGCCATTTTTAATCCCCTAACATCATTT
TCACAACATCAAACTCATTAGTTTTTGCTGTGTTTTATTTGCAAAAACATTATTTTTTG
GAACTTGCACTTGATCATTCTTGGTATCTAAAAAGCTTTTAAAGCCTTCTAAATCCTTAC
AAGCATACATTAGCGCCCATTCTTTTTGGGAATTAGCAATTTTTCCGCTATTTAAAGCAT
TATCAACTAAAGAGCTTGCTAAGTTTTTAACGCTTTCTTCGTTTTGTTTTTTAAAGCTT
CATTTTGTAAAGCGAGTGAGCTATTTTCATTTTTTAAAGCTATAATCTGAGATTCTAGCT
CTTTGATTTTTCATCCATTTTCTCTCCTTTGTTTTGATGAATATTATTTTTGTTAGCAA
TGAGTTCGCCTAGCTCATCAATAAATGGTGTATTAGTTAGTGCGACTGAGTGAAGCTTAG
CTCTTACTAGTTCTCCACTTTTATTGTCTTTTGAATTAAATTCAAACACAGGGGATAAAT
AGCGGTATTGCTTATTTGCTATATATTTTTTAGCCTCTTCGTTAAACTCAGCCTTAGCCA
TTAAGGCATCATTTTCCAAATAAAGCTCTTTAATCCAACCTGCAGCAGGTGCTTTTCAT
TTTTTAAGCTTTGATGCTCATAGTCAATAACCAAATCAATCTTTTTTGATTAAAATTAT
CAATCATTGAGTTTAAATCTTTATCATCAACCTTAAACCTGCCATTATTATGCCCTTTCC
ACTCACCCTTAATTGCCACTTTTATGGGCTTATCATTGCTAACTTCGACTAAATTTTCTT
TATTGATAAAAAGCATTTAAATCCTTAAAAAATCATCTTTTGGTAAAAAGCTACTTTGC
AAAGTTCTTGCATAAATGCTTAAATAGCCATGATCGCTTATTCCTTCGTAAACCTTTTA
AGATCTTTAAGCTCTATTCTAAAACCATTGCTAGGTTCTGCATTTAAAAGCACTTTATCA
ACAGCTTCTATTGCATCAAATAATTTATGCTTAGCATCAATTCTGTGTTTAGGAGCTTTT
GATTTTGTATGGGTTAAAATATAAAGTTTCCAAGTTCCCACTTTATTTTCTAAATCTTTA
TAACTTTCTCCTTCAAAATCAAGCAAAAGCGAAGCATCTAAATTATTAATACAACTTGCT
ATGTTTGGGTGTCTTCAAACTCGCCTAAATACATTCTTACTTTAAAATCTTTTAATAGT
TCTAAAAGCTCATTTTCAAAACTTTTAAGCATTTTTCATCCTTTAAAAATTAGCGGCAAT
TTTAAAATGAGTTCTTTTTTTAATCAAGCAAATTATTTTTTCAAAGAGTTTAGCACAAA
ATTTTTCTAGTTTTTGGGTCAGCTTTTTAACTAAACTTACGACATTTTAAAGGAGTGAAA
ATGAAAAATAACCCTTATTTTAAAGAAAGCGAATTTAAATGTAAATGCGGCAAATGTGAA
TTGCCTCAAAATGTGCCAAGTGATGAGCTTATAGACATTCTTTGTGAAATCAGAGAACAT
TACAATGCTCCTGTTATTATAAATAGTGGATATCGCTGCAAAGAGCATAATGCAGAGGTT
GGTGGAGCCCCTAAAAGCCAACACGCTATAGGAAGTGCAGCGGACTTTGTGGTTAAAGGA
```

FIG. 17BI. Continuation of (CJLB-15-1 [organism=Campylobacter phage CJLB-15] partial genome contig_1)

```
GTTAAAACAGAAGAAGTTCATCAATATGTTTTAATCACCTATGGCGAAAGAGGTTTAGGG
ATTGCTATAAAACATAATTTTAATGATCCTTATGCTGGGTTTGTACATTTAGACACTAGA
GGCAAAAAAGCAAGATGGACTTATCCATAAGGAAAAGATTGTGTTTAGTTTTATTTTATC
AAGGTTTTTAAGTCCTTCAAAAATAGCTTTTTTTGTTCTAATTGCTCTTTGTGGTTTTTT
ATATTTAAAAAACAATGCTTTAGCTTTAGAAAATGAAAATCTAAAACTTAAAGCTTTGCA
TTTTAACAATGAAATCAATGTTTTTAAAGATAAATTAGCCCAGCAAAATAAAGCTATTGA
TAAATTAAAACTTGATTTAAAGCCCAAGAGACTTTAAAAGAAGTTTTAAAAGTGGATAA
GGTTTTATTAAAGATAAAAGCTGTGAGAGTGAACTTAAAGCTTATAAAGAATTATTTAA
TATTTTAGGAGCAAAAAAGTGAATGATAAAATGAGAATTTTCCTATTAATTATACCTTTT
GTTTTTTTAAGCGCTTGTGCTTCTAAAGATATTTTGATTAAAACTGAAATCAAAGAAGTT
AAAGTTCCTATTAAATGCCCTTTAAAACTTCCTTTAAAGCCTTTAGACAAAAAAGACTTA
GAAAGTGCTAAAGAAATCTCTAAATATTACTTAGAAGTTGAAAATATAGCCAAGCTTTGC
ACAGGAGAGAAAGATGAAAGAAAATAATAAAATGATAAATCAAAAAGCATTGCAAAAGA
TCTTCTTATAGCTCTTTTGTTTCAACTTTTGCATTAGCTTTATTATATTTATTTGAAAT
TTTTACAAGGAGCTAGCAATGAAATTAGAAGATATATTTGTATATATGGTTTTAATGATA
GTAAGCTTTATAGCTGGACTTGTAGGAATTGTAACAAAAAATAAATTAAGCAAAGCTCTT
AATTTAAAAGGTAAATTTACACTCTTTTTAAAAGGTATGCTAGGTTCTATGTTTGTAGCA
TATCTAGTTTTTGAAATTGTAAATTATCTTAATTTTGGCATAAAGCTTAGCGTTGCAGTG
GGTGGTTTTGCAGCTTATATGGGGACAGATGCATTGCTTAAAATTGAGCAACTTGTAGAA
AAGTTAATTAATAAAAAAATGGAAAAACTATAATGAACGAACTTGGCATCATTTGCGACA
TTAAAGACAATAAAGCTAAGGTTGCTATTGGAGATATGGTAACGGATTTTTTAAGTGTTT
TTCAAAGTCTAGCTAATTCTTATGCAGTGAGCTTTTCTCCTTTAAGAATAGGAGAGCAAG
TATTAGTCATACCTGTGCGTGGGGATTTAAATAGTGGAGTTATTTTGCGTGGTCTTTACC
AAGAAAAACATAGAGCAAAAAATACAGATGAAAATACTTTTAATATAGATTTTGAAGATG
GAACGCATTTAGAATACAACTCTAAGAGTAGCACTTTAAAACTTGATGTGGTTAAAAATA
TAAATATCGCTTGTGTAGATAAAACCACCCATAACCAAACAACACCTTAAATACTAAAA
ATCATACTACAAACGCTAATACCATAACGCTTAATGCTCCAAGTATTAATTTAAATGGTA
ATACTCAAATTGCAGGAGCAATTTCTACAAGTGGCGAAGGTGGGGCAAGTGGTACTTTTA
GCATAAAAGGAAATTTAAACTTAATAGGCAATTTACAAGTTAGCGGAAATATAAGCGATA
GCAAAGGTGATTTAACAAATCATACCCATTCTTGTACTTGTGGTGCCACAGCTTCGCCAA
GATAGGAAAAACTATGAAAGAATTATTTTTGCTTTTATTTTCATTAGTCTTTTTTATGCT
CTTTTGCATGGGGCATTTTATGCTTTTTTAAACCTAAACTTTTTTATCAAAAGCATTTT
TATAGGCTTTTTTATAGCTTTTATGTTTTTAGGATTTTCGCAAATGCTAGAAAACATTTT
TGAATTTTACAAAGGTTTAAAATGAATTACATGGTAAGCATCGAAGAAAGTATCAAAGAC
ATTTTAATCACTCCTTTAGGCTCAAGAGTAATGAGACCAGAGTATGGTTCTTTACTTTAT
ACACTCATAGATAGAAAAATCGATGATGATTTTAAGATAAAGCTTACTAGATACACTGCA
GAAGCAATTTCAAAGTGGGAAAAAAGAGTAAAGCTAAAGGTGTGAGACTTAATGAGTGT
AAAGACAATAAATTAAGCATTACCTTGCTTTTTGAAAATTATGGGGATTTAACAATGGAG
CTAGGCAAATGAGTGAGCTTTTAAGTGCAAATGATAGCTATTTTAAACAAAGCTTTTTAA
AGGATATCCCTTATCCACAAATCATAGAAGAGCTTGATTATGAAAAGCTTTTAAAAGCCT
ATGAAGAACTTTTTAAAAGCTTTTTAAAAGATAATGTAGAGCTTTTAGAATCTGACCCTT
TTAAAGCCATTTTAGAAGCTTTAGCTTATAGAGAAATGATAATTAGAGCAAGAATTAATG
AGAGTATAAAAGCAACTTATCTTCATTATGCAAAGGGAAGTGATTTAGATAATGTAGTAG
CTAATGGCTATTTGATACAAAGGCTTAAAGGGGTTAAGCCCACAGCTAAAGTAGAGTTTG
AATTAAATACTTTACTTACCTATGATGTCATCATCCCAAAAGGTGCAATTTTTTCAAATG
AAAAAGCAGACCTTGCCACTTTAAAAGAAGAAGTGGTGATTAAAAAAGGGCAAAGTAAAG
CACAAGGTATTTTAGAACTTAATGAATTTATTCAAAGCAAAGAAAGTAAAACCGAGTTTT
TACAAACCCCACTGCCTTTTATAGCTAAGATTAAACAACTAGAATTTTTCAAAGGTGGAG
CCAGTGAAGAAAGTGATGAAGCCTTAAGAGAAAGGGCTGTAATGAGTGTACATCGCTTTT
CAACCGCAGGAAGTGAAAAAGGCTATATCTATCACGCTTTAAGCGCAAGTGCAAAAGTAG
CTTCCATAAAAGCTTTAAACAATGGAGCAGGAAAAGTAAGAGTTATCATTAAAAGTGAAG
ATGAATTAAGCGTTGATGTGGTTAAAGAGTATTTAAGTGCAGATGAGCGAAGACCTTTAA
CTGATGAAGTCAGCGTTGAGTTAGCTAAAAAAGAGAGTTTATCGTAGATGCCAAACTTT
TGCTTTTAGAATTAAGCCGTGCTAATGAAATAAGTGAAAAGATTAATGCTTTGCAAAAGG
ACTTTGATTTAAGTGTGGATTTAGCACTGGGATTTATTTATAAATGTCTTCATCAAGACG
GAGTTTATAAAAGCGAAATTTTAAGCATTAAAGAAAAAATCATAAATGAAGAAGAGCAAG
AATTAAAAGACTTACCTTTAGCAAACATAATAATAGCTGATGATGAGTTTGCAACCCTTA
GCTTTTCACTTAGTTATGAAAAGGCGGTGCTATGAATACACTAATACTAAACCACCATCC
AAAACAAAGCAAAGCCATTGATTTAAGTGCTAAACAAGATTTGAAGATTTAAATTTAGC
TAGTATCACAAATCTAGCTCTAAATTGCGATGAAAGATTATTGCCAATTTTAGCCAATGC
TTATGATGTAAGTATTGATGGTTTAAATGAAAAAGAAGCAAGAAAGCTAATATCTAAAGC
CTTGCTTTTAGACAGATACAACGGCACAACTTGGGCTATAAAAGAAGCTTTAAGAGCCGT
ATTTCCTACTGCAGTGGTTAAAGAGTGGTTTAATTATGGCGGAAAGCCTTATTTTTTTAA
AGTTAAAGTAAGCACAACTAATGTTAGCTTTGATGAAAGAACGCTTAATACTTTAGAAAG
ACTAATTTATGATTTTAAAAAATGTTAGAAGCGTTTTAGAAGCAATTGAAATAGAGATTAA
AAGTAAAAATGATAGTTTTAATGCTAATGCACAAATAAGTGGAGAAACTATAGAAATCTT
```

FIG. 17BJ. Continuation of (CJLB-15-1 [organism=Campylobacter phage CJLB-15] partial genome contig_1)

```
ACCTTTTCAAACCACTTTTTTAGAAAATGAAATTAAAAGTACTAAAAATGTATTTGGAAT
TTTTATGTGTGAAATAACAAGAACTAATATTGATTTTAAAGGAGTGTATTAATGGCAAAA
AGTGAATACTATACCATACTAACAAAAATTGGCATTGCTAAATTTATTGCTGCAAGAGCA
AGTGGAAATGGTATCAATTTAAAAAGCTTTAAATTAAGTTCAAAAGTTATTTTGCCCAGT
GAAGAAATGCAAAGCTTAGAAGAGATTGTATATGAAGCTAATATTAGTAGCAAAAGCGTG
GATGAAAGCAATCCAAACTATGTGAATTTAATGTGTCATGTGCCAAGCGATGTGGGCGGG
TTTGAAGTTAATGCAGTAGGCATTTATGATGAAGCAGGAGATTTGCTTGCAGTTGGAAAT
GTCCCACGCACTTATAAACCTATCTTAAAAGAAGGCAGTGCTAAAGAGCTTATGATAAAA
ATTGTCATGGAGCTTTCTAATGCAGAGGAAGTTATTTTAAAACTAGATCCTAGTGTGATT
ATGGCAAGTCGTGATTATGTGGATGTTATTAAAGTGGAACTCAATCTTAAAATTGATGCT
TTAACGCAAAAATATGATGCAGAGTTTAAAAAAGTATGGGATGAGTTTGCTAAATATCTT
TTAGAAAATAAATTTAATACAGAAATTGCCAAATATGTTACTTTAGCTACTAATCAAACC
ATTACAGGAGCCAAAGACTTTACCAAACTACCTACAAGCTCTATAAAAGCTACAAATGAC
AATCAATTTGTAAATTTAGCTACCTTAAAAGAAAATCAACTCAATTTAAAAGATCCAGAA
CTTTTAGCATTGATAGGGTTTAATACCTATCTTGATGGAACTTCTTTACTTAAATCTCAT
TCTATGTCTAATAATGTGATATACACAAATACAACAGGAGGAAAAACACCTATTGCAATA
AAAATTCAACAAATCGATAATGTAGTCAATCAAGCTAGTATTAGTATATACATAAATAAT
TCTTTAATAAAAAAAATAAATGCTATACAATACACTAATTCAACAGGTAAATATATTCCA
TTAACACATTATGAAGGTATTTTGAAACCAAATGACACATATAAAATAGAATTGTTTAAT
ATTGTTATGGATAAGCCAAATATTGAGGCAACAATTTTAAATCTCCAATAAGGAGAAAAA
ATGAAATATTTTATAGACAAAAACGATAATAATCAAATTTATGCTTATGAGGATGAAGTG
AGCGATGAGCAAATTAAAACAGGTTTAACACCTATTAGCGAAGAAGAGTTTAATGCTTTA
ACAAGTCCTCCTAAAAGTGAAGAAGAGCTTTTAAACGAGGCAAAAGAATTAAAAATAAAT
GAAATCAATGCTAAAAAAGAAAGCGTTTTAAATGGTGGATTTTCTTTTAAAGGTAAAATC
TATCAAAGTTCTAATGAAGATCAGTTAAGAATTAATGGAGCAGTAACCAATGCTCTTGTT
AATCCTAATTTAATTCCTTATATTGATTGGATTGCGCTTGATAATACAACTACAAGATTT
AGCGTAGATGAGTTTAAACTCTTTGCAAGTAGCATGGCTTATTTTGTGCAAGAGACTATT
TTTAAAGCAAGTGCTTTAAAAGAAAAAGCTAGAAATGCACAAAGCAAAGAAGAACTTGAT
TTAATTGTTTGGGAGAGTGAAAAATGACTAAAGCAGAATTAAAAAGAGTATGCGTAAAGC
CATACGATAAGGACAGGTTTGAAGTGATACAAGATTATGAGTTTGCTTTGCTTAGTTTTA
AAGGCATTGTGCCAAAAGGATTTAAAACTGATGGTGCAAGTATCCCACGCCTTTTTGGT
CTTTGTTTCCACCTTTTAAAAGTGAGTATTTTAGCGCTTGTGTGGTGCATGATTTTTTAT
GCGAAAAAGCAAATTCAAGAACTGATTATAGGACAGCTGATTTAGCATTAAAAGAAGCTA
TGACTTTGCTTGGATGTTCAAGACTTAAAATCTTTGTATTTTATCATTCTTGCAATCTTT
ATCATGCAATAAAATGCTTGATAAAAGGAAAATAAAAAAAGGTGAGCTACCCACGCAGTG
GGACGGGGCTTTAGCAAAAGCGACTTTGGGCGGATTTTATTCGCACAAAGTGAAAGCAT
AAAAAGGAGTTAAAATGAAAGATTATGGAATTCTTTTATTCCAAATATTAATCAAGGCT
CAAAAGAGCCAAGTGAACCTATAGTTAGTGATAAGCTTAATGCTCAAAAAGTTAATGAGC
TTATAGATAAAAAACTAAAGCTTTTTAAAGAAGAGCTTGTTAATAAAGAGGAGCTTAAAA
GTCTCATTCAAGAGATTTTAAAAGATGAGGGTTTTCAAAATACAAACATAAAAATATCAA
AAACCCCACCTAACTACAATACACAAGCTAAAGTAGGAGAAATTTGGGCGGTTGTAGAAA
GTAAAAGCAATTATTTATTTGCACTGCTAATGATAATGATTTTACAAGCTGGGTTGATT
TACTAGGAGATGGTAGCAATGATATTGCCCCTAAAGAAAAAATCATCATCACATTTGATA
ACACTACAACAGGTGGACAATATGGGGGTTGTATGAGTGATTTAAGACTTGGTTTTGAAA
ATGGTTTTGCTACTCCAAATAAAGTTCAAGATGAGTATAAACGCAAAATTTACTATGA
CTAAAGATGGTAATGGTCTTAATAGAAGCGATTTTACTATAGATTCTAATCCTATTGCAG
GAGAAAACCAAATTTTAGGAACGATTAAGACAAGTGGTATTTATCAAGAAACCTATCACA
AAATCGCCCATGTGTTTAAAAAATATAATGGTGGTTCTGATGAGTGTTGCTTATGGTCTA
GCTCAGGAACGAGAGAGGTAAGCATAGAACTTGAAAATACACCAATGCCTAATAAGCTTT
TTGCTAGAGGTAATGGATATTATGGTCAAACAGAAATTACCAATGTAAGAGTAAAAAAT
CCATTTTTATAGGTGAGCAAGAAATTCAAAGTGAAGATTTTAATGTTGAAAAGTTAGAAG
CTAGTGCTGATACTTATGGAGATTATGCTTTTTTATTTGAAATTCTAAACAAGATCAAA
TTGTTATGAAAAAGAGCTTAATTTAAATCCTAAAAAAACAAAAAATACAAAAAATGTAA
AGAAATAAGGAGTGAATAATGGCAGCAAATTATGGAGTTAATTTTAATATTAGCAATGGT
GCGGCAAGTCCTATTAAAGTGCAAAGTGATACGCCTATAGGTATTGCTGGGCTATAAAA
GGTGCAAGTAAAGAAATGATTTACACAAAGGCTGGTTATGAAAGCGTGGATAGCTTTCCA
ATCTTTGCCTTTTCAAATGTAAGCAAAGCAAAAGAATTTGTAAACGATTTAATCAAAGAA
AATAACTTACAAGATTTTAGACTTTTAGATACTTTAGAAGTGTATCAATCTACAAAATGTT
TCTAATGTCATAATTATCAGCTTTTTTGAAGAAAGCGAGGAAAGTGAAAACACTTTAACC
AATATTGTTAATGCCATAGAAGCTTTTAAAAAAGCAAAGCACAAAACAGGCTTTAACCCT
GATTTAATCATTGCTCCTTATTACTCACATGAAGCAGGAGTAAAGGCTAAGCTTGAAAGT
GTGGCAAGTTCTATGAATATCACAGCTATTGTGGATCTTTACGCTACAAATGTTGGCGAA
GCTATTAATACAATGGAGGCTTTTAGCTCTAAAAGATTAATTGCTGCTTGGCCACAGGTT
CAAATCTTAAATACACAAGGAAAATACGCTTATGTTCCACAATCTCCTATCATCGCAGGT
TTAATAGCTCATACAGATGGAGATAAAGAATATGGCTTTAGTGATTCTTACTCAAATAGA
GTGATGAATGGGGTTACTGGCACAGAGTATTTTATAGAGTTTATCAATGGCTTTGATTGT
```

FIG. 17BK. Continuation of (CJLB-15-1 [organism=Campylobacter phage CJLB-15] partial genome contig_1)

```
GATGCAGAAAGACTAAGAAACGCTCATATTTCAACTTGTATTTTAAGTGAAGGTTATCGC
TCTTGGGGTGGGGAAACTAGCCATGAAGATACGATTTGGCAAGATTTAGCTCGTGTAAGA
ACCTTTGATCGCATAGCTCTAGCAGGACAAAAAGCAGCTTTTAAGGCTATTGATAAAAAA
GCAAGTGAATTATATTTTATAAAAATCAGCATTGAAGAATTGCTAAGAGATTAAAAGGA
GCTAAGGTTTTAATTGGCTATGAGGTAAGCTGGGATGAAGAAAGAAACACGATGCCAAT
GTGAGTGCTGGTAAGTTTTATCTAAATATAAAAATGATGAATAATCCAATCGTTAAACAA
ATCACTTTAGAGTTCATCTACTCTGATGAATGGGCGAGTGATTTGATTAAAACTATTAGT
GCGGATAGTTAATAAATTTTTACAAGGAGAAAATAAAAATGAAAGAATAATTGGCGAAG
TTATACAGGAAGGTAATATTTATATAGATGGACAAGGTTATCTTGGAGTGGTTAGAAATT
TAAAATTGCCTGATATAGAACAAGAGATGATTGAAACCAAAGGAGTTTTAGGAGCAAATT
ATAGTAGCGGGGTTTTAAAGCCTTTAGAAATTAGCTTTAAATTAGCCGTTGTTGATCCAG
TGCTTTATGCGGCTTTCTTTCATACTACTTTTAGCGAGATTAAAGCTCCTTTGCTTTTTA
GAGAAAGTGTTCACAAAGGCGGTAAAAACTATGGTATTAGTGCTGAGTTTTTAGGAGAGT
TTATAAGCATAAGTGAAAGTGATCATGAAAGTGGAAAAGAGGTGGAAGCTGAAATTAAAA
TGGCAGTTCATTTTTACATGCAACGCCGCAATAACATTCCAATCATTACCTACGATCATA
AAAACACTATTTTAATGATAAATGGGGTGGATATGATGAGTGATGTAAGAAGCAATTTAA
CCCTTTAAACACTGATTAATCGGAGTTTAATTAATAATACTGGGATTTTAGGATTAAAGT
TTGGCTTTTTGGGCATTGCGTAGCAATGGGTGGGGAAGCCTTTAGTTGCTTCTCAGGCGG
AATTACTTCCGCCATAAAGAAGGATAAAAAGGAAAGAAAAATGAAAGAAAAAATAATCAA
ACTTGAAAATGGCGAAGAATTAAAAATGAGAGAGCCAAATGTGCGTGTACTCAAAAACGC
CACTAATAAAGGTGAAAAAGAAATGGAGCAAACTATTTGTATGATAGCTGCACTTACCAA
TAAGCAAGAAAGTGAAATTGAAGATTTGAATCTTAAAGATTTTAAAGCTTTACAGGACGC
TCTTAAAGATTTTTTGGTAGAAGCAGGAGTTATAGCTTAGAGGCTATAGCCCTTATAAGT
CATACTTTGCATTGGGGATTAAATGAAGTTTTAGATTTAAGCTTAGATGAGTTTGAAGAA
GCTTTAGCAATTTCAAAAGAATTTTTAAAGGCTAAGAGTTTTTGATTGTTTTATTTTTCA
AAAAATAAATTTTTAAAATAGCAAAAAGAATAAAATCTAAACTTATTACAATTAGCCAAG
TGGGTAAAATAAGCAATAAAGCAATGGGTGGCATTATCATCACTAAAATAGCAGTTATGA
TAATGCTTATAAAATAAGAAAAAATAAAAATAGCCATTGTATTAAAAAAACCATCACTTG
CACTTTGATAGCTTATGTAAAAGCAGGTATGAGCGTTGTTAATAATAAGGCAATATGTG
AAATTATATCATCGTTAATAAATTTTAAAACTTTCATAGTAAAGATTTTAAAATACAATC
GCTTAAAAAGGGTTGAATATGGAAAATGCTGAAGTATTGGAATTGGTGTTATTTTAGGA
CTAGCGATTAAAAACGCAAGTGCCGTTGGCAAGGTAGTTAAAGATTTTAGCAATTTAGAA
AAAATAGCAGCAAAACTAAACTCGGCATTAATGGATTGCAAAAGAATTAAACACTCTT
AAACTCAATGCCAATTTAAGAGCGGAATTAAAAGCTCAAAGAAAAGGTTTGCAAGATGAG
TTTTTAAGTTTAGGTAATGTTATTCGAGGTGGAATTATTGGTAAGGGTTAGGAGAAGCT
ATCAGCTTTGAATCTGCTATGGCTGATGTGAGAAAGGTTGTGAATTTTGATGAAGGCGAT
GATATTAAAAAAATGAGTGCTGATATCCTTAAGATGTCTCAAACTTTACCTGTTACTGCC
AATGAGTTAGCAGCTATAGCTGCTGCTGGAGGACAGATTGGACTTGGTTCAAAAGATGTA
AGAGAATTTACAAATCTTGTAACTAAAATGAAAGTGGCATTTGATATGAGCGCTGAAGAT
GTGGGAGATAGCGTTGCGAAAATTAAAAATATTTTAGGCATTTCTTTAAAAGACATGGAG
GATTTAGGCGATAGTATTAATAATCTTTCAGATAATAGTGCATCTAAGGCTAGAGAGATT
ATTGATGTTATGAAAAGAACTGCAGCTGCTGGAAAGCAAATAGGATTTACTAAAGAACAA
ATTGCGGCTTTAAGCTCTTCTTTTATATCTTTAGGTAAGGGACCTGAAGTAGCAGGAACA
GCTATTAATAGTCTTTACCGCGTTTTAGCCACAGCTGATAATATGGGAACTAAAACTGAA
TCTGCTTTTGCAAAGCTTGGTATAAGTGGAGCATTTTTAAAACAAGCCAGTTTTGATGAT
CCTCAAAAAGCTTTAGATATGTTTTACAAAGAATTTCAAAACTAGACCAAAAAGAACAA
ATGGGCGTTTTAGTTGATATTTTTGGTCGTGAATTTGCAGATGATATGGCAACTCTTGTT
GGAGGGCTTGACACTTATAAAGAAGCTTTAAAAAATGCTGGTGATGAAGCAAAAAAAGGC
TCTTTACAAAGGGAATTTGATACAAGGGCTGCTACCACTGAAAATTCTATTATATTAATG
AAAAATGCTTTTAATTCCTTAGCTGTTAATTTAGGTTCGGTTTTTTACCTGCAATATCA
TGGGTGAGTGCTGGAATTTCTTATCTTGTTAATAGTATCACTTATATCACAGGACTTGTC
CCTGGTCTTAATGGGGTTTTAGGAGGACTTATAGCCACTTTTTTGCTCGCCAAACCTGCA
GTCTTAGCTTATGCTATTGCTAAAAACTATCTTAAAGATTGCACCATTTACTTAAAAGT
GCTTTGATTAAAACAAGAATACATCTTTTAGCTTTTCGTAATTCTTGTATATTATCTAAT
ATTACTTTAAAAGCAAAAACCGTCACAACTACTATTTACACAACCTCCCTTAAAGCCTTA
TCTTTTGTTTTAGGTGGGCTTAATAAAGTTTTTAAAGCCGTAGCTATTGGTATTAGAGTG
TTAAGCATGGCTATGATGAGTAATCCCATCGGTCTTATTTTAGGGGGCATTGCAATAGTG
GCTGGGCTTATTATTGCAAATTGGGATAAGGTTAAGTCTTGGTTTAAATCTTTTATAGAA
TGGCTTAAACCTGTTTGGGAGCCTATATACAATGTCATTAAAGCAGTATTTGATAAATGT
GCCCTTGTATTTACAAGTTTTAAAGATATTATTATGAGTGTTGCTTCTCCATTAGCTGAG
TTTTTAAATTCTATTTGGCAAGGTGTTGGCGATTTCTTTTATAGTATTTTTGGTTCTTTA
TTTGATTGGTTTGCTTCTAAGCTTCTTGGGTAGGAGATATGATCTCATCTATAAGTGGC
TTTATAAAAGATGCTCTTGATTTGTAGGGCTTGGAGATGATGAAGAAGTTAAGATAAGC
CAAAGTGAACAAAAACAAAGAAAAAGTCTTTACTACAAACATTATAAAGATGAATTAGCT
GAGACAAAAAGTATAAATCATGCTCCAAGCTTTAATAATGGCAATATCAATATAAGTGTT
AATGGTACTTTTAACATAGCGACTAAAGATGGCAATTTTAATATGCAAGAATTTGCAAAT
```

FIG. 17BL. Continuation of (CJLB-15-1 [organism=Campylobacter phage CJLB-15] partial genome contig_1)

```
ACTATACAAAAAAGTGTATTTGACGCTTTAAGAAAGCAAGAACAAAACAAAATTAACACT
ACAATTTATGGATAAAATATGAGTGAATATATAGAAATAAAAGGGCTTGAAAACTTTTTT
AAAGCTTGTGATAAATTAATAGATATGGATAAACACGGGCAAAGCATTATGGCGGGTGCT
GGAGAGAGTATAAGAAATAGCATTATAGACTCTTTTAAAAACGAACGCAGTATTTTAAT
GGAAAATGGCAAAGCTTAAAACCAGCTACCATAAAACAAAAGATAAAGATGGTAAGAAT
AAAGGAATTTTAAAAAGAGATGGAGAATTAAGTAATGCTTTAAATTGGCAAAGCGAACCT
ACCAAAAGCGGAGTAGAAGTCTTTAATAATATACAGACTAAAAATGGCTTTAAATATGGT
TATGTTCATCAATGGGGAAACAGAAAAAGAAAAATTCCTCAAAGAGCTTTTTTACCCATA
GATAATAACAAAGTCTTGCACCCAAGTATAAGAAGTGTGATTTATAAAGATACTAAGGAT
TTTATTGAAAAAATTGTTAAGAAGTGACAATATGGGGCATTGCATAGCAAGGAATGGTCG
GGCGTGGTCTTTAGTGATGCCACTTTTTGGAAAATCGCAATTTTTCAAAAAGTGTTAGCA
AGAATGGCAAGGAAGACTAAAGCCTTCCTTTTTCTAAAAACTAGCAAAAGCATTATAGCT
TTGTTTTTAAAGCAAAGCTTTTTAATTTTATTTGAAAGGAGTTTGTATGAAAAATAAT
ACAGACAAATTTCTAAAAACTAGCACACTTACTAAACCTACAAGAACTACACTAAAAGCT
CCATTTGCTTGGGTGGGTGGTAAAAACTATTTAGCTAAAGAAATCATTGCTTTAATGCCT
GAGCATAAAAGCTATATTGAAGTCTTTGGAGGAGCTTTAAGTGTTTTTTATCAAAAAAGT
GCTTCAAAAATAGAAGTCATTAACGACATTAACGACGAGCTTATTAATTTACATCTTTGT
ATAAGAAACAAACCCCAAAGCCTAGCAAATGTGCTTAATTCTATGATAATAAGTAGAAAA
ATCTTTCATATGCTTAAAAATAAAGAAATTAAACCAAGAAATGACTTAGAAAGGGCTGCT
TTTTATTTTTATCTTATCAGTACTTCTTTTGGTTCAAGCATGGGACAATTTGCTATGAAT
AAACAAAGAGCACCAAAGAGATTATGTAGGGATTTTAGCTTACATACAAAAAGACTTAAA
AATGCCAGTATTGAAAATAAAAGCTTTGAATATATTTTAAAAGAATATGATTACAATGAA
GCTTTATTTTATTTAGATCCACCTTATGTAGGAACTGAGAATTATTATAAAAACACAGGA
GGTTTTGGGCTAAAAGAACATGAACTTTTATGTAATTTGCTTAAAAATATCAAGGGTAAA
TTTATGCTTTCTTATAATGATTGTGAGCTTATAAGAAAGCTTTATAAAGATTTTAATTTT
AAGGAGTTGAAAGTAAGGTATTCTTTAAATAATAATGTTTTAAAAAGAAAAGAAAGTAAA
GAGCTTTTGATTATGAATTTTTAAAAGCTAAGAGAGTAAAAATACTCTCTTTTATTTTAG
CAAAGAGCTTAAAAACTTTAGAGCTTCTTTGCTAAAATCTTTATTGCATTCTTCTAGGTA
ATTTTTATCTAAATAGCACCGTATTTTAATAAAAGCAAATCGCTCCAAATTATTATG
AGTTATTGCATAAAACATAGGCTCTTCGCCCATGCATTCTTTAGTTGCACTCATACCATT
TTTAAGATATTCTAAAACAAGTTCATTGTTATGGTTGCAAATTGCGTTTATAAAAGTCTT
GCTAAAACCTTTTTGATATCTACTATTACTTTACTCATCTTATCTCCTTTTGTTTTGAT
AAGACAAGATTAGCTTTGCTTGGCTGAATGTGTGCTGTTGTTTGACATCTTTTTGAAATC
AATTTGTATTAACCCAATCTTGCACCACATTTAATAAATGATTATAATCACTACTCATGG
CTTCTTTTTGAAATTTACTTATTTCTTCTTTGCTTACACCTGCTTTTTTTAAAGCCTTGC
TTACTCTTGCTAGAATACTAAAAGCATTGCCATCTTCGCCAACTAATTTCACATAAACAT
TAGGATATTTCATCTTTTCTCCTTAAAATTCACAAAAGGTACTTTTTAATTCGTATCTTT
GTTTTTCATCATTATATTTAACTACAAATTTTCTACCTATAATATATCTTTCAAACAAAG
GAACTTGTATAAGACTTTTATCTTCATTCATCTCAAGGTTTTTAGCGATTGAATAAGAGT
TTATGCCCATATTATAAATAGTCATAAGCTCTAATATATTATCCCTAGCAAGATAATCTT
TTTCTTTTAAAAGCTTTTTGTACAAAATCCTAAATTCACTCTCTAAATCTTGTATGATTT
TTTCTTTTAATTCTTTATCGGTGTAATTTTTGATATCTTTCATGTTTATCTCCTTTTTG
ATAGAACAACCTTGTGTTTTACACTCTCTGTGAGATTAGCTTGACTTAGCTTATTGTGTA
CTGTTACATCTTAGAAAGTTCTCCAATTACTACACCAATTAGCAAAAAATCTCCATTTTT
ATAAAATATATCTTCATATAAAGGATTTAAAGAGTGTAAAATCACTCCATCATCTTGTTT
TAAAACTTGTTTTATAAAAAGTCCATCTCTAGTATTAATCACACAAATGCTTTTATTCTT
AAAAGCCTTATTTCTATCTATTACACAAATACTTCCATCTTTTATAAGTGGCTCCATGCT
TTCTCCATAGCAAGTGATAAACTCACACTCTTTACTACCAAAAAGTTTAATAATTTTTC
ATCTACAATAAGCTCAGAGCAATCTATTAAATCATTTATTCCGCCTCCGCCTAAACTCGC
ATTTGTTTTATAAAGCTTTAAAATTTTATATTTATTCTCACATTCTAATTGATCTTTAGG
AGAGACACCATAGAAAAAATAATTAATGCTTATATTCCTCTCATTTAAAAAGTTTAAGAT
TTGTGGATAAGGAATGGAGTTTCTAAATTTCATGGAATTAAAAGTATCAGGATTGATTCC
TAATTCTTTGGCTATATCTTTTGTTTTAAATCTCTTTTGCCTTCACTCGCAAGTATATC
CTTTAACTTTTCAATCACTTCTTGCATTTGCATTTTAAATCCTTTGATTTTAACTTCAAA
GAATTTAAACATAAAATTTCAAAAAGCAATTAAAAACTTTTGATTTGAAAGATTTTTAAT
ATAAGAGCTTGAAAATCTAACTTCAAGCTCTCTAAATTGATATTTAAAAACATCTTACT
AAGCTATTTTTTTAACAAGATTTCATAAAAAATTGCTTCATTACTTTTTAAGTTTTCTAT
GTAACTATCTTCCAAAGCTTAATGCCATAGATAGTTACGTCGTATTTTTATATAAAAGT
GGTTAAACTATGATTATATAGTGTTTTATGGGGATAGTTACATCAATAAGAAAATATAAA
AATACTTTAAGCAAAATGTAACTATCCTAGAGGGTAAAAAACACTTTTGGGATATAAAA
TTTAAAATCAAAGCTCGTGTTTATCCATCTTTTAAACAGCATTTAATCACTTTTTTGGGA
CAAAGCGGACATTTGGGATATTTGGGATATTTTACGCTTTAGATTAGGAAAGATAAAAA
GTCATTTTTGTAAGCTTTAAAATCCTATTATTTGGGATTTTTGCTAAAATTATTTAGGGA TAGTTACATGTTCTTTTTAAAATACCCCTTACA
```

FIG. 17BM. Continuation of (CJLB-15-1 [organism=Campylobacter phage CJLB-15] partial genome contig_1)

```
>CJLB-15-7 [organism=Campylobacter phage CJLB-15] partial genome contig_7
TAAGATTGAAAGTTTTCATCCATTCATTTCTAACATCTTTATTTATAGTATACTCTTTGC
CATTTTTGCCTATAAATCTTAAAGAATTGTCTTTAGGATCAGCTTTATCCATGAAGAAGT
TGTCGCCTTTGGTTAAATCTTTAACTTTTGAATTAAATTCTTTTCTAGCCTCTTGTGCTT
CTTCTTTGAGTGTTTTATCTTTAATACTTTCTATAAATTCTTTAGCCGATCTATCAAAAT
CTTTTAAATTATTTATATTACTAAACCCCCTTCGCATTTGTATTCTTGTTCCAGCTCTTT
TGCCAACTTCCCATAATCTCATAAAATAAAAAGCTATATAATCAGTGAAATTATTAACAA
GCATTGTTTAGCTCTTTCTATGAAATTTGTACTTATTCCATGTCCTAGTTCTTTTGCTT
TTGAATTTAAAATACCATCTATTACAGTTTCAAAGTTAGTACGTAAATCACCTATTGTTT
TTAAAACTTCAATCTTCTCTTGTCCTGATTTGCTTTTTGGTTTAAAGTTTTCAAAATTAT
CCATGACCGCTTTATAATTTACTGCAAATTTGGGATTATTGGCATCTCCTATATTTACTT
TATTTTTTTCTAAAGCTCTAGTTATTATTTGATTATCTAAAACTTTAATCTCATCATCAT
TAAGTCCTTTTGTTATAGCTTCATAATTCTTTTTGGATTAGTTTCATTAAGTATTTTAT
CTATATCTTTTGATATCTCTTTTTCACTTCCTTCTAGTTTTTTTCCTAATTTACTTTTAT
CATATACTTTAAAATCTGCATAATCTTTTCTAATCTTGGTTAAAATCTCTTTTGCTTCTT
GGGGATTATCAGCACTTTTTACTATATTTTCTAAAAATGCGTCTTTTAAGCTATTTAAAA
AATCTTTATAGTTGTAACTTGAGCTTTCTTTTATTTTATTGCCTATAGCATCAATTCTAT
CGTAAATCTCTTTAACGCTTTTACCATCTAATGCACCGCTTTTTGCTTCATGAATAAAAT
TTTTTATCATAGCTGGTGTGCTTTCACTATAAACACTTGAGTTTAAAACTATATCATCTA
TGGTTTGCTTATCTACTTTTACACCATTTGGATTAAGTTCATCTAGTTTATCAAGTCCTT
TTCCAAATTCATCATAAGCTCTTTTTGCTCTAGCATCTCTTAAAGCATAAAGCTCATCAG
CCTTAGAAGCATTATTTAAATTTAACTCTTTTAATATAGCCTCATCTTGTAAGTGTAAAG
AGTTTGCAACCTTATTTGCCATTTTAGGGTCATTTGCTAAAACACTTCTTGCCATATTAG
CTAAATCATCATTCATAAAAGAAAGATTAATAAGATCTTGTTGATTCAGTGCTGCTTCTT
TTGAACCTATATTTTTACTAATATTATTTAGTGAATTAGTTACGTTGTCTGCTGTATTTT
TTACAAAACCATTTTTTGCAGTATTTGAGAAATCTTTTATTTTGCTTGCCACTCCATCAA
CTAATGCATTTCCTTGATTAACTTCTAAAGGCATAGCTCTTGATTTTTGCAATATATCAT
CATAATTTCTATTTCCGCTTTCTATTAGCTCTCTTGCATAAGCTTTTGAAGTTTCGCTAC
CTTGTGAAGCTAAATCATTTAAAATACTAGGGCTTATTTTTCTAAGCTTATCCCCTATAT
TTTCTTTTAAATTACCACCTTTTACTGCCATGCCATCTATCATATCTTTACCGGCTTTGTG
CTCCTGTTTTTGCCATATTATAGGTATTTTTAAAGCTCTTGCTCCTTTGACAACTCCTG
CAAAAGCTGCATCACCTATTAAAGAAAGTCCCGCATTTTCACCCATAAGCATAAGAGCTT
CTTTTAAATTTGCATCTTGATTTGTATCTTTTGTATTTCCGTAGTAATCATATCCTGCCC
CTAAAGATGCACCTAATGCACCACCTGCAACCATACCAACTCCGCCACCTAGCATTGTAC
CGCCAATGGCACCTGCTGTTCCTAAAGCCATACTAGCACCATTATCTCTTAATCCACGAT
ATAAATCACCCATTGCGCTACCTTGCACTTTAGAATAATTTCCGTTATTATCTTGCACCC
AATAAGATCCATCATCATCTTGTAATAATCTTCCACGCCCTGATTTTTGCAACTCATCGC
CTAAATCTCTCATAAACTGATTACTTTTTCTTGCTACTTCATTATCATCAGTAAAAATAG
GTTTAGAGGCATTAAATTTAGATTGCTTATCTAAAATATAATTACTTAAATCATCAGCAC
TCATGGATGGATTTTTATTATAATCATATAAATCCCTTTTATAT >CJLB-15-8 [organism=Campylobacter phage CJLB-15] partial genome contig_8
ACAATAGCTTTTAATAAAAAATTAAATAACGTTTTGCAAAACAATAATGAAGTTTATTTG
GACGAATTTTTAAAATCAATACAGTTTTTTTTACAATTTAGACAAAAAATACAAAAAGAT
GGGCGTAAAATTATTGCTAAAGAAAATATATCTAGAAGAATGTTTTACTATTTTGATTTT
AAAGAGAAAGATGTTATGGATAAGATAATTGATAATATTGATTTTAACCATATTGGGAAT
ATTCCAAAACAGGCATTAATAGAATTTAATAATTTTATGTCTCATGTTTGCACCGCCTAC
TCTTTATCCGATAAAGATGAAAACACTGATATTTTTTAAAAAATATTGAACGAGCAATA
AACCATATTAAACGAGGAACGCTCGATTGTTATAAAATTATAATTAAAGATTATTTTATA
CTTGAAAATTCAACTTTACCTATAGGTCTTATAGGTCTTAAAAATCAATTGTCAACTTA
AGAATTAATGAATATAAAAATTTAGGAAACAATAGTATCATATTTTAGAGCAAATTTAA
AAAATAGTTCAAGAAATTATGAAAACGCCGTATTTAAACTCCTAATTTTATTTGTTATAA
TTTTAATTAAGAACTTAAGGGCAGAATCTCGCCCTTTACAATTGCGAAAGATGTATATAA
ACTTTCACTTCTCTTATTGTAATTCATAGTTTGCAACTATCCATGTATTTGTCTTATCTC
CTTTTCAATTATCTTTATATTTTAAAAAATAATTACATGAATTTATGCTATAATTAATA
ATCGCCATTGACACTACTCACGCTTAAAGTGTCAGTATTAAGCCTAGCTTTAGTGCGTAT
CGGCTAAGCTAGGGGCGATAATATTAATAAAAATTATATGCAGTTATAATCCACTTTTTA
TCTTTACCTTTATAATCAAGTGCTACCATAACTCTACTATTCTTAACATCAATAAAAGCT
CTATTATTACCTTTTTTTACATTTCCATTATTTATAATATTTTCTATTTCTTTTATAAAA
TTTAAAGCTTTATTTTTTGCTTCTATTTTATTTAACCCTTGTTTAATGAAATCTTCTTCT
CTTCGATTGACAATATGACTTAATCCAAAGTTTCCATCTCCCCAAACCAAATCAATATCC
CCTAAATCTTTTCTATGAAAAGCACCTGCTACCTGCCCTTGTTTTCAATGAGTAGTTTT
TGTAAAGCACCTTTTCCATCGTGATAATATTCTGCATAATTTTCGCCAAATTCTTTTAAA
GGTTGTATGTTTAATTCTTGTTCGATTTTACCCCTTAAAGCACTTGGAATATCTTTTTT
ACACCTTTATTTGTGCTTTCTTTGGCATTGATTATCATCTGTCTAGTTAAGTTGTATTCA
ACAGTATTTAAATTCATCTTATCTAAAAAATCAAGTTTATTGTCTTTATTCTCTTTTAGA
```

FIG. 17BN. Continuation of (CJLB-15-1 [organism=Campylobacter phage CJLB-15] partial genome contig_1)

```
AAATTATCATATCTTTTTAGAATATCTTCACTAGCCTTTTTATCATTTTGTATTTTTTA
TCAAGCCTTTGTTTTACGCTTTTTTTATTCTTTTTCTCTACTTCTTTAGCCTCAATATTT
TCTTTTATATCTTCCATTAAGTTTGTTTTAGGTTTAGTTTGGGTAGAATTTTTATCAGAG
AACGACACTTGATTTGTCTCTGAAGATGCCCTAGATGTCGGTAAGGCTCTCGCATTATTA
TAATACACTGCCTCAGCATTCTTAATTTTATTTTTTATATTATTTTGTTTCTTTGGCGAA
TTGCTAATTATAGTCAAATGCGTTTCATAGTCTTTGCCTATACTTGTAAAATAAGTCTGA
TTATCTATATTTTTAATAAAAATAAAATCATCTTTATCTTTTAAGATTGCCTGTGGGCTT
TCTAAAGTTTCTTTGATATGTGGTATGTATTTAATTCTATCTTTTTCAATCAGCTTTAGT
AAACTTCCTTTTGTAAGTTTTATTTCTCTATCTTTTAAAGCTATCTTTGCTTCTTTTGGT
ATATTAGGGATATATTCATCATCGATATTTTAAGATTGAAAG

>CJLB-15-9 [organism=Campylobacter phage CJLB-15] partial genome contig_9
CTAATATTTCCCATATGATTTGTTAAATTTTGGTCTTTGAAATTATATTTTTCATATTCT
TTAGCATATTTATCTTTATTTTTATAAAAATCATTTATTACTTCATTTTTTAAATTTGAT
AAATATTCACTTGTATTTTGATTTTCACTTTGACTTGCTCCATCTTGCAAAAATGAAATA
ATGTTATTTTCTTGTGGTTTTTCTAATAAAAATTCTCTTATATTCATTATATTAATCCTT
GTTTTTTTAATTCTTCTACGCTAACTTGCATTTTTCTACCTGCTTGATTAACTAATATTA
CATTACCATTAGCATCAGGCTCTGATATTTGAGCATTAATTCCATTAAAACTAACGCTAT
GTAATTTTGGTGTATTTTGATTTTGCACTTCTAATGTATTGTTTTGGCTAAATCATTTTGTA
TATTTTGATTAGTTGTTGAATTACCTATAATTACTGCATTTTTACTAGGTTTTGAGTATT
TTTCATCCCAATAAAAAGCTTTTACCTTTGGAGCATAATTATTATAAAAATCCATATTAT
TTTTATAATCTTCTATAGCACTTTGTTTCTCAATATTTGTTTTGCGTTTCCTAGTCTTT
CTGCTAATTCCATTTTAAAAGAGTTTGGAGCTTCTGCTAACCATTCTCCTGCTAATGCTT
GAGCTACCCTTTGATTATTTGCTTCCATAGTATAACCATTAATAGGGAAATTGGCTTGTA
TATTCTCTAAATTCCATTTAGCATTTTTACCACCCCTTAATAAATCACTTTGCATTCTTT
TTAAAAATAAATCACTTGCATCATTTAAATCCGTGCTTTGACTTCCCCATCCACCAAAAC
CACGCTCTATAGCTCCATTCCAAAAACCATGGGTTGTATCATATGTTTTACCTTGATTAC
TTGCTAAATCTAAAAACTGAGCGTCTGCTTTATATCTTGTATTGTTTTGTAAATTTGCAT
TGTTTTGACTATTGAAACCTTGAGTATTACTAAGAACTCCATTTAATAAATCTTGCTCTT
TTTGTTTTGTATTTATCTCATTTTGTAATTTTTGAAGTTCTAATAATCCTTTTTGATAAT
TTAAATCCTTGTAAGCCTTATTAGCATTTATCGCTTGCTGTCTTAAAGCATTTTGCATGG
CATATTGTCTAGCTCTTTGGTTATAATTCATTTGCCATTGCTGATCTGCTATATTTGCTC
TTTCTTTTTGATAATCAAAGTTTCTCTCATTTTGCAAGATTTGATTGTTTTGCATAGCCT
CATTAAATTCCATTTGTTGCTTTCTTAAATCTTGCTCTTGCTGAAACTCATTAGCTTTAA
CTTTATCATCAAAACTTTTGCTCATGATGTCATATAAGACACCACCGACTTTTCCTGCGT
TTTGTATAACGCCTGTATCAGGATTAAATACTACTCTTTGTGGGTTATAAAATGCCATTT
TGTTTCCTTTATTCTTTCTTTTAAAATAAAGGATTTAAGGAAGTTTGTGTATAATTTTAA
AAGGTGTGGTGCCAAGGGTCGCCACCCTTAGCACTAAATTACCACCTAGAAAGGCGGTGA
AATAAGATGCTACAAATCTTAATAGTTATTATACTACTTTGTATTATTGTTGTCAATGCA
AATTAACAATCAATAAACAAAGCCCCTTATACAAGGGGTTAAGATTTACCCTTTAAAACA
AACTCCTTAAATCCAAATCTATTTAATTACTCCAAACACTTTGAAGTTTATTTTCCGTAT
TCTTTCTTCTATTTAATTCTTCATTAGCTAGATACTTATTGAAGTTATAAGCATCTTTTT
GTAACTCATAATTCTTTTGTGCCATCTTTTGCTGATTATAAGCACCATATAAAGCACCAG
CACCGCCTAAAACATTTCCCAATCTATCAAAATTAGTTACTTTATTTGCATCAGAACTTT
TAAATAACCAATCTCCAAAATTGCTAAAAGAATTTTTAATCCATTTAAAAAAACCACTAC
TACTTGCTAAATTTGGAGTAAAATTGCTTGTTTTCATCAAAGTATCTGCAAAGCTAGATC
CTAATCCTGTACCACCTTTTAAAGCTGTTATAAAATCCATAATTTCTCCTTTATACTAAA
CTTAATAATTCTTTGCCTAGATCTATCTCGCTAACTTCGCCTTTTTTTAACTTATCGTTA
AAATCACTAGTTCTTACATTATTATTTGCACTTGATAAATCTTCAGCTTTTTTGGCATTA
TTTGATTTTCCGACCAAATTAAGCAAGGTTTTCCAGCTGTCAATATTACCTTCGCCTAAA
CCATTTAATTTTGTTGCAAGTTCTGCCATAGCCTTTAAATCCGCATCAGGATAGGCTTTT
CTTAACTCGCTTTCTACTTGTGCGTATTTAGCGATTAGTGCATCTTGCTCTTCTTTGTCT
TTTTGCTTTTTATCAAGCTCTTCAAGCCTTTTTAATTTCTCATCAAGTCCATCAAGTCCT
AATTCTTTTAAATACTGCTCTCTTTGTAATTCTTGTTCGCTTGGCTCTTTTTTGGATTT
TTTAAAGCTTCAAGCTCACTCATTAAAGCATTTAATTTGTTGTCATTTTCACTTTTATAA
GCTTCAAACATCGCCTTATAATCAGGCTCGTTCTCATTAGCAACCTGCATAGGTTCATTA
TCTTCTACTTGCGTAGGTTCATCGCCATTATTAGCAACTTGTCCTTTATCATCATCTGTT
ATGACATTTATTAAATCTTTTAAAGCATCATTTTCCATCTTCTTCATCCTTTATTTTATT
GATTATTATGTCTAAAAAAGCCATAGTATCTAAAGCTTTTAACCTTAACCTTCTTTCTCATC
GTTATTTTTTGCTATATAAAAACATTCACTATATTTGCTTTGATAAAATCTATTAATTT
CTTTCCTCCTTTAGTTTTAGATATATCACTTTTAATTTCAATATTAAGCATTAGCTTCTC
CTTGCATTTGTGGATTAATATCTTCATTATTTTCAAAAGCAAATAAACTATTTACATTCT
TTACACCTAAAATTGGTAATAATTCTTTAGTAAGTTCTTTACTAGCATTTATAATCCCAT
AAGCAGAATTTGCATCGCCTATGCTCATATACATTTGATATAATTGTGAAAAAACTTGCA
TACTAGCTTGAATTCCTGCACGTCTAATTTCTTTATTCATGGCACCTGTGCCGGTTTGAA
TTTTAAATCTAAAACTAGGTATATCCTCTCTTTGAAAACCATTAAAAAAACTATCTTCTC
```

FIG. 17BO. Continuation of (CJLB-15-1 [organism=Campylobacter phage CJLB-15] partial genome contig_1)

```
CATACTTAAAAACAAGCATTGCAAATCTATCAAATAAAGGCTCTATAAAAGTTTCGTTAT
ACTGTCTTATGTAGTCAGCACTTCTTCTTCCACCTTCTTGTGCTTTTATGCTAATTTCTG
TTGCTGTTTCATTTTGTGCAGTTTGAGCTCCATTGTTTTGTGGACTAACTCCTATAACTT
CTGTGAGTTCGCTTTCTAAAAGCTGTAAATTCATTCCCGCACTATTTACATTGGTGGTG
GTAATATTTGCACACCCTTTGGATCGTCTGTATATATTGGTTTTCCTAAGGTTTCTATAT
CTTCTCTGCTTACTCCCATTGATTTTGGCATCATTATTTTAGGCATGATATGAGTTCTTA
CTGCATCTATTAAAAGATTTCTAGTTATATTAATTTCATCTTGCAAAGGCATAGCAGAAG
CCATTATAGGCTCGCCATAAGCACTTACATAGTTTTCGTTATCTATCTTTTTAAGTTGTG
GTAGCATTGAACCCCAGATAAAAGGCTGTCCATCTTGCAAAGTAACTTCATTTCTAAGTA
AATTATTTTCAAATAAGGTAGAAACCACCCACTCATCATCGTTTTTCTTTCATAAATAT
CATAAAGCTTTACTTTTTTATACTCATCATCTTCATCAAAAGCTTTTTAATTTCATTTT
TTTTATAAAATCCTAGCTTTTGTCTTTCATGGATTTGATTATAGGTTAGGTAAATTTCAT
TGACTATATATCCTACATCCTGCTATTTAATGCATTTGGATCAAAGAATATACTATCAA
TATCTACTCTTTCAATGCGTGGCATTCCCTTATGCCAAGTAACCTTAGCTATACTTGTTC
CCACAAGTAAAACATCTAAGAAAAGCGGTGAAAAATCTTAAACATATTGATTTTACCAC
TATAAAAATCAATTGCATTCTGCCATAGCTCTATAATCGTATCATCGCTATTAATGTAAG
TTTCAATATCTGCCATTCTCTCACTATTAAAATATACATCATTTAAGCTAGTGATTAAAT
ACTTTACCTTAGCGTTTATTTTTGGTATGTAAATACTTGATTTATTTCTTTTTCTCAATT
TTTGCATTACCTTATTTTCAAGCAAATAAGCATCTTGCAACTCTTTAAAGTGTGGTTTGT
AATTTTCATATCCACTTTTACTTTCGCTAATGAGTTGTGTTAAAAACGACACTCTCTCAT
CATTAGTTCTTTTTGTTTTCATTCATAATTCTCCATATTGTTGTTTTGCTTAAATTTGTT
ATTTTTAAAATATCTTTTTCATTCACTCCTTTTTCAAATAAAAACTCCGCAAATTCTCTT
TTAAATTTCTTTTTAGAAATATTATTAAACCCTGATACAAGCTCTAAAAATTCATTTGCA
AGACTTGACTTTATAGCCTCATCGCTTAAATTTGAAAGCTTTTTTATTTTGTTTACATCA
ATTGCATCATAGATCATTAAAAACTCACCAGCCATCATAACTCCAATCTTCATTAGTATT
GTTTCTGCTGTATAGTTTTTCAAAAAAAGTTAATGCCACCGCATCGCTAACATCAGGACT
TTTGCCATAGTTCTTTTTTAATTGTTCTTTTGAAACTATCTTTAAAAGCCCCTTGTCGCT
ATATTCATATTCAATCATTCTCATATCTTTTTTTAATTCTTCATCTTTAACAAGCTCCAT
GTGTTTAAGTTTTTAGTAAATGTAAAATACATTTGCGCTCTTTTATTTAAGTATTCATT
ACTGGTTGCAGAATTTGCAGAATTTGCCTCAAATACAGGCAAACCATAATTTAACAAGAC
ATCATATACGCCAACGCCAAGACCACAGGTATCTATAAAAATACCTTTTGGTTTATCTTC
GCTTTGATTGTATTCGGCTAGTATTTTGTTTGCTAATTCTATAGTTCCAAGTTGTGAGTA
TTTTTTAATCTCATAAATTACAAAACCTTTTCTTTTTGCTAAAGCACTCTTATCATCTCC
ATATCTTGCTACATCAAGCCCCCAAATATTCTCGCCTTGCATTTTTTCAATACTAAAAGA
GTTCTTGCTCATCGCATTTTCAATTTCACTTAGAGAAAATAATTCAGCACTCGAGCTATC
TATAAACTCGCCATAAATTTCTTGCTTGACAACTTCACTACCTTCTCCGCCTACTTCTTC
AATTAATTCTTTAATTTGCTCTTCTTTTAAAAATGGATTATCATAACTTGAGAATTGAAA
ATGTTTCCAATTTTTATCGCTGAGTTCTTTTCTGCAAAGTTCATAAAATAGATTTTTTCC
TTTAGGAACTCCACCGATAATCGCTCTTGATTTAGGGTTATCAAGCAACATAGGTCTTAT
AGCGTTATACCAAAGATACTCTCCTTTACTACCTTTTAAAATAATTCCTGCTTCGTTTAA
GATAACAAGGTCATATCCAAAACCTTCGATATTTTCACTTCTTTCAGCACTTCTCATATG
AAGCACTGCTCCATTAATAATTAGTTTCTTATCTTGCACACTCCATGAGTAAAAATCTTT
TGGCAAGTTTTTTAACTCAGGTGTAAAATATAACTCGTAATAATTTTGTAAATTTGCTTG
TATGGTATCCACCCATAAAACATTTTGTCCTAAAAGCAAGTTTTCGATAACAAACTTAGC
ACTTCCCCTTGTAAAACCAAGTCTTCTGCCCTTTGCTACAGTTATAAAGCGTGGATTTTT
ATCATCAAAACTTTAAGTTGTGCCGGAGTGTAAGAAAAATCGATTTTTAATTTCATTTG
ATTTCACTTCTTATAATTTCAATTTTTTGAACGTTATCGCTGACAACTTCTTGTTTATCC
ACATATCCATGTTGATTTTTTAGCAAGAACATACTAACGCTAGGAGTATAAGTGCCGATT
AAGGAATGGTTTAAAATATCCATTTCACATTTTTGCTTAGCTTGAGATACAATTCTCCA
AAATCCTTATCCTTCTCCCACTCGCCTAAAGTTTGTATTGTAATTCCTAAATACACAGCT
AATCCCACTTTTGTTTAGGTGCAAAAATAATACTCTCCTTAGTTTCTTTTAAGACAACT
CTTTCATTAAAATAACTCTCTATTTTTGAAACAAGCTCTTCTTTTGTCATACTTTTGCCA
TTTGTCATCATTCTAGCCATTAAGCCACCCCTTCTTTAAAATTAAATTCTTTGATTTCTA
AGTTTAAAAAGATTTTTAAAACTAATAATCTCATAATCGCCTTTTAAAACATTCTTAT
CGTTTCAAATAACGCATCTAACACGCATTTTACGATATTGTCCCCATCGCCATGCCTTT
TGCTGTTAAATCCTATTTTAAAGAAAACTCATATTTCTTTTGCTTATCAAAAGCTTGAA
AACAGCTAATATCATTTTGTCTTCTAAACTCCATTTGCAAGAGTTTTTAAAATCTAAAT
ATTTAAGATAATCTTTACATACAAATTTAGATCTTTGCGTGGTTCTTTTTATAAGGAACTG
GGTTGCTTTTAAATCAATTTTTAAAATATACTTTTCCATTTCAGACTATCTTAAATTTA
GCTTATATTTTAAAAGCCATTTGCTTTTAAGAATTTTTTCAAATCTACTCTTATTCTC
GTTAAATAGCCTTTTTTCTTCAGCTTTTTCAAGCTCTCTCATTTCATCTAAAGTTAAAAC
TCTTTCTATTTCTCGCACTGGTAAAGAATGCTCTAAATCTCTTCCTATCCTATCTTGATT
TTTGAACATGAAATCAACTAAAGCTTCTTTAAATTCTCCATTAGCTATCAAATTACCATC
TTTATAAGTGATTTGCTTAAAAGCATTGATGCAAATTAAAGAATCAATAGATTCTTGATT
TATTTTAATTTTTTGATTGCTTCCGTAATTTGCAAAATATGAGTATTTAAAATCGCCTTT
AAAAACTCTAAAGCAAGCTTGATTTTTGTATTTATTGCAAAGCCATTCTAAAAAAATTTC
```

FIG. 17BP. Continuation of (CJLB-15-1 [organism=Campylobacter phage CJLB-15] partial genome contig_1)

```
TTTGTCTTCAAAACGCTTTTTAAACTCTATTTCAGCTCTTTTGCAAACTCTTCTTAATTT
CTCATAGGTTGTCCCTACGATATTCTCTCTTTCTAAAGTTTCGAAATAAAAATCTAAGAA
AGCATGAATATCCTTAACGCTTTTGAGATATCTACCTACAATATCAGTTGCTTGAGCCTT
ATTAATTTCCAATAAGTCCATTAAAATTTGTATTTTTCTTGCATTTTTTACTCCTTAAA
AGCATCCTAAGAGCTTGTTTTTGTTCTCATCTTTCATTCCGTAATACTCCATCAAGCTAT
CAACCACACTAGGATTGGCTTCTTTTTTTCTGTTAAAACGATGATTTTTCTTGCTTCAT
TTTCTTTAGCGTATTTAAGCCATGTATAAAGACTTCCTACCACACTTGACATTCTTTTTC
CATTTCTTTTCCATTCCCTAGCATCCCAATAGCCTATAAAATCATTAGCCAACTCTTCAC
CAAAGTTTGTGCCATTTTTCTCATTAAAAGCTATTATTTGTCTCATGAGTTCATTTGCAT
TTGGGACTTTAAACTCTTTTTTTGCCATTTTCTCTAACTCCTTTTTGCCAAAATCAATAA
AGCTCGTCACAAAGAGGCGTTTTGATTAGAAACGCATTCTTTCTTTTCTTGATTATTTT
TTAAATTTTCTAAATTCTCTTTTTTTATAAATTTATTATTATTAATATTTATATTATTTA
TAAATTTATTATCGTGTGCGTGCGTGCGTGTTTCTATATAATGTAAATTCTCTTTTTTTT
CGTTTTCAGTAGTTGATTTTCTGTCGATTGATGAAGTGTTATTTTTAAGAGTTTTGCTTA
GCTTTTCATCACTGCTTTTAAGCAAAGATAAAGCTTTGTTAAAATGTTTTTTAATTTGAT
AATTTTCATCTTTTAAAATCCACTCATAAAAATTTAAAGAGCCATTTCTAACCTTTTTAA
TTTCTAAAAGTCTGAGTTCAATTAATTCTTTTTTGGCAATTCTTAATCTATTTAAACT

>CJLB-15-10 [organism=Campylobacter phage CJLB-15] partial genome contig_10
ATATCACCTTTTCCATAAATGTCACTAGTATTTGAAAAACAAGCTTCATTATTTTTCAAA
TTTTCAAAAAAATCTAATAATTCTTTATCCTTAATTTTAGGAAACAAAAAGAAATCTGCC
ATTTTTTAGTCCTTTGGTTTATTTAGATAACAAAACGCGCTAAAATTATACCTTTTTTAT
AGTTAATTTATACTTATTTTATATGTTTTATATACTTAACTTATAGGTTTTTTATAGTCT
TGCTTTTTTTTGAAAATATATATTTTTATTTCAAAACACACTATTTTTGAAATAGCTATT
TTTGGAAAAATCCTTAAAACTAAACTAAGGAGAATTCAAAAATGGCTTTACCTTCAATGG
GACATACCTCACCCGCAACAGAAAATGTTAAGTTAAAACAATCAATATATGAAACGATTA
TTAAAATTGGAGCTACTGAAACACCAATTCTAAATAAAATAGGCACTTCAAAGGTTACAA
ATCCTTTAACTCATAGTTGGATTACTGATACTTTTGAAGAACCAAAAAAGAATGCAAATT
TAGAGTTAAGTAAATTTGTAGGTGAAACAAAAAACACAGCTCAAAAAACTACAAATGCTA
CTCAAATATTCATTACCGAAGCCATGGTATCAAAAGCTTTATTAAAAGCAAATCAATATG
GTGGCAATGAAATGGAGTATCAAATAGGCAAAAAAACCAAAGAACATAAAATGGATATGG
AATATGCTTTATTTGGTCTAGGCAGAGATAGTGATGTAAAAAAATCAGTTTTCAAAGATT
ATGTTCAAGCACAAGAAGCAACAAGTGGAGAAATGGCTGGACTTTTTCATTATATCGCTA
AAGGAAAAGATAGCTTTTCTGATGGAAAGCGTGGAAATGTATTAGCTTTTGATGAAACAG
GAGATTGGAGTGGAACTGCAACAGAACTAACAGAAGATAAACTTAATCAAATCTTACAAA
CCATTTGGAATAGCGGAGTGACGCCTAAAGATGTCTTTTTAGGAGCTGACTTAAAAGGAG
CTATCAATAAATTCGCTACAAGAATTTTAGGCAATGAAACAAAACTAGCAGGACAAGTAG
TGAGCCTTGAAACAGATTTTGGAACGGTAAATTTCCATATGCATAGATTATTAAGCCCTA
AATATGGTTTGGGTGATGTTTTAATTGCTGGGGATTTTGAGTATATGAAACATGGGCTTT
ATATTCCTACTATGATTGAAGATGTTCCAACTGATATTACTGCAAAAGCAAAAAGATTTT
ATACGCAAAGCACTTTAGAAGTAAGAAATGCTGATGCTTTTGCTATAGGCGTGGGATTAA
CTAGTGGAAATAATGCAAAGGCTAAAGCGGTTTTAAAAGCAGCAAAAGGTGCATAATGCT
TTGTGCTACGGCTAAAAAACTCATTATCGCTAAAGTTAAAAATTCTTACAAAATGATAGA
AGATGATGAAGTTTTGAAAGCCTATTTTATGGAAGCATTTATTATATTTTATCAAAATG
TGTTCCTAGCGTTCTTTTAAAAAATGTAGAGCAAGGCGAAAAAGTTTTAGGCAAGTTAG
AAATAATCATTTTTTGATTATTCCTGATGAGCCTGATTTTGACAATGAAAAAGAACATTT
AATGATAGATGAAACACTTAGTTTTGCTGTGATTAATTATGTTTGTTATTTGATTACAAG
ATGCGAAGAAAAAGACTTTCTGGCATTATGTGACAAGATAATTTATGAGTATATAGCTAA
TGATGGCAAGGAGCTTGATGATGAAGAACATGGTTGTAATTGTAATTTCACAAAAAAAA
TTAATAGAGCTTTGAGTTATAAAGACTATGTGCAAAGTATAAATAGTGCTGATTTTATAG
CTTATTTAGATGATAAAAAATGGCTTTTAGCCATGGATGATCTGCTTTTCTTTTGCGAAA
AGAGAATTAAAGATAGTGATTATTATGAAGGTTAAAAATGGGAACAAGCTTAAATGAATT
AAAAACAGGTAGAGAAAAACTTGAAATCATAAATCAAGTTTTAGCTAGAATAAACAGCAT
TTCAGAAGCAATAGACAATACAAGACCTGATGAAGTTGTAGGCTTAAAACAAGCTTGCGA
ATCTTTAAAAAATGATGTTTAAAATTTAAAAATGATATTGTAGATAAAAATGATGATAT
TTTAAGCAAATATGATGATATTAATAAAAAATATTCAAATATAAGTGTAAAATACAACAA
TGTAAATGCAAAATTTGATTATATTAAAGAAGCGTATGAAGATTTTTCTTTAAATAAACA
AGAAATACAAAACATTAAAGATTTTTTAGAAAATAATACAGAAGAGTTTGAGAATTTAAA AAAAGATATACAG >CJLB-15-11 [organism=Campylobacter phage CJLB-15] partial genome contig_11
CATTATTATAAAATGATTGGTTCAAATCATCATAACTATATGTATATACATTATGATTGC
GAAAATTTAAGTATTTAAGAATACCTTTTACACCACAATAATCGTAAACATTAAAAAAAA
CAATATTTCTTTCAATATTCTCAAGTTCTGAGAAATTTAAAATGTTACTCATATTTTGGA
TACCAACATAGTTCTAAACATTTACAATTTTTATGTGGGCAGGTTACTACAATATTATCA
TCTATATTTTTAATGTGCTTAAAACAATCATTCATAAAAGTGCCATCAATATCTAATAAA
```

FIG. 17BQ. Continuation of (CJLB-15-1 [organism=Campylobacter phage CJLB-15] partial genome contig_1)

```
AAATTTAAAGGTTTGCATTTTATATCTTTGGTATTTAGTCGTAATATTTCAAAATTATCA
TCCAAAATATTGTCGTGTGTTTTGTATTTGAGATTCCAATCAAACATATATAAAATTTTG
CTATGTTTTTTTGCAATACTATCCAATGGCACTCCATTACAATCGTGTATAGGATTTATA
AAATAGTTAATATTATGTTTATCGAACAACGCTACAACATTTTCTACAAGTTTGAGTTTT
ACCGTGTTAAGTGATATTATTTTACGAGTCTTAATTTTATAATATTTAAAATAAATTTA
AAAAAGTTTTTGCCGTGGTAGGATGCAACTATAAAAACTTTGCTATTGTTAAAATTATAT
GAATGTAGAGGTGCTGTTAAATTTGTTATGAGAGCAATCTGATTTATATAATTATTATGC
ACTAGTATTTCCACAATTTTATTCAATTTGGGGTGTAAAGTAGGCTCCCCACCAACTAAT
TGTATATTAACTGGTCTGTGGATATGTTTTTTAAAAATAACATCAAAGTTGATATTTTT
ATAAATTTAGATTTATTAATATTATTGTGATAACCAATACAATATGAACAATTGAAATTA
CAAGCGTCTGTGACGTTTATGCTAATTATAGGTAAAACTTCTTCAAAACCTCTTACCAAT
TTCATTTGCGGTACTCCATTATTTCATAATCTTCACAAGCTATTTTTTACAATTTATAT
CAACACCGAACATTGTTTCTAATTTATTAGATTTTAAGTTACGACATTTAGACGTAAATA
TGCCATTATCATAATATATCAATTTGGGGTTGCATAGACAACCCAGTGATTTATTCAGAT
TATTTTTAAAAATATTAAAATATTGTTCATCCCTAGTTAGATTAAATCTATTGGTTAAAA
TATTTTTATTGTTTAAGAAGATTTGTTCAAAAAAATTAAAACATTTTTCTTCAACAGGAA
CTTTCAATCCTTTTTTATCCGTTAAAAAAATTAGAAAAAAATGATAATTATTTGTACTGA
GAAAATCAATTATTTTTGTAGGGTAACCTAAAACTGGTAACGCTACATATAGTTGTTTA
TTGTTTGTTTATTTATTATGTTTATAAAACTATCTTCATCAATCTGATTAGGAT

>CJLB-15-12 [organism=Campylobacter phage CJLB-15] partial genome contig_12
ATAAAACACGCTTTAGTTTTGAATTTGAAAAGACATTTTTTGGCGATTTAAATGTAGATT
GGAGTGCAAATGCTAATTTAAGATATAGTTTTTAAATAAAAAATAATTTAAAAATTGTAT
TTTTATTTTAAGCTTTTTTGTTTATAATACTTGCTTTTACATTTAAAGGATAAAGATGAA
AATAAAAGTTGGGATTTTAGGAGCGAGTGGTTATGCGGGAAATGAACTTGTTCGCATTTT
GCTTAATCATCCCAAGGTTGAAATTTCTTATTTGGGTTCGAGTTCTAGCGTGGGGCAAAA
TTATCAAGATCTTTATCCTAACACCCCTTTAAATTTATGTTTTGAAAATAAAAATTTAGA
TGAACTTGAACTTGATCTTTTGTTTTTGGCTACTCCGCATGAATTTAGTGCTAAACTTTT
AAATGAGAATTTATTAAAAAAGATGAAAATCATTGATTTAAGTGCGGATTTTCGTCTTAA
AAATCCTAAAGATTATGAGCTTTGGTATAAATTCACTCATCCTAATCAAGAGCTTTTGCA
AAATGCGGTTTATGGACTTTGTGAGCTTTATAAAGAAGAGATAAAAAAAGCAAGTTTAGT
GGCAAATCCAGGTTGTTATACCACTTGTTCTATCTTAAGTCTTTATCCGCTTTTTAAAGA
AAAGATCATTGATTTTAGCTCAGTTATTATTGATGCAAAAAGTGGGGTAAGTGGAGCAGG
AAGAAGTGCAAAGGTGGAAAATCTTTTTTGTGAAGTTAATGAAAATATCAAAGCTTATAA
TTTAGCTTTGCATCGCCATACTCCTGAAATTGAAGAGCATTTAAGCTATGCAGCCAAAAA
GAAAATCACTCTACAATTTACCCCTCATCTTGTCTCTATGCAAAGAGGAATTTTAATCAG
TGCTTATGCAAATTTAAAAGAGGATTTGCAAGAACAAGATATACGCGATATTTATACAAA
ATACTATCAAAACAATAAATTCATAAGGCTTTTACCGCCGCAGTCGCTTCCGCAGACTCG GTGGGTTAAATCAAGCAATTTC >CJLB-15-13 [organism=Campylobacter phage CJLB-15] partial genome contig_13
GCGTTTAATTGTCTAAATCCTAAATAATTTTCTTTTTCTCCATTTTTATTGATATAGCTA
AAATCGTTATTTTTAGCTACAAAAAGATTAAAAATAGCTAGTTTTTGCTCTTTTCTGGTT
AAAAATTCAAAACAAATAAAAGTATTATTGCTTCCATCGCTTGCCAATTTATCATATAAA
AAGGCTTTGCGGAAAACTCCGCTATAAAGCCCACCTTCACTTAAATACTCTACGCTTGGC
GAATAATTTGCCACTTCAAAACTTGCCTTAAATGCTGGTAACATTATAATCCTCCTTTTA
ATTGTGTTAAAAATTCATCTTTATTACTTAGAACTTCTTGTATTTTTTCACTTGTAAATA
AAGAATGTTTTTTTATAAAATTGTTTTGCTCTTGGGTGTTAAACCATTATCACTCATAA
ATTTTCTAAGTTCAGCACCTAAAGCTTTTATCTCTTTTGCTTTATTTTCTAAAGCTATTT
TTTCATCACTACCCCAAACTTTTAAATCTTCATTTGGATTTAAAAATCGCTTTTCCTTTA
TTGTTTCTAATTCACTTTCATCAAGCATTCCAAGTCCGCAAATACTTAAGGTTACACGCC
TTTTTGCTTTTGTGATAGCTTTCATTATTGCGTTTGCTAAATTATCGCCACCTAAATTTT
TAATATTTAAAGCACCTGTATCGCAATCAGTTCTTCCATCTGGTGTTGCTGCGTAGGCTG
TAACCATATAAATATCGCCAACTTGTGCCACTTCTGTTTTTGTAATACTTACTTTTCTTA
TTTGTCTTAGTTGATCTGTTGCTGATTTATTTGCATATAAAGTAAGTTTGCCATTTAATA
CTATGTATTCAAAGGCTTTGTAAGCATGTTTAAGCTTAAACTTTCACAAAGATTTTTAA
CATAACTCGCTCGTTCTACATCACTAAGTTTTGATAAATCACCTTTTACCAAAGCCAACT
CATAAGGATTAAAATTTATTTCTAATTTATTTTCTTCTTTTAATACAACTTCATTACTCA
TTTTATGCTCCTTTTTTGATTTTTAAACACATTGAAATACTTTCTTTATAAAACTCTTTA
GGCACAGTAATATTTTTTTGCTCTAAAAAGCCCTTATAATCAATTGTAGTTCTACTTTGC
GGATAAATTGTAATATCCAAACATCTTGCTTTTTCTCCATTTGCTAAGGCTATGAGTTCT
TTTTTAAGACTTTCTAGCTTTTCTTTAATAGGTTAATCGTGTTTTCAAGCCTTATAATT
TCAATCGTTAGATTTTTTGCTTTAGTATCTTCAAGCTCTTTATATTCACTTTTTTGATCT ATGATATAATCTAATAT
```

CAMPYLOBACTER BACTERIOPHAGES AND USES THEREOF

CROSS-REFERENCE TO RELATED APPLICATIONS

The present application claims the benefit of U.S. Provisional Patent Application No. 63/128,634, filed Dec. 21, 2020, the disclosure of which is incorporated by reference in its entirety herein.

INCORPORATION OF SEQUENCE LISTING

The sequence listing that is contained in the file named "041071_00108_Sequence_Listing.txt," which is 1,476,666 bytes as measured in Windows 10 operating system and was created on Feb. 22, 2022, is filed electronically herewith and incorporated herein by reference.

FIELD OF THE INVENTION

Background of the Invention

Bacteriophages

Bacteriophages are bacterial viruses that attach to their specific hosts and kill them by internal replication and bacterial lysis involving a complex lytic cycle involving several structural and regulatory genes. Phages are very specific in that they only attack their targeted bacterial hosts. They cannot infect human or other eukaryotic cells. Bacteriophages were first identified, in the early part of the 20th century by Felix D'Herelle who called them bacteriophages or bacteria-eaters (from the Greek phago meaning to eat or devour). It is estimated that there are more than $10^{31}$ phage particles in the biosphere, and about $10^{23}$ phage infections occur every second on a global scale, indicating that the phage population is not only large but also highly dynamic.

Lytic and Lysogenic Bacteriophages

Bacteriophages have a lytic cycle or a lysogenic cycle, but some bacteriophages can carry out both. With lytic phages such as the T4 phage, bacterial cells are broken open (lysed) and destroyed after immediate replication of the virion. As soon as the cell is destroyed, the new bacteriophage viruses can find new hosts.

In contrast, the lysogenic cycle does not result in immediate lysing of the host cell. Those phages able to undergo lysogeny are known as temperate phages. Their genome will integrate with host DNA and replicate along with it harmlessly or may even become established as a plasmid or prophage. The virus remains dormant until host conditions are stressed or deteriorate (e.g., due to depletion of nutrients, or exposure to UV light) then the endogenous phages (known as prophages) become active. At this point they initiate the reproductive cycle resulting in lysis of the host cell. As the lysogenic cycle allows the host cell to continue to survive and reproduce, the virus is reproduced in all of the host cell's offspring.

Bacteriophage Structure

Although different bacteriophages may contain different materials, they all contain nucleic acid and protein. Depending upon the phage, the nucleic acid can be either DNA or RNA but not both, and it can exist in various forms. The nucleic acids of phages often contain unusual or modified bases. These modified bases protect phage nucleic acid from nucleases that break down host nucleic acids during phage infection. The size of the nucleic acid varies depending upon the phage. The simplest phages only have enough nucleic acid to code for 3-5 average size gene products while the more complex phages may code for over 100 gene products (the largest bacteriophage genomes may be >700 kb in size). The number of different kinds of protein and the amount of each kind of protein in the phage particle will vary depending upon the phage. The simplest phage has many copies of only one or two different proteins while more complex phages may have many different kinds. The proteins function in infection and to protect the nucleic acid from nucleases in the environment.

Bacteriophage come in many different sizes and shapes. The basic structural features of bacteriophages include their size, head or capsid, tail. For example, T4, a common phage is among the largest phages; it is approximately 200 nm long and 80-100 nm wide. Other phages are smaller. Most phages range in size from 24-200 nm in length.

All phages contain a head structure which can vary in size and shape. Some are icosahedral (20 sides) others are filamentous. The head or capsid is composed of many copies of one or more different proteins. Inside the head is found the nucleic acid. The head acts as the protective covering for the nucleic acid. Many but not all phages have tails attached to the phage head. The tail is a hollow tube through which the nucleic acid passes during infection. The size of the tail can vary, and some phages do not even have a tail structure. In the more complex phages like T4 the tail is surrounded by a contractile sheath which contracts during infection of the bacterium. At the end of the tail, the more complex phages like T4 have a base plate and one or more tail fibers attached to it. The base plate and tail fibers are involved in the binding of the phage to the bacterial cell. Not all phages have base plates and tail fibers. In these instances, other structures are involved in binding of the phage particle to the bacterium.

Bacteriophage Infect Bacteria

The first step in the lytic cycle/infection process is the adsorption of the phage to the bacterial cell. This step is mediated by the tail fibers or by some analogous structure on those phages that lack tail fibers, and it is reversible. The tail fibers attach to specific receptors on the bacterial cell, and the host specificity of the phage (i.e., the bacteria that it is able to infect) is usually determined by the type of tail fibers that a phage has. The nature of the bacterial receptor varies for different bacteria (e.g., proteins on the outer surface of the bacterium, LPS, pili, and lipoprotein). These receptors are on the bacteria for other purposes, and phage have evolved to use these receptors for infection.

The attachment of the phage to the bacterium via the tail fibers is a weak one and is reversible. Irreversible binding of phage to a bacterium is mediated by one or more of the components of the base plate. Phages lacking base plates have other ways of becoming tightly bound to the bacterial cell.

The irreversible binding of the phage to the bacterium results in the contraction of the sheath (for those phages which have a sheath), and the hollow tail fiber is pushed through the bacterial envelope. Phages that do not have contractile sheaths use other mechanisms to get the phage particle through the bacterial envelope. Some phages have enzymes that digest various components of the bacterial envelope.

Lytic (Virulent) Phage Life Cycle

Lytic or virulent phages are phages which can only multiply on bacteria and kill the cell by lysis at the end of the life cycle.

During the eclipse phase, no infectious phage particles can be found either inside or outside the bacterial cell. The phage nucleic acid takes over the host biosynthetic machinery, and phage specified mRNAs and proteins are made. There is an orderly expression of phage directed macromolecular synthesis, just as one sees in animal virus infections. Early mRNAs code for early proteins that are needed for phage DNA synthesis and for shutting off host DNA, RNA and protein biosynthesis. After phage DNA is made, late mRNAs and late proteins are made. The late proteins are the structural proteins that comprise the phage as well as the proteins needed for lysis of the bacterial cell.

In the Intracellular Accumulation Phase, the nucleic acid and structural proteins that have been made are assembled and infectious phage particles accumulate within the cell.

During the Lysis and Release Phase, the bacteria begin to lyse due to the accumulation of the phage lysis protein (e.g., lysin), and intracellular phage are released. The number of particles released per infected bacteria is typically 40-200 but may be as high as 1,000.

A common assay for lytic phage is the plaque assay where lytic phages are enumerated by a plaque assay. A plaque is a clear area which results from the lysis of bacteria. Each plaque arises from a single infectious phage. The infectious particle that gives rise to a plaque is called a PFU (plaque forming unit).

Temperate ("Lysogenic") Phage Life Cycle

Temperate phages (sometimes also called "lysogenic" phages) are those that can either multiply via the lytic cycle or enter a quiescent state in the cell. In this quiescent state most of the phage genes are not transcribed; the phage genome exists in a repressed state. The phage DNA in this repressed state is called a prophage because it is not a phage per se but it has the potential to produce phage. In most cases the phage DNA integrates into the host chromosome and is replicated along with the host chromosome and passed on to the daughter cells. The cell harboring a prophage is not adversely affected by the presence of the prophage, and the lysogenic state may persist indefinitely. The cell harboring a prophage is termed a lysogen. See McGrath S., van Sinderen D. Bacteriophage: Genetics and Molecular Biology. 1st ed: Caister Academic Press; 2007, herein incorporated by reference in its entirety.

Anytime a lysogenic bacterium is exposed to adverse conditions, the lysogenic state can be terminated. This process is called induction. Adverse conditions which favor the termination of the lysogenic state include desiccation, exposure to UV or ionizing radiation, and exposure to mutagenic chemicals. This leads to the expression of the phage genes, reversal of the integration process, and lytic multiplication. See Kutter E, Sulakvelidze A. Bacteriophages: Biology and Application. Boca Raton, FL: CRC Press; 2005, herein incorporated by reference in its entirety.

Campylobacter Spp. Bacteria

Infections due to Campylobacter spp. are one of the most common causes of gastroenteritis worldwide. In the United States, an estimated 1.3 million foodborne Campylobacter infections occur every year, with an economic impact of about $1.3-6.8 billion (in 2014 dollars). Generally, Campylobacter infections are self-limiting, but they do account for 6% of mortality due to foodborne illnesses in the US. In addition, about 8-12% of Campylobacter infections trigger Guillain-Barré syndrome which is a severe debilitating neurological disease. Poultry and dairy cattle are the major reservoir of Campylobacter, responsible for over 90% of all foodborne Campylobacter outbreaks in the US. Chicken and other poultry, in particular, are one of the most significant sources of Campylobacter infections. For example, in a recent study, the Food Safety Inspection Service (FSIS) isolated Campylobacter from 24.6% of chicken carcasses, 22.1% of chicken parts sampled, and 65.7% of mechanically separated chicken products, representing substantially higher incidences than previously reported. As chicken and other poultry is widely and increasingly consumed in the USA, poultry associated campylobacteriosis presents a significant public health risk. Unpasteurized milk is another important source of campylobacteriosis, and it has been implicated in at least sixty Campylobacter outbreaks between 2009 and 2015. As more states are legalizing the sale of unpasteurized milk, the risk of milk-borne Campylobacter infection outbreaks is growing. Other potential reservoirs and sources of transmission to humans include beef and meat products, shellfish, pigs, domesticated animals, and undisinfected water. Fresh produce has also been implicated in Campylobacter infections in humans, with cantaloupe as the top food in the category with elevated Campylobacter risk in the US.

Approximately 20% of the US population, including children, elderly, and people with weakened immune systems, have increased vulnerability to foodborne infections and other infectious diseases. Prevention and the provision of a safe food supply is one of the high priority areas to control and limit the foodborne outbreaks of campylobacteriosis and other foodborne pathogens under the "One Health" approach. Both the CDC and USDA have implemented and continue to amend regulations to control Campylobacter in our food supply. The national food safety regulations were revised in 1996 with the aim of reducing the incidence of Salmonella, E. coli O157: H7, Campylobacter and Listeria contamination in chicken and turkey carcasses and ground parts (61 FR 38806). The regulations mandated testing for Campylobacter in all slaughter plants; however, the standards developed in 1996 primarily targeted Salmonella, with the belief that intervention strategies aimed at reducing Salmonella would also be effective against other pathogens. In 2011, on the recommendation of the Presidential Food Safety Working Group, FSIS developed new performance standards for Campylobacter for chilled chicken and turkey carcasses to further reduce Campylobacter incidence (75 FR 27288). Despite these new regulations, Campylobacter-associated outbreaks occurred in 2011, 2013 and 2015 from comminuted poultry products; therefore, new performance standards were mandated in 2016 for poultry parts and comminuted products (81 FR 7285). Even with these regulations in place, the incidence of Campylobacter infections appears to be on the rise in the US (FIG. 1). Thus, there is an urgent need for novel, safe, and effective intervention strategies to reverse this trend and reduce the risk of foodborne illness due to Campylobacter or to modulate the gastrointestinal (GI) tract microflora to enhance its resilience against colonization with Campylobacter and subsequent infection with, and disease caused by, the bacterium.

Most human illness (approx. 90%) is caused by one Campylobacter species, called Campylobacter jejuni, but other Campylobacter species (e.g., C. coli) have been also implicated in human illness. C. jejuni causes severe morbidity associated with bloody diarrhea, fever, and abdominal cramps. Antimicrobial therapy is recommended for high-risk patients, such as those with weakened immune systems and/or children. However, resistance to antimicrobial drugs, especially macrolides and fluoroquinolones (the primary drugs of choice), has been increasing in Campylobacter which limits the therapeutic options. Following approval of fluoroquinolone use in poultry for certain indications by the Food and Drug Administration in 1995/1996, prevalence of ciprofloxacin resistant C. jejuni increased in poultry. For example, the *Campylobacter* surveillance data from the National Antimicrobial Resistance Monitoring System (NARMS) suggest that prevalence of ciprofloxacin resistant *C. jejuni* rose from 17% in 1997-1999 to 32.7% in 2018. Concurrently, prevalence of aminoglycoside and macrolide resistant *C. jejuni* is also increasing in the US. The alarming increase in the *Campylobacter* incidence in the food-supply chain, together with the emergence of drug-resistant *Campylobacter* clones, emphasizes an urgent need for novel non-antibiotic intervention methods to significantly reduce or eliminate *Campylobacter* (and especially *C. jejuni*, *C. coli*, and *C. upsaliensis*) in all foods at high risk of being contaminated with *Campylobacter*.

As explained above, there remains an urgent and unmet need in the art for new agents and approaches for controlling *Campylobacter* in several critical areas, such as clinical applications, enhancing gut resilience against *Campylobacter* colonization and subsequent infection, food safety-related uses, and environmental decontamination.

SUMMARY OF THE INVENTION

The invention meets the described needs and more by providing compositions comprising alone or in any combination novel CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) bacteriophages having lytic specificity for the Targeted Bacteria and deposited in American Type Culture Collection (ATCC) on Sep. 30, 2020. The ATCC deposit number for each phage is provided in the parenthesis. The invention additionally provides methods of using the Deposited Bacteriophages to control or prevent colonization or contamination of processed and unprocessed food products by Targeted Bacteria, or colonization/contamination of equipment involved in the processing of the same food product(s). The invention additionally provides methods of using the Deposited Bacteriophages to modulate GI tract and/or enhance gut resilience against Targeted Bacteria, by reducing the incidence and/or levels of colonization in various animals (including humans) with Targeted Bacteria. The invention also provides methods of detecting the presence of Targeted Bacteria cells on processed or unprocessed food products, or equipment involved in the processing of the same food products. The invention additionally provides methods of using the Deposited Bacteriophages for the removal of antibiotic-resistant or other undesirable pathogens from medical, veterinary, animal husbandry, food processing, and other environments where they may be passed to humans or animals. The invention additionally provides for methods of using the Deposited Bacteriophages to prevent or treat human and/or other animal diseases caused by Targeted Bacteria.

For example, one significant need concerns the treatment of processed or unprocessed food products to reduce, eliminate or prevent colonization with undesirable bacteria such as pathogens responsible for food-borne illness and food spoilage organisms. A second critical area of need concerns the removal of undesirable bacteria from industrial environments such as food processing facilities to prevent colonization thereof. A third critical area of need concerns the removal of antibiotic resistant organisms from environments where they may be passed to susceptible humans and animals, such as hospitals, nursing homes, veterinary facilities, and other such environments. Additionally, new bacteriophage compositions and methods of using the same are needed for the prevention or treatment of animal and human bacterial disease, particularly those diseases caused by antibiotic-resistant organisms. Furthermore, bacteriophage compositions may be used as pre-biotics or probiotics or nutritional/dietary supplements—alone or in combination with bacteria-based supplements and/or yeast-based supplements—for modulating GI microflora for various health benefits (i.e., the bacteriophages modulate GI tract microflora by specifically lysing undesirable bacteria while leaving desirable microflora intact).

The Deposited Bacteriophages are provided in order to control the growth of the Targeted Bacteria, which will reduce their ability to contaminate and colonize various environments, including but not limited to (a) raw, unprocessed food products, (b) equipment used to process or manufacture various food products, (c) various food products processed or manufactured with equipment contaminated with the Targeted Bacteria, (d) animals (including humans) contaminated/colonized with the Targeted Bacteria, (e) animal (including human) environments contaminated with the Targeted Bacteria, and (f) various processed food products for humans or animals containing ingredients contaminated with the Targeted Bacteria. The invention also provides methods for providing a prophylactic dosage(s) of the Deposited Bacteriophages, alone or in combination with bacteria-based supplements and/or yeast-based supplements, that may offer a subject protection against the disease caused by the Targeted Bacteria. The invention also provides methods for detecting the presence of the Targeted Bacteria in processed or unprocessed food products, and in equipment used to process or manufacture the food products. In addition, the invention provides methods of using the Deposited Bacteriophages to remove the Targeted Bacteria from medical, veterinary, animal husbandry, food processing, and other environments where they may be passed to humans or animals. Also, the invention additionally provides methods of using the bacteriophage (either as a pharmaceutical composition or nutritional supplement composition) to prevent and treat animal and human diseases caused by the Targeted Bacteria.

The invention meets the described needs and more by providing compositions comprising alone or in any combination novel CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) bacteriophages having lytic specificity for the Targeted Bacteria. The invention additionally provides methods of using the Deposited Bacteriophages to control or prevent the infection or colonization of processed and unprocessed food products by Targeted Bacteria, or colonization of equipment involved in the processing of the same food product(s). The invention additionally provides methods of using the Deposited Bacteriophages to prevent, eradicate, or reduce the levels of colonization of various animals (including humans) with Targeted Bacteria. For example, compositions comprising the Deposited Bacteriophages may be formulated as nutraceutical composition (e.g., dietary supplement, probiotic, or prebiotic) for use by animals, including humans. The nutraceutical composition comprising the Deposited Bacteriophage is injected by an animal (including human), which lyses the Targeted Bacteria reducing colonization by the Targeted Bacteria of the animal. In another example, the same nutraceutical composition comprising the Deposited Bacteriophage is injected by an animal (including human) regularly for enhancing GI resilience against colonization with the Targeted Bacteria; if and when the Targeted Bacteria in introduced into the GI tract of the said animal, the nutraceutical composition lyses the Targeted Bacteria reducing colonization by the Targeted Bacteria of the animal and subsequent risk of infection and disease. In yet another example, the same nutraceutical composition comprising the Deposited Bacteriophage is combined with bacteria-based and/or yeast-based nutraceutical preparations for enhanced ability to modulate the animal microbiome and enhance its resilience against colonization with various pathogenic microorganisms. These bacteria-based dietary supplement preparations can be based on, but are not limited to, strains of *Lactobacillus* species, including *L. acidophilus, L. rhamnosus, L. gasseri, L. reuteri, L. bulgaricus, L. plantarum, L. johnsonii, L. paracasei, L. casei, L. salivarius*, or *L. lactis, Bifidobacterium* species, preferably *B. bifidum, B. longum, B. breve, B. infantis, B. lactis*, or *B. adolescentis, Streptococcus thermophilus, Bacillus cerus, Bacillus subtilis, Enterococcus faecalis, Enterococcus faecium*, or a combination thereof. These yeast-based dietary supplement preparations can be based on, but are not limited to, strains of *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii*, or a combination thereof.

The invention also provides methods of detecting the presence of Targeted Bacteria cells on processed or unprocessed food products, or equipment involved in the processing of the same food products. The invention additionally provides methods of using the Deposited Bacteriophages for the removal of antibiotic-resistant or other undesirable pathogens from medical, veterinary, animal husbandry, and other environments where they may be passed to humans or animals.

The Deposited Bacteriophage has binding specificity for Targeted Bacteria (i.e., *Campylobacter* species and strains), and is capable of lysing Targeted Bacteria (i.e., lytic bacteriophage). The invention also contemplates progeny, variants, substantially equivalent bacteriophages, and bacteriophage derivative(s) of the Deposited Bacteriophages.

In another embodiment, the variants of the Deposited Bacteriophage have the same phenotypic characteristics as the Deposited Bacteriophage. In another embodiment, the variants of the Deposited Bacteriophage have the same lytic specificity for *Campylobacter* as the Deposited Bacteriophage.

In a still another embodiment, the variants of the Deposited Bacteriophage differ genetically from the Deposited Bacteriophage by a single genetic event including but not limited to silent mutations, inversions, deletions, insertions, polymorphisms, or point mutations but still retain the same phenotypic characteristics and lytic specificity for *Campylobacter* as the Deposited Bacteriophage.

In many embodiments, the progeny may be variants of the Deposited Bacteriophage.

In one embodiment, the invention provides progeny of the Deposited Bacteriophage having minor variation(s) in the genomic sequence and polypeptides encoded thereby while retaining the same general genotypic and/or phenotypic characteristics as the Deposited Bacteriophage. In particular these progenies are the result of successive passaging of the Deposited Bacteriophage where the variants accumulate silent mutations, conservative mutations, minor deletions, and/or minor replications of genetic material. The progeny described herein of the Deposited Bacteriophage retain phenotypic characteristics of the Deposited Bacteriophage, in a preferred embodiment, the progeny retains lytic activity against the Target Bacteria.

In an embodiment, the invention provides derivatives of the Deposited Bacteriophage comprising substances that constitute subunits or expression products of the Deposited bacteriophage or its progeny, including (but not limited to) phage nucleic acids, partial or complete phage genes, gene expression products (e.g., exopolysaccharide degrading enzymes), and structural components (e.g., polyribonucleotide(s) and polydeoxyribonucleotide(s), including modified or unmodified bacteriophage DNA, cDNA, mRNA and synthetic polynucleotide sequences, as well as DNA/RNA hybrids.) In another embodiment, the invention provides modified polynucleotides (e.g., phosphorylated DNAs) of the Deposited Bacteriophages.

In an embodiment, the invention provides the use of the Deposited Bacteriophage, and its progeny and derivatives, to control the growth on, or colonization of, processed and unprocessed food products by Targeted Bacteria, or the colonization of buildings and equipment, particularly those associated with the processing of the same food product. The invention also provides methods of identifying Targeted Bacteria as a bacterial diagnostic and/or detecting the presence of Targeted Bacteria on processed or unprocessed food products, or equipment or buildings such as those involved in the processing of the same food products. The invention further provides methods of using the Deposited Bacteriophages and their progeny and derivatives for the removal of antibiotic-resistant or other undesirable pathogens from medical, veterinary, animal husbandry, or any additional environments where they may be passed to humans or animals. The invention additionally provides for methods of using the Deposited Bacteriophages and their progeny and derivatives to prevent and/or treat human and animal diseases caused by Targeted Bacteria. The Deposited Bacteriophages and their progeny and derivatives are administered for the methods of the invention as a homogenous phage administration, or alternatively as a component of a multi-phage composition comprising several bacteriophages and/or other bacteria-based or yeast-based compositions. These methods of use are provided with greater particularity infra.

In any one embodiment, one possessing the Deposited Bacteriophage will inevitably be in possession of progeny of the Deposited Bacteriophages. Furthermore, after successive sub culturing (e.g., over 50 passages) of the Deposited Bacteriophages, progeny having genetic variations within the scope of "closely related" organisms as descried by Tenover et al., or "Same Species" as described by Olm M. "Are these microbes the "same"? www.microbe.net/2017/02/15/are-these-microbes-the-same/> ("Olm") and Jain C, Rodriguez-R L M, Phillippy A M, Konstantinidis K T, Aluru S. High throughput ANI analysis of 90K prokaryotic genomes reveals clear species boundaries. Nature Communications. 2018; 9 (1): 5114 ("Jain"), both of which ares incorporated by reference herein in relevant part, are present.

In one embodiment, the invention comprises bacteriophages substantially equivalent to the Deposited Bacteriophages-bacteriophages that are "indistinguishable" from or "closely related" to the Deposited Bacteriophages as these terms are defined in Tenover et al., or fall under the "Same Species" designation as described by Olm and Jain.

In any of the foregoing embodiments, the composition comprises at least one, two, three, four, five, six, seven, or all eight of the Deposited Bacteriophages.

In another embodiment, a nutraceutical composition may comprise at least one of the Deposited Bacteriophages. The nutraceutical composition may further comprise an excipient, carrier, stabilizer, flavoring, or colorant agent.

In another embodiment, the composition comprises at least one the Deposited Bacteriophage and additionally comprising a washing step in which the food product is contacted with an aqueous medium to remove the bacteriophage composition.

The present invention is directed to novel phage compositions useful in treating food products to minimize or eliminate bacterial contamination by *Campylobacter* bacteria. The phage compositions can be formulated with suitable carriers.

The compositions of the present invention may be used for human, veterinary, agricultural or aquacultural purposes. Furthermore, the compositions as described herein may be used for environmental applications. The composition may be used within a cream, lotion or gel, be admixed with a pharmaceutical carrier and administered topically, orally, nasally, used as a powdered inhalant, or the antibacterial composition may be added to a feed for animal, aquatic or avian uses.

In another embodiment of the invention, isolated progeny of the deposited bacteriophage derived from the deposited bacteriophage.

Another embodiment of the invention comprises isolated progeny of the progeny of the deposited bacteriophage.

One embodiment of the invention comprises at least one of the isolated bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the American Type Culture Collection, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

Another embodiment of the invention comprises at least one isolated progeny of bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

Another embodiment is a composition comprises at least one isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

Another embodiment is a composition comprises at least one progeny of bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

Still another embodiment comprises at least one derivative of the bacteriophage of isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains, said derivative comprising nucleic acids, partial or complete genes, gene expression products, structural components, or one or more combinations thereof.

In any of the foregoing embodiments, the composition may comprise at least one derivative of the progeny bacteriophage of isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains, said derivative comprising nucleic acids, partial or complete genes, gene expression products, structural components, or one or more combinations thereof.

In any of the foregoing embodiments, a composition may comprise an isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, progeny, derivatives, and mixtures thereof. In some embodiments, the composition may be a pharmaceutical composition, nutraceutical product, dietary supplement, probiotic, and/or prebiotic. In some embodiments, the composition may be a concentrated aqueous solution or dried powder preparation. In any of the embodiments, the composition comprises one or more of the following ingredients: deionized water, buffer solution, preferably Tris-HCl pH 7.0-7.5, mineral water, sucrose, glycerol, trehalose, dextran, polyethylene glycol, sorbitol, cellulose, tapioca dextrin, hydroxypropyl methylcellulose, gellan gum, gelatin, casein, NaCl, $MgSO_4$, or a mixture thereof.

One embodiment comprises a method for the prevention of food borne illnesses caused by *Campylobacter* strains, comprising contacting a food product or products with a microbial growth inhibiting effective amount of a bacteriophage composition comprising at least one of the isolated bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

One embodiment comprising a method for the reduction of the incidence of food borne illnesses caused by *Campylobacter* strains, comprising contacting a food product or products with a microbial growth inhibiting effective amount of a bacteriophage composition comprising at least one of the isolated bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains.

In several embodiments, the contacting described in the methods herein comprises (i) spraying or misting or fogging the bacteriophage composition on the food product(s), or (ii) dipping or soaking the food product(s), or (iii) adding, injecting or inserting the bacteriophage composition into the food product(s) or food product packaging, with the solution containing a concentration of the bacteriophage composition sufficiently high to inhibit the growth of *Campylobacter* strains.

In any embodiment, a method for reducing the risk of bacterial infection or sepsis in a person colonized with bacteria comprising treating the colonized person with a pharmaceutical composition containing bacteriophage of one or more strains of the Deposited Bacteriophage which produce lytic infections in said bacteria, wherein said treatment occurs prior to said colonized person developing an illness due to said bacteria and said treatment reduces the risk of bacterial infection or sepsis in said colonized person, and wherein said treatment of the colonized person reduces the level of colonization with bacteria susceptible to the bacteriophage by at least 50%, wherein said composition is administered intravesicularly, topically, orally, rectally, ocularly, optically, vaginally, topically, nasally, or via inhalation. Additionally, said bacteria is *Campylobacter*. In a more preferred embodiment, the bacteriophage composition is an oral tablet, capsule, enteric coated gel cap, tablet, gummy, liquid or syrup, a nasal aerosol, a throat wash, a mouth wash or gargle, a toothpaste, and a topical ointment. In another embodiment, the colonized person is a person having a diarrhea, and the bacteriophage produce lytic infections in bacteria capable of causing diarrhea.

In any embodiment, a method for reducing the risk of bacterial infection or sepsis in a person not colonized with *Campylobacter* spp. bacteria comprising treating the person with a pharmaceutical composition containing bacteriophage of one or more strains of the Deposited Bacteriophage which produce lytic infections in said *Campylobacter* spp. bacteria, wherein said treatment occurs prior colonization of the person or development an illness due to said bacteria and said treatment reduces the risk of bacterial infection or sepsis in person, and wherein said treatment of the person prevents the colonization with bacteria susceptible to the bacteriophage, wherein said composition is administered intravesicularly, vaginally, topically, orally, rectally, ocularly, optically, nasally, or via inhalation. In a more preferred embodiment, the bacteriophage composition is an oral tablet, capsule, enteric-coated gel cap, enteric-coated tablet, syrup, gummy, liquid, a nasal aerosol, a throat wash, a mouth wash or gargle, a toothpaste, and a topical ointment. In another embodiment, the person is a person having a diarrhea and bloating, and the bacteriophage produce lytic infections in *Campylobacter* spp. bacteria causing these symptoms.

In another embodiment of the invention, a composition may comprise at least one of the Deposited Bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. In another embodiment, the composition further comprises a pharmaceutically acceptable carrier wherein the pharmaceutically acceptable carrier is an aerosol, a paste, a powder, a syrup, or an injectable formulation. In some embodiments, the composition may be a dietary supplement and/or nutraceutical composition.

Another embodiment comprises the use of a bacteriophage composition comprising at least one of the isolated bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains for the prevention of food borne illnesses caused by *Campylobacter* strains comprising contacting a food product or products with a microbial growth inhibiting effective amount of said bacteriophage composition. In a preferred embodiment, said contacting comprises spraying or misting or fogging the bacteriophage composition on wheat kernels, flour, or other food product(s), or by dipping or soaking these product(s) in a solution containing a concentration of the bacteriophage composition sufficiently high to inhibit the growth of *Campylobacter* strains, or adding, injecting or inserting the bacteriophage composition in said concentrations into the food product(s) or package which contains said food product(s).

In any embodiment, the pharmaceutical composition is formulated as a capsule, tablet, chewable composition, syrup, or gel. In any embodiment, the capsule may be an enteric-coated gel capsule.

In one embodiment, method of preventing or treating campylobacteriosis comprising administering an effective amount of the pharmaceutical composition of paragraph 56 to a patient in need thereof. In any embodiment, patient is an adult, infant, or child. In any embodiment, child is less than 5 years of age.

In any embodiment, the dietary supplement and/or nutraceutical composition may include a probiotic bacteria, preferably *Lactobacillus* species, preferably *L. acidophilus, L. rhamnosus, L. gasseri, L. reuteri, L. bulgaricus, L. plantarum, L. johnsonii, L. paracasei, L. casei, L. salivarius*, or *L. lactis, Bifidobacterium* species, preferably *B. bifidum, B. longum, B. breve, B. infantis, B. lactis*, or *B. adolescentis, Streptococcus thermophilus, Bacillus cerus, Bacillus subtilis, Enterococcus faecalis, Enterococcus faecium*, or a combination thereof.

In any embodiment, the dietary supplement and/or nutraceutical composition of any one of paragraphs 55, 59, or 60 wherein the composition further comprises a probiotic yeast, preferably *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii*, or a combination thereof.

In another embodiment, method of preventing or treating campylobacteriosis comprising administering an effective amount of the nutraceutical composition of paragraph 56 to a person in need thereof. In any embodiment, person is an adult, infant, or child. In any embodiment, child is less than 5 years of age.

In another embodiment, method of preventing or treating campylobacteriosis comprising administering an effective amount of the nutraceutical composition of paragraphs 56, 60, and/or 61. to a person in need thereof. In any embodiment, person is an adult, infant, or child. In any embodiment, child is less than 5 years of age.

In at least one embodiment, the invention provides a method for the reduction in the incidence of food borne illnesses caused by *Campylobacter* strains comprising contacting food processing equipment with a microbial growth inhibiting effective amount of a bacteriophage composition comprising at least one of the isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. In any such embodiment, the contact may comprise spraying or misting or fogging the bacteriophage composition on the food processing equipment, dipping or soaking the food processing equipment in a solution containing a concentration of the bacteriophage composition sufficiently high to inhibit the growth of *Campylobacter* strains, or adding, injecting or inserting the bacteriophage composition into the food processing equipment; or spraying or misting the bacteriophage composition on a surface used in food processing. In several embodiments, the foods are wheat kernels (including outer shell, bran, germ, and endosperm), flour, poultry meat, red meat, shellfish, fruits and vegetables, dairy products, healthy drinks, and ready-to-eat foods. In several embodiments, the *Campylobacter* strain is *Campylobacter jejuni, Campylobacter coli, Campylobacter upsaliensis*, or a combination thereof. In several embodiments, the *Campylobacter* strains are *Campylobacter jejuni, Campylobacter coli, Campylobacter upsaliensis*, or a combination thereof.

In at least one embodiment, the invention provides a method for reducing colonization by *Campylobacter* spp. bacteria strains of a subject comprising administration of an effective amount of a nutraceutical composition comprising at least one of the isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. In several embodiments, the nutraceutical composition is formulated as a capsule, tablet, chewable composition, syrup, or gel. In several embodiments, the capsule is a gel capsule.

In several embodiments, the subject is an adult, infant, or child. In several embodiments, the child is less than 5 years of age.

In several embodiments, the *Campylobacter* strain is *Campylobacter jejuni, Campylobacter coli*, and *Campylobacter upsaliensis*, or a combination thereof. In several embodiments, the *Campylobacter* strains are *Campylobacter upsaliensis, Campylobacter jejuni* subsp. *jejuni, Campylobacter jejuni* subsp. *doylei, Campylobacter coli, Campylobacter lari, Campylobacter upsaliensis, Campylobacter helveticus, Campylobacter concisus, Campylobacter showae, Campylobacter curvus, Campylobacter rectus, Campylobacter gracilis, Campylobacter sputorum*, and *Campylobacter hominis*, or a combination thereof.

In several embodiments, a method for modulating an animal (including human) microbiome by reducing colonization by *Campylobacter* spp. bacteria strains may comprise administration of an effective amount of a composition comprising at least one of the isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. In one embodiment, the method reduces colonization of the gastrointestinal tract, vagina, skin, or a combination thereof.

In several embodiments, a method for maintaining healthy gut microflora by modulating an animal (including human) microbiome by reducing colonization by *Campylobacter* spp. bacteria strains may comprise administration of an effective amount of a composition comprising at least one of the isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. In one embodiment, the method reduces colonization of the gastrointestinal tract, vagina, skin, or a combination thereof.

In any of the foregoing embodiments, the composition is a pharmaceutical composition, nutraceutical composition, dietary supplement, probiotic, and/or prebiotic.

In any of the foregoing embodiments, the animal is already colonized by a *Campylobacter* bacteria spp. strains.

In any of the foregoing embodiments, the animal is not colonized by a *Campylobacter* bacteria spp. strains.

In any of the foregoing embodiments, the bacteriophage is present in a composition in an amount of $10^3$ and $10^{11}$ PFU. In any of the foregoing embodiments, the animal may be a human. In any of the foregoing embodiments, the human may be an adult, infant, or child. In any of the foregoing embodiments, the child may be less than 5 years of age.

BRIEF DESCRIPTION OF THE FIGURES

FIG. 1 is a plot showing camamplyobacter infection incidence rates during 1996-2018.

FIG. 2 illustrates an example Restriction Fragment Length Polymorphism (RFLP) pattern of bacteriophage CJLB-4 sequence virtually digested with the enzyme HhaI.

FIG. 3 illustrates an example RFLP pattern of bacteriophage CJLB-7 sequence virtually digested with the enzyme HhaI.

FIG. 4 illustrates an example RFLP pattern of bacteriophage CJLB-10 sequence virtually digested with the enzyme HhaI.

FIG. 5 illustrates an example RFLP pattern of bacteriophage CJLB-12 sequence virtually digested with the enzyme HhaI.

FIG. 6 illustrates an example RFLP pattern of bacteriophage CJLB-14 sequence virtually digested with the enzyme HhaI.

FIG. 7 illustrates an example RFLP pattern of bacteriophage CJLB-15 sequence virtually digested with the enzyme HhaI.

FIG. 8 illustrates an example RFLP pattern of bacteriophage CJLB-5 sequence virtually digested with the enzyme HhaI.

FIG. 9 illustrates an example RFLP pattern of bacteriophage CJLB-13 sequence virtually digested with the enzyme HhaI.

FIGS. 10A-10K illustrate an example partial genome sequence of bacteriophage CJLB-4, which corresponds SEQ ID NO. 1.

FIGS. 11A-11I illustrate an example partial genome sequence of bacteriophage CJLB-5, which corresponds to SEQ ID NO. 2.

FIGS. 12A-12AF illustrate an example complete genome sequence of bacteriophage CJLB-7, which corresponds to SEQ ID NO. 3.

FIGS. 13A-13AF illustrate an example complete genome sequence of bacteriophage CJLB-10, which corresponds to SEQ ID NO. 4.

FIGS. 14A-14AO illustrate an example complete genome sequence of bacteriophage CJLB-12, which corresponds to SEQ ID NO. 5.

FIGS. 15A-15BB illustrate an example partial genome sequence of bacteriophage CJLB-13, which correspond to SEQ ID NO. 6-12.

FIGS. 16A-16AN illustrate an example complete genome sequence of bacteriophage CJLB-14, which corresponds to SEQ ID NO. 13.

FIG. 17A-FIG. 17BQ illustrate an example partial genome sequence of bacteriophage CJLB-15, which correspond to SEQ ID NO. 14-26.

RESTRICTION FRAGMENT LENGTH POLYMORPHISM (RFLP) ANALYSIS OF C. JEJUNI BACTERIOPHAGES

*C. jejuni* phage DNA is notoriously difficult to digest with common restriction enzymes. Therefore, virtual RFLP pattens were generated for each of the Deposited Bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), or CJLB-15 (PTA-126846), as briefly outlined below. The bacteriophages were sequenced on Illumina (of San Diego, CA)'s MiSeq System with read length 2×250 bp. Reads were trimmed for illumine adapter, length (≥50 bp), quality (q≥20) and mapped to *C. jejuni* RefSeq NC_002163.1. The unmapped reads were collected and assembled using Unicycler assembler as described, for example, in Wick R R, Judd L M, Gorrie C L, Holt K E. Unicycler: Resolving bacterial genome assemblies from short and long sequencing reads. PLOS Computational Biology. 2017; 13 (6): e1005595, which is incorporated by reference herein in relevant part. For six out of the eight phages (CJLB-4, CJLB-7, CJLB-10, CJLB-12, CJLB-14, and CJLB-15), a single consensus contig was obtained. Sequences for phages CJLB-5 and CJLB-13 failed to generate a consensus contig and were further processed to generate reference-guided assemblies. Briefly, contigs were aligned to *Campylobacter* phage CP8 (for CJLB-5) and CP220 (for 384) using AlignGraph2 and Minimap2 on a local Galaxy Server, such as the one described, for example, by Afgan E, Baker D, Batut B, van den Beek M, Bouvier D, Čech M, et al. The Galaxy platform for accessible, reproducible and collaborative biomedical analyses: 2018 update. Nucleic Acids Research. 2018; 46 (W1): W537-W44 ("Afgan"), which is incorporated by reference herein in relevant part. The consensus sequences were generated using bcftools in Samtools suite. The CJLB-5 and CJLB-13 were assembled to 75% and 67% completeness as determined by CheckM toolas described, for example, by Parks D H, Imelfort M, Skennerton C T, Hugenholtz P, Tyson G W. CheckM: assessing the quality of microbial genomes recovered from isolates, single cells, and metagenomes. Genome Research. 2015; 25 (7): 1043-55, which is incorporated by reference herein in relevant part. The contigs were uploaded on the online tool Restriction Analyzer by molbiotools.com. A custom list of restriction enzymes of HhaI, TaqI and MboI were generated using the online form. The sequences were virtually digested using various combinations of three restriction enzymes with tool set to "linear sequence" and "ignore sites blocked by methylation". MboI did not cut any of the sequences, while HhaI and TaqI each had multiple target sites in all sequences. The RFLP patterns of the eight Deposited Bacteriophages resulting from virtual digestion with HhaI are shown in FIG. 2-FIG. 9.

Genome Analysis and Average Nucleotide Identity of the *C. jejuni* Lytic Phages

Eight lytic bacteriophages were sequenced on the MiSeq Sequencer with read length 2×250 bp. Reads were trimmed for illumina adapter, length (≥50 bp), quality (q≥20) and mapped to *C. jejuni* RefSeq NC_002163.1. The unmapped reads were collected and assembled using Unicycler assembler. For six out of eight phages a single consensus contig was obtained, while two phages assembled in multiple contigs. The strain delineation was assessed by calculating average nucleotide identity over genome (gANI), for example as described by Jain. The GenBank accession numbers for the genome sequences of the Deposited Bacteriophages are as follows:

| Phage ID | ATTC Deposit Number | GenBank Accession Number | Released to Public on[§] |
| --- | --- | --- | --- |
| CJLB-5 | PTA-126840 | MW057932 | Jan. 2, 2023 |
| CJLB-7 | PTA-126841 | MW057933 | Jan. 2, 2023 |
| CJLB-10 | PTA-126842 | MW074124 | Jan. 2, 2023 |
| CJLB-12 | PTA-126843 | MW074125 | Jan. 2, 2023 |
| CJLB-14 | PTA-126845 | MW074126 | Jan. 2, 2023 |
| CJLB-4 | PTA-126839 | MW057783 | Jan. 2, 2023 |
| CJLB-13 | PTA-126844 | MW373745 | Jan. 2, 2023 |
| CJLB-15 | PTA-126846 | MW365733 | Jan. 2, 2023 |

The assembled contigs were analyzed in pairwise fashion using the fastANI tool, for example as described by Jain, on a local instance of Galaxy server, for example as described by Afgan, installed on an in-house Linux server. The fastANI tool was run with default setting to report ≥80% gANI for each genome pair. gANI<80% was considered divergent.

Cutoff values of gANI>99.9 were used to determine if the two sequences were identical. Sequence delineation was interpreted based on previously published cutoff values presented by Olm and Jain:

ANI<80% Divergent genomes
ANI≥95% Same species

ANI≥98% Same genetic clade
ANI≥99.9% Same strain

Based on this classification by Olm and Jain, bacteriophages with ANI≥95% could be considered "same species" and bacteriophages with ANI<80% could be considered "divergent." When applying this classification to the eight Deposited Bacteriophages, all Deposited Bacteriophages are distinct from each other (Table 1). The result demonstrate that CJLB-5, CJLB-7 and CJLB-10 are closely related to one another, and CJLB-12, CJLB-13, CJLB-14 and CJLB-15 are closely related to one another (but all are distinct/"divergent" from one another). For reference, two previously published lytic *Campylobacter* phages CP8 and CP220 were also included in the analysis, the result show that CP8 and CP220 can be considered within the same species grouping with certain lytic phages isolated by Intralytix but are relatively divergent from each other. Of note, CP8 is classified as Fletchrvirus while CP220 is classified as Firehammervirus.

TABLE 1

Average nucleotide identity (gANI) of *C. jejuni* phages (%)

|  | CJLB-5 | CJLB-7 | CJLB-10 | CJLB-12 | CJLB-13 | CJLB-14 | CJLB-15 | CP8 | CP220 |
|---|---|---|---|---|---|---|---|---|---|
| CJLB-4 | <80.0 | <80.0 | <80.0 | <80.0 | <80.0 | <80.0 | <80.0 | <80.0 | <80.0 |
| CJLB-5 |  | 97.6 | 98.1 | <80.0 | <80.0 | <80.0 | <80.0 | 96.8 | <80.0 |
| CJLB-7 |  |  | 98.0 | <80.0 | <80.0 | <80.0 | <80.0 | 96.6 | <80.0 |
| CJLB-10 |  |  |  | <80.0 | <80.0 | <80.0 | <80.0 | 96.7 | <80.0 |
| CJLB-12 |  |  |  |  | 99.3 | 98.1 | 99.2 | <80.0 | 95.0 |
| CJLB-13 |  |  |  |  |  | 97.9 | 98.9 | <80.0 | 94.4 |
| CJLB-14 |  |  |  |  |  |  | 98.3 | <80.0 | 95.3 |
| CJLB-15 |  |  |  |  |  |  |  | <80.0 | 95.6 |
| CP8 |  |  |  |  |  |  |  |  | 91.3 |

Tables

Table 1 shows average nucleotide identity (gANI) of the Deposited Bacteriophages Table 2 shows the lytic specificity of the Deposited Bacteriophages for *Campylobacter* species, the Targeted Bacteria.

Table 3 shows the lytic specificity of the Deposited Bacteriophages for non-Targeted Bacteria of the other bacterial species.

DETAILED DESCRIPTION OF THE PREFERRED EMBODIMENTS

Definitions

The terminology used in the description of the invention herein is for the purpose of describing particular embodiments only and is not intended to be limiting of the invention. As used in the description of the embodiments of the invention and the appended claims, the singular forms "a", "an" and "the" are intended to include the plural forms as well, unless the context clearly indicates otherwise. Also, as used herein, "and/or" refers to and encompasses any and all possible combinations of one or more of the associated listed items. Furthermore, "about," as used herein when referring to a measurable value such as an amount of a compound, dose, time, temperature, and the like, is meant to encompass variations of 20%, 10%, 5%, 1%, 0.5%, or even 0.1% of the specified amount. Unless otherwise defined, all terms, including technical and scientific terms used in the description, have the same meaning as commonly understood by one of ordinary skill in the art to which this invention belongs.

"Administration," as used herein, refers broadly to any means by which a composition is given to a subject, be it a patient, healthy or diseased human, or other healthy or diseased animal species.

"ATCC," as used herein, refers to the American Type Culture Collection, located at 10801 University Boulevard, Manassas, Virginia, 20110-2209, USA.

"Bacteriophage composition," as used herein refers broadly to a composition comprising, or alternatively consisting essentially of, or alternatively consisting of, the Deposited Bacteriophage. A "bacteriophage composition" as used herein does not include the Deposited Bacteriophage as it exists in its natural environment prior to isolation and/or substantial purification. Further, a composition may comprise, consist of, or essentially consist of at least one of the Deposited Bacteriophages. Alternatively, the compositions as described herein may comprise, consist of, or essentially consist of at least one, two, three, four, five, six, seven, or all eight of the Deposited Bacteriophages.

"Bacteriophages substantially equivalent to the Deposited Bacteriophages," as used herein, refers broadly to those bacteriophages that are "indistinguishable" from or "closely related" to the Deposited Bacteriophages as these terms are defined in Tenover F C, Arbeit R D, Goering R V, Mickelsen P A, Murray B E, Persing D H, et al. Interpreting chromosomal DNA restriction patterns produced by pulsed-field gel electrophoresis: criteria for bacterial strain typing. J Clin Microbiol. 1995; 33 (9): 2233-9 ("Tenover"), which is incorporated by reference herein in relevant part, for PFGE patterns and/or in Olm or Jain for full genome sequence analyses. For example, Tenover describes that organisms are "genetically indistinguishable if their restriction patterns have the same numbers of bands and the corresponding bands are the same apparent size." Epidemiologically, these organisms are "all considered to represent the same strain, i.e., isolates demonstrating the common outbreak pattern represent the outbreak strain." Accordingly, under Tenover, a particular organism is "indistinguishable" from itself or its clone. Tenover describes that an organism is "closely related" if its "PFGE pattern differs from the outbreak pattern by changes consistent with a single genetic event, i.e., a point mutation or an insertion or deletion of DNA. Such changes typically result in two to three band differences." Tenover states that such two to three band differences "have been observed in strains of some species when they are cultured repeatedly over time or isolated multiple times from the same patient." Accordingly, under Tenover, progeny of an organism (e.g., descendants of the organism created by serial passage of the organism), for example, are "closely related" to the parent organism. For genome-based sequence analysis, Olm and Jain et al. define as "Same Species" organisms with the average nucleotide identity over genome (gANI) of ANI≥95% said criteria used herein for defining bacteriophages substantially equivalent to the Deposited Bacteriophages.

"Colonization" or "colonized," as used herein, refers broadly to the presence of Targeted Bacteria on foodstuff(s), or environmental surface(s), or in vivo such as in the gastrointestinal tract or skin of a mammalian organism without perceptible significant alteration other than the presence of bacteria. The terms "colonization" and "colonized" stand in contrast to the terms "infection" or "infected" which are commonly understood to require perceptible deleterious alteration as part of their definition. "Colonization" and "colonized" may also refer to the presence of bacteria in or on a human or animal without perceptible damage, alteration, or disease.

"Deposited Bacteriophage," as used herein, refers broadly to isolated bacteriophages CJLB-4 deposited with the ATCC on Sep. 30, 2020, Deposit Accession No. PTA-126839, CJLB-5 deposited with the ATCC on Sep. 30, 2020, Deposit Accession No. 126840, CJLB-7 deposited with the ATCC on Sep. 30, 2020, Deposit Accession No. 1126841, CJLB-10 deposited with the ATCC on Sep. 30, 2020, Deposit Accession No. 1126842, CJLB-12 deposited with the ATCC on Sep. 30, 2020, Deposit Accession No. 1126843, CJLB-13 deposited with the ATCC on September 30, Deposit Accession No. 1126844, CJLB-14 deposited with the ATCC on Sep. 30, 2020, Deposit Accession No. 1126845, and CJLB-15 deposited with the ATCC on Sep. 30, 2020, Deposit Accession No. 1126846.

Bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), and CJLB-15 (PTA-126846) were deposited with the American Type Culture Collection at 10801 University Blvd, Manassas, VA 20110 under the Budapest Treaty on the International Recognition of the Deposit of Microorganisms for the Purposes of Patent Procedure.

Additionally, "Deposited Bacteriophage," as used herein, refers broadly to isolated bacteriophages CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), and CJLB-15 (PTA-126846) deposited with the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. All of the Deposited Bacteriophages described herein are lytic not lysogenic phages. The Deposited Bacteriophages have lytic activity against *Campylobacter* strains.

"Derivatives," as used herein, refers broadly to all substances that constitute subunits or expression products of the Deposited Bacteriophage or its progeny, including (but not limited to) phage nucleic acids, partial or complete phage genes, gene expression products, and structural components. For example, derivatives of the invention mean polyribonucleotide(s) and polydeoxyribonucleotide(s), including modified or unmodified bacteriophage DNA, cDNA, mRNA and synthetic polynucleotide sequences, as well as DNA/RNA hybrids. In another example, polynucleotides of the invention encompass modified polynucleotides, such as for example phosphorylated DNAs. In yet another example, gene expression products mean phage-encoded exopolysaccharide degrading enzymes.

"Effective amount," as used herein, refers broadly to the amount of an isolated bacteriophage that, when administered to an animal (e.g., human patient) for treating a disease, is sufficient to affect such treatment for the disease. The effective amount can be an amount effective for prevention and/or an amount effective for treatment. The effective amount can be an amount effective to reduce the incidence of food borne illnesses, an amount effective to prevent incidence of food borne illnesses, to reduce the severity of infection, to eliminate infection, to slow the development of the infection, to prevent the development of infection (colonization). The "effective amount" can vary depending on the disease and its severity and the age, weight, medical history, predisposition to conditions, preexisting conditions, of the patient to be treated. The term "effective amount" is taken to be synonymous with "therapeutically effective amount" for purposes of this invention.

"Isolated," as used herein, refers broadly to material removed from its original environment in which it naturally occurs, and thus is altered by the hand of man from its natural environment. Isolated material may be, for example, foreign nucleic acid included in a vector system, foreign nucleic acid contained within a host cell, or any material which has been removed from its original environment and thus altered by the hand of man. Isolated material further encompasses bacteriophage specific for the Targeted Bacteria or particular Targeted Bacteria isolates, isolated and cultured separately from the environment in which it was located, where these isolates are present in purified compositions that do not contain any significant amount of other bacteriophage or bacterial strains, respectively.

"Mammal" as used herein, refers broadly to any and all warm-blooded vertebrate animals of the class Mammalia, including humans, characterized by a covering of hair on the skin and, in the female, milk-producing mammary glands for nourishing the young. Examples of mammals include but are not limited to alpacas, armadillos, capybaras, cats, chimpanzees, chinchillas, cattle, dogs, goats, gorillas, horses, humans, lemurs, llamas, mice, non-human primates, pigs, rats, sheep, shrews, and tapirs. Mammals include but are not limited to bovine, canine, equine, feline, murine, ovine, porcine, primate, and rodent species. Mammal also includes any and all those listed on the Mammal Species of the World maintained by the National Museum of Natural History, Smithsonian Institution in Washington DC, which is hereby incorporated by reference.

"ORF," as used herein, refers broadly to an Open Reading Frame which is an in-frame sequence of codons that (in view of the genetic code) correspond to or encode a protein or peptide sequence. Two ORFs correspond to each other if the sequences or their complementary sequences encode the same amino acid sequences. An ORF sequence, operably associated with appropriate regulatory sequences, may be transcribed and translated into a polypeptide in vivo. A polyadenylation signal and transcription termination sequence will usually be located 3' to the coding sequence.

"Patient" as used herein, refers broadly to any animal, including humans, who is in need of treatment either to alleviate a disease state or to prevent the occurrence or reoccurrence of a disease state. Also, "Patient" as used herein, refers broadly to any animal who has risk factors, a history of disease, susceptibility, symptoms, signs, was previously diagnosed, is at risk for, or is a member of a patient population for a disease. The patient can be a clinical patient such as a human or a veterinary patient such as a companion, domesticated, livestock, exotic, or zoo animal. Animals can be mammals, reptiles, birds, amphibians, or invertebrates.

"Progeny," as used herein, refers broadly to replicates of the Deposited bacteriophage, including descendants of the Deposited bacteriophage created by serial passage of the Deposited bacteriophage or by other means well known in the art, or bacteriophage whose RFLP profiles are substantially equivalent to the RFLP profile of the Deposited bacteriophage (See FIG. 2-FIG. 9). The term substantially equivalent is used to describe variability between organisms in accordance with the standards advanced by Tenover for RFLP patterns or by Olm and Jain for genome sequence analysis. For example, Tenover discloses the acceptable levels of variation that may be seen when the genomes of identical propagated organisms are electrophoretically analyzed following restriction enzyme digestion. Bacteriophages "substantially equivalent" to the Deposited Bacteriophages are "indistinguishable" from or "closely related" to the Deposited Bacteriophages. Tenover describes a system for interpreting chromosomal DNA Restriction Enzyme digest patterns ("RFLP") using Pulsed-Field Gel Electrophoresis (PFGE). In particular, Tenover set forth various categories of genetic and epidemiologic relatedness including those organisms that are "indistinguishable" from or "closely related" to each other. While Tenover provide a schematic (prophetic) example of PFGE patterns of genetically related bacteria, the same principles being applied for bacteria also apply to bacteriophage, because Tenover is analyzing genomic DNA. For genome sequence-based analysis, Olm and Jain et al. define as "Same Species" organisms with ANI≥95% said criteria used herein for defining "Progeny" of the Deposited Bacteriophages.

"Recombinant bacteriophage," as used herein, refers broadly to all genetically modified versions of the Deposited Bacteriophage or its progeny, obtained by serial passaging (in vivo or in vitro) or genetic manipulations of the Deposited Bacteriophage or its progeny. Such manipulations include, but are not limited to, introducing genes or gene cassettes encoding alternative proteins or nonfunctional proteins, or noncoding nucleotide sequences into the genome of the Deposited Bacteriophages, or removing certain genes or gene cassettes from the Deposited Bacteriophages.

"Substantially pure," as used herein refers broadly to material essentially free of any similar macromolecules that would normally be found with it in nature. For example, a substantially pure bacteriophage is in a composition that contains no more than 1% of other bacteriophages.

"Targeted Bacteria," as used herein, refers broadly to *Campylobacter* species including but not limited to *Campylobacter upsaliensis, Campylobacter jejuni* subsp. *jejuni, Campylobacter jejuni* subsp. *doylei, Campylobacter coli, Campylobacter lari, Campylobacter upsaliensis, Campylobacter helveticus, Campylobacter concisus, Campylobacter showae, Campylobacter curvus, Campylobacter rectus, Campylobacter gracilis, Campylobacter sputorum*, and *Campylobacter hominis*.

"Therapy" or "therapeutic," as used herein, refers broadly to treating a disease, arresting or reducing the development of the disease or its clinical symptoms, and/or relieving the disease, causing regression of the disease or its clinical symptoms. Therapy encompasses prophylaxis, prevention, treatment, cure, regimen, remedy, minimization, reduction, alleviation, and/or providing relief from a disease, signs, and/or symptoms of a disease. Therapy encompasses an alleviation of signs and/or symptoms in patients with ongoing disease signs and/or symptoms, e.g. of infection. Therapy also encompasses "prophylaxis" and "prevention". Prophylaxis includes preventing disease occurring subsequent to treatment of a disease in a patient or reducing the incidence or severity of the disease in a patient. The term "reduced", for purpose of therapy, refers broadly to the clinically significant reduction in signs and/or symptoms. Therapy includes treating relapses or recurrent signs and/or symptoms, e.g. of colonization. Therapy encompasses but is not limited to precluding the appearance of signs and/or symptoms anytime as well as reducing existing signs and/or symptoms and eliminating existing signs and/or symptoms. Therapy includes treating chronic disease ("maintenance") and acute disease.

"Variants," as used herein, refers broadly to bacteriophages that share the same phenotypic characteristics of the Deposited Bacteriophage and share the same lytic activity of the Deposited Bacteriophages against the Targeted Bacteria. Variants also include bacteriophages that are "substantially equivalent" to the Deposited Bacteriophages or are "indistinguishable" from or "closely related" to the Deposited Bacteriophages as described in Tenover for RFLP-based analysis, or fall under the "Same Species" classification (i.e., ANI≥95%) as defined by Olm and Jain et al. for full genome sequence-based analysis.

"Microgel," as used herein, refers to cross-linked or interwoven three-dimensional polymeric networks. The microgels may be hydrogels, which may absorb and retain large amounts of water. The Deposited Bacteriophage or derivatives thereof may be encapsulated in, embedded in, cross-linked to, etc. the microgel. The microgels may undergo abrupt volume changes in response to environmental factors such as temperature, ionic strength, and pH. Accordingly, the physical and chemical properties of the microgel may be customized for controlled release of encapsulated amounts of the Deposited Bacteriophage or derivatives thereof in particular environmental conditions. The microgel may be a biodegradable microgel that includes degradable linkages in the polymer or cross-linker.

The Deposited Bacteriophages

The Deposited Bacteriophages have binding specificity for Targeted Bacteria and are capable of lysing Targeted Bacteria. The invention further contemplates variants of the Deposited Bacteriophage, which are bacteriophage having minor variation(s) in the genomic sequence and polypeptides encoded thereby while retaining the same general genotypic and phenotypic characteristics as the Deposited Bacteriophage. Such variants are considered to be the Deposited Bacteriophages in accordance with the standards advanced by Tenover for RFLP-based analysis, or fall under the "Same Species" classification (i.e., ANI≥95%) as advanced by Olm and Jain for full genome sequence-based analysis. The invention also contemplates progeny and bacteriophage derivative(s). The progeny, variants, substantially equivalent bacteriophages, and bacteriophage derivative(s) of the Deposited Bacteriophage all retain the same target specificity (e.g., the Target Bacteria) and are lytic phages.

The invention contemplates the use of the Deposited Bacteriophage, and its progeny and derivatives, to control the growth on, or colonization of, processed and unprocessed food products by Targeted Bacteria, or the colonization of buildings and equipment, particularly those associated with the processing of the same food product. The invention also provides methods of identifying Targeted Bacteria as a bacterial diagnostic and/or detecting the presence of Targeted Bacteria on processed or unprocessed food products, or equipment or buildings such as those involved in the processing of the same food products. The invention further provides methods of using the Deposited Bacteriophages for the removal of antibiotic-resistant or other undesirable pathogens from medical, veterinary, animal husbandry, or any additional environments where they may be passed to humans or animals. The invention additionally provides for methods of using the Deposited Bacteriophages to prevent and/or treat human and animal diseases caused by Targeted Bacteria. The Deposited Bacteriophages are administered for the methods of the invention as a homogenous phage administration, or alternatively as a component of a multi-phage composition comprising several bacteriophages, or alternatively combination of thereof with one or more prebiotic bacterial strain(s) and/or one or more probiotic yeast strain(s). These methods of use are provided with greater particularity infra.

Using methods and materials known in the art, a person of skill in art in possession of the Deposited Bacteriophage, will inevitably be in possession of progeny of the Deposited Bacteriophages. Indeed, after successive sub culturing of the Deposited Bacteriophages, progeny having genetic variations within the scope of "closely related" organisms are present. Furthermore, again only relaying on methods and materials known in the art, a person of skill in the art in possession of the Deposited Bacteriophage will be able to isolate and identify variants of the Deposited Bacteriophages as described herein. In particular, the variants of the Deposited Bacteriophage having minor variation(s) in the genomic sequence and polypeptides encoded thereby while retaining the same general genotypic and/or phenotypic characteristics as the Deposited Bacteriophage. Such variants are considered to be the Deposited Bacteriophage in accordance with the standards advanced by Tenover for RFLP-based analysis, or by Olm and Jain et al. for "Same Species" for full genome sequence-based analysis. In particular, these variants may be the result of successive passaging of the Deposited Bacteriophage where the variants accumulate silent mutations, conservative mutations, minor deletions, and/or minor replications of genetic material. The variants described herein of the Deposited Bacteriophage retain the phenotypic characteristics of the Deposited Bacteriophage, in a preferred embodiment, the variants have lytic activity against the Target Bacteria.

Furthermore, bacteriophages substantially equivalent to the Deposited Bacteriophages are those bacteriophages that are "indistinguishable" from or "closely related" to the Deposited Bacteriophages under Tenover (RFLP-based analysis), or "Same Species" under Olm and Jain (full genome sequence-based analysis). Progeny of an organism (e.g., descendants of the organism created by serial passage of the organism), for example, are "closely related" to the parent organism, or the "Same Species" as the parent organism.

Additionally, the Deposited Bacteriophages can be used to isolate derivatives, in particular all substances that constitute subunits or expression products of the Deposited bacteriophage or its progeny, including (but not limited to) phage nucleic acids, partial or complete phage genes, gene expression products, and structural components. For example, derivatives of the invention mean polyribonucleotide(s) and polydeoxyribonucleotide(s), including modified or unmodified bacteriophage DNA, cDNA, mRNA and synthetic polynucleotide sequences, as well as DNA/RNA hybrids. Polynucleotides of the invention also encompass modified polynucleotides, such as for example phosphorylated DNAs. Depending upon the phage, the nucleic acid can be either DNA or RNA but not both and it can exist in various forms. Further, the nucleic acids of phages often contain unusual or modified bases. These modified bases protect phage nucleic acid from nucleases that break down host nucleic acids during phage infection. The size of the nucleic acid varies depending upon the phage. The phages can have only enough nucleic acid to code for 3-5 average size gene products while some phages may code for over 100 gene products.

The Targeted Bacteria—*Campylobacter* Spp. Bacteria

*Campylobacter* a genus of motile Gram-negative bacteria capable of infecting humans and other animals and causing disease. The bacterium's main natural reservoir is poultry; humans can contract the disease from eating food contaminated with *Campylobacter* species. *Campylobacter* can cause a gastrointestinal infection called campylobacteriosis. *Campylobacter* has also been associated with periodontitis, and with some other disease, including hemolytic uremic syndrome, thrombotic thrombocytopeniarpura, and the Guillain-Barré syndrome.

The genus *Campylobacter* was formed in 1963 and its taxonomic structure has changed extensively since its inception. At present, the genus *Campylobacter* contains 16 species and six subspecies, including *Campylobacter upsaliensis, Campylobacter jejuni* subsp. *jejuni, Campylobacter jejuni* subsp. *doylei, Campylobacter coli, Campylobacter lari, Campylobacter upsaliensis, Campylobacter helveticus, Campylobacter concisus, Campylobacter showae, Campylobacter curvus, Campylobacter rectus, Campylobacter gracilis, Campylobacter sputorum,* and *Campylobacter hominis*. Most human illness (approx. 90%) is caused by one *Campylobacter* species, called *Campylobacter jejuni*, but other *Campylobacter* species (e.g., *Campylobacter coli*, and *Campylobacter upsaliensis*) have been also implicated in human illness.

For additional information about *Campylobacter*, see Section *Campylobacter* spp. BACTERIA.

Use of the Deposited Bacteriophage and their Progeny Compositions

The Deposited Bacteriophage, and its progeny and derivatives, may be used to control the growth on, or colonization of, processed and unprocessed food products by Targeted Bacteria, or the colonization of buildings and equipment, particularly those associated with the processing of the same food product. The invention also provides methods of identifying Targeted Bacteria as a bacterial diagnostic and/or detecting the presence of Targeted Bacteria on processed or unprocessed food products, or equipment or buildings such as those involved in the processing of the same food products. Methods of using the Deposited Bacteriophages include for the removal of antibiotic-resistant or other undesirable pathogens from medical, veterinary, animal husbandry, or any additional environments where they may be passed to humans or animals. Methods of using the Deposited Bacteriophages to prevent and/or treat human and animal diseases caused by Targeted Bacteria comprise administration of an effective amount of the Deposited Bacteriophage. The Deposited Bacteriophages are administered for the methods of the invention as a homogenous phage administration, or alternatively as a component of a multi-phage composition comprising several bacteriophages. These methods of use are provided with greater particularity infra.

The Deposited Bacteriophage are formulated in compositions containing the bacteriophage and a carrier and can be stored as a concentrated aqueous solution or dried powder preparation, where dry powder preparation is obtained by convection drying, bed drying, drum drying, freeze drying (lyophilization), microwave-vacuum drying, shelf drying, electrostatic drying, infrared radiation drying, fluidized bed drying, or spray drying.

The Deposited Bacteriophage may be formulated in a chewable or gel cap or tablet composition, for example comprising gelatin, water, and the Deposited Bacteriophage, optionally including citric acid, sugar, pectin, and combinations thereof. The Deposited Bacteriophage may be formulated for oral administration with probiotic bacteria, preferably *Lactobacillus* species, preferably *L. acidophilus, L. rhamnosus, L. gasseri, L. reuteri, L. bulgaricus, L. plantarum, L. johnsonii, L. paracasei, L. casei, L. salivarius,* or *L. lactis, Bifidobacterium* species, preferably *B. bifidum, B. longum, B. breve, B. infantis, B. lactis,* or *B. adolescentis, Streptococcus thermophilus, Bacillus cerus, Bacillus subtilis, Enterococcus faecalis, Enterococcus faecium,* or a combination thereof. The probiotic bacteria may be included in the composition in an amount of 1-10 billion Colony Forming Units (CFU), preferably 100-10 billion CFU.

The Deposited Bacteriophage may be formulated in a chewable or gel cap or tablet composition, for example comprising gelatin, water, and the Deposited Bacteriophage, optionally including citric acid, sugar, pectin, and combinations thereof. The Deposited Bacteriophage may be formulated for oral administration with probiotic yeast, preferably *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii,* or a combination thereof. The probiotic yeast may be included in the composition in an amount of 1-10 billion Colony Forming Units (CFU), preferably 100-10 billion CFU. Phage may be included in the composition in an amount of 100-one quadrillion Plague Forming Units (PFU), preferably 1,000-100 billion PFU.

The Deposited Bacteriophage may be formulated in a chewable or gel cap or tablet composition, for example comprising gelatin, water, and the Deposited Bacteriophage, optionally including citric acid, sugar, pectin, and combinations thereof. The Deposited Bacteriophage may be formulated for oral administration with probiotic yeast (preferably *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii,* or a combination thereof) and probiotic yeast (preferably *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii,* or a combination thereof). The probiotic bacteria may be included in the composition in an amount of 1-10 billion CFU, preferably 100-10 billion CFU; the probiotic yeast may be included in the composition in an amount of 1-10 billion CFU, preferably 100-10 billion CFU; and phage may be included in the composition in an amount of 100-one quadrillion PFU, preferably 1,000-100 billion PFU.

Bacteriophage may be formulated by resuspending purified phage preparation in aqueous medium, such as deionized water, buffer solution (e.g., Tris-HCl pH 7.4), mineral water, 5% sucrose solution, glycerol, dextran, polyethylene glycol, sorbitol, or other formulations that maintain phage viability, and are non-toxic to humans. Suitable formulations, wherein the carrier is a liquid, for administration (e.g., a nasal spray or as nasal drops, include aqueous or oily solutions of the active ingredient.) The bacteriophage may be formulated in a chewable or enteric-coated gel capsule/tablet composition comprising deionized water, buffer solution, preferably Tris-HCl pH 7.4, mineral water, 5% sucrose solution, glycerol, dextran, polyethylene glycol, sorbitol, cellulose, tapioca dextrin, hydroxypropyl methylcellulose, gellan gum, or a mixture thereof. The bacteriophage may be formulated in a chewable composition comprising polyethylene glycol, preferably PEG 3350, a sweetening agent, preferably a sugar, a polymer, preferably pectin, an organic acid, preferably citric acid, and a polyol, preferably maltitol.

A spray (including coarse spray, fine spray, mist-like spray, or fog-like spray) comprising a composition of the present invention can be produced by forcing a suspension or solution of a compound disclosed herein through a nozzle under pressure. The nozzle size and configuration, the applied pressure, and the liquid feed rate can be chosen to achieve the desired output and particle size. An electrospray can be produced, for example, by an electric field in connection with a capillary or nozzle feed.

The Deposited Bacteriophage may be formulated in pharmaceutical compositions containing the bacteriophage and a pharmaceutically acceptable carrier and can be stored as a concentrated aqueous solution or lyophilized powder preparation. Concentrated aqueous solutions may comprise an aqueous solution with a small volume (e.g., 0.1 mL to 1 mL) and bacteriophage in an amount of about $10^3$ and $10^{11}$ PFU/mL. The concentrated aqueous solution comprising a Deposited Bacteriophage may comprise the bacteriophage at about $2 \times 10^4$ PFU/mL, $1 \times 10^6$ PFU/mL, $1 \times 10^7$ PFU/mL, or $1 \times 10^8$ PFU/mL. For example, the concentrated aqueous solution may comprise 0.1 mL to 1 mL of a Deposited Bacteriophage at about $2 \times 10^4$ and $1 \times 10^9$ PFU/mL. The aqueous solution may have a pH of pH 6.5-7.5.

The Deposited Bacteriophage may be formulated as a frozen composition comprising LB broth and glycerol, e.g., 70% LB broth-30% glycerol, and stored at −80° C.

Bacteriophage may be formulated for oral administration by resuspending purified phage preparation in aqueous medium, such as deionized water, mineral water, 5% sucrose solution, glycerol, dextran, polyethylene glycol, sorbitol, or such other formulations that maintain phage viability, and are non-toxic to humans. Alternatively, the pharmaceutical composition can further comprise an adjuvant. The pharmaceutical composition may contain other components so long as the other components do not reduce the effectiveness of the bacteriophage so much that the therapy is negated. Pharmaceutically acceptable carriers are well known, and one skilled in the pharmaceutical art can easily select carriers suitable for particular routes of administration (Remington's Pharmaceutical Sciences, Mack Publishing Co., Easton, PA., 1985).

The pharmaceutical compositions containing Deposited Bacteriophage may be administered by parenteral (subcutaneously, intramuscularly, intravenously, intraperitoneally, intrapleurally, intravesicularly or intrathecally), topical, oral, rectal, inhalation, ocular, vaginal, optic, or nasal route, as necessitated by choice of drug and disease.

The Deposited Bacteriophage may be formulated in a pharmaceutical composition, as a dietary supplement (alone or in combination with other bacteria-based and/or yeast-based supplements), probiotic, and/or prebiotic that reduces or eliminates colonization of GI tract (including oral cavity), vagina, or skin with *Campylobacter* spp. In effect, the Deposited Bacteriophage may be used to modulate a patient's microbiome.

The Deposited Bacteriophage may be used in a method for prophylactic treatment of a subject comprising administering the Deposited Bacteriophage to the subject in an amount sufficient to reduce *Campylobacter* spp. by at least 50%. In this method, the alteration of normal microflora of the individual is minimized. The subject may be a human. The Deposited Bacteriophage may be administered periodically, for example daily. The Deposited Bacteriophage can be administered in a tablet, capsule, or food or drinking additive. Additionally, a method for maintaining normal flora in a population may comprise administering the Deposited Bacteriophage to a subject in an amount sufficient to reduce *Campylobacter* spp. bacteria by at least 50%, whereby alteration of normal microflora is minimized. The amount administered may be an amount sufficient to eliminate *Campylobacter* spp. bacteria.

The invention provides a nutraceutical composition comprising at least one of the Deposited Bacteriophages, progeny, and/or variants thereof and a suitable carrier.

The Deposited Bacteriophage(s) of the invention may be administered in a powdered form in combination with additional components. The additional components can include stabilizing agents, such as salts, preservatives, bacteria-based supplements, yeast-based supplements, and antibiotics. The additional components can include nutritive components, such as those used to make a nutrient broth as described herein, or other useful components as determined by one skilled in the art.

The Deposited Bacteriophage may be administered in pharmaceutical compositions containing the Deposited Bacteriophage and a microgel. For example, the Deposited Bacteriophage may be encapsulated in, embedded in, cross-linked to, etc. the microgel. Typically the composition will contain at least $10^3$ PFU phage/g microgel, preferably between $10^6$ to $10^{11}$ PFU phage/g microgel. In some embodiments, the composition of the microgel is adapted to release the Deposited Bacteriophage in the environmental conditions found inside of a macrophage. In some embodiments, the microgel may be prepared by cross-linking polymers formed from anionic monomers and polymers formed from ionic monomers. For example, a microgel may be prepared by cross-linking poly(acrylic acid) ("PAA") with poly(ethyleneglycol) ("PEG") to form a poly(acrylic acid)-poly(ethyleneglycol) (PAA-PEG) microgel or hydrogel. In such embodiments, the PAA may have a molecular weight of about 25,000, the PEG may have a molecular weight of about 5,000, and the microgel may have a degree of cross-linking of about 35%. In another example, the microgel may include nanosized polymeric microgel particles including a cross-linked polymer network of polyionic segments and neutral segments as described in Vinogradov, S. V., Colloidal microgels in drug delivery applications. Curr Pharm Des, 2006. 12 (36): p. 4703-4712 ("Vinogradov), which is incorporated by reference herein in relevant part. Exemplary polyionic segments may be polyethylenimine (PEI) and/or PAA. Exemplary neutral segments may be PEG or Pluronic.

In some embodiments, the pharmaceutical compositions containing the Deposited Bacteriophage and the microgel may be adapted for macrophage-targeted delivery. Such compositions may enhance the ability of phages to manage infections caused by intracellular bacterial pathogens, such as those that are internalized by macrophages as part of the immune response. In such embodiments, the microgel containing the Deposited Bacteriophage may be formed into a plurality of microgel particles that are sized to be suitable for phagocytosis by macrophages. For example, the microgel particles may have diameters of about 1 μm to about 4 μm. In some embodiments, non-mammalian carbohydrates such as mannose, chitosan, and β-glucan may be incorporated into the microgel particles to induce phagocytosis of the microgel particles by macrophages. For example, β-glucan may be hybridized into the microgel particles as described by Tae (43). In some embodiments, the microgel particles including the Deposited Bacteriophage may be injected into a patient. In some embodiments, the microgel particles including the Deposited Bacteriophage may be intravenously administered to a patient. In some embodiments, the microgel particles including the Deposited Bacteriophage may be orally administered to a patient.

A nutraceutical composition of this invention may comprise at least one Deposited Bacteriophage in combination with an acceptable carrier. Examples of acceptable carriers include a solid, gelled or liquid diluent or an ingestible capsule. One or more of the bacteriophages of the invention, or a mixture thereof, may be administered orally in the form of a pill dosage form comprising the bacteriophage in combination with an acceptable carrier. A unit dosage of the bacteriophage may also be administered without a carrier material.

A nutraceutical composition comprising at least one Deposited Bacteriophage in combination with an acceptable carrier may be in the form of a capsule, tablet, gel, syrup, or chewable composition (e.g., gummy bear). A chewable composition may comprise a binding agent, a sweetener, and at least one Deposited Bacteriophage. Pectin, food starch, gum, or any combination thereof may be used as the binding agent in the chewable composition. The chewable compositions may also include a flavorant, vitamins, carriers, excipients, or a combination thereof. For example, a chewable composition (e.g., gummy bear) may comprise a gummy bear mixture of sugar, glucose syrup, starch, flavoring, food coloring, citric acid, and/or gelatin, and at least one Deposited Bacteriophage. For example, a chewable composition (e.g., gummy bear) may comprise a mixture of deionized water, buffer solution, preferably Tris-HCl pH 7.4, mineral water, 5% sucrose solution, glycerol, dextran, polyethylene glycol, sorbitol, cellulose, tapioca dextrin, hydroxypropyl methylcellulose, gellan gum, or a mixture thereof.

The nutraceutical compositions of the invention may include dietary supplements, pre-biotics, probiotics, and may be prepared in many forms that include tablets, hard or soft gelatin capsules, aqueous solutions, suspensions, and liposomes and other slow-release formulations, such as shaped polymeric gels. For example, a pill composition may comprise at least one dried Deposited Bacteriophage contained in a size "00" gel cap. An oral dosage form may be formulated such that the bacteriophage(s) of the invention are released into the intestine after passing through the stomach, to protect phage from the acidic environment (typical pH of 1.5 to 3.5) of the stomach (e.g., in enteric coated gel caps, preferably in size "0" or "00," with the capsule capacity of 408-816 mg or 546-1,092 mg, respectively).

Oral liquid nutraceutical compositions may be in the form of, for example, aqueous or oily suspensions, solutions, emulsions, syrups, or elixirs, or may be presented as a dry product for constitution with water or other suitable vehicle before use. Such liquid compositions may contain conventional additives such as suspending agents, emulsifying agents, non-aqueous vehicles (which may include edible oils), or preservatives. For example, a gel may comprise at least one Deposited Bacteriophage.

Oral liquid nutraceutical compositions may be in the form of, for example, aqueous or oily suspensions, solutions, emulsions, syrups, or elixirs, or may be presented as a dry product for constitution with water or other suitable vehicle before use. Such liquid compositions may contain conventional additives such as suspending agents, emulsifying agents, non-aqueous vehicles (which may include edible oils), or preservatives. For example, a gel may comprise at least one Deposited Bacteriophage. In another example, an enteric capsule may comprise of at least one Deposited Bacteriophage and at least one probiotic bacteria. In yet another example, an enteric capsule may comprise of at least one Deposited Bacteriophage, at least one probiotic bacteria, and at least one probiotic yeast.

A pharmaceutical composition comprising at least one Deposited Bacteriophage in combination with a pharmaceutically acceptable carrier may be in the form of a capsule, tablet, gel, syrup, or chewable composition (e.g., gummy bear). A chewable composition may comprise a binding agent, a sweetener, and at least one Deposited Bacteriophage. Pectin, food starch, gum, or any combination thereof may be used as the binding agent in the chewable composition. The chewable compositions may also include a natural flavor, vitamins, carriers, excipients, or a combination thereof. For example, a chewable composition (e.g., gummy bear) may comprise a gummy bear mixture of sugar, glucose syrup, starch, flavoring, food coloring, citric acid, and/or gelatin, and at least one Deposited Bacteriophage. For example, a chewable composition (e.g., gummy bear) may comprise a mixture of deionized water, buffer solution, preferably Tris-HCl pH 7.4, mineral water, 5% sucrose solution, glycerol, dextran, polyethylene glycol, sorbitol, cellulose, tapioca dextrin, hydroxypropyl methylcellulose, gellan gum, or a mixture thereof.

The bacteriophages according to the invention may also be formulated for parenteral administration (e.g., by injection, for example, bolus injection or continuous infusion) and may be presented in unit dosage form in ampules, prefilled syringes, small volume infusion containers or multi-dose containers with an added preservative. The pharmaceutical compositions may take such forms as suspensions, solutions, or emulsions in oily or aqueous vehicles, and may contain formulatory agents such as suspending, stabilizing and/or dispersing agents. Alternatively, the bacteriophage(s) of the invention may be in powder form, obtained by drying from solution, for constitution with a suitable vehicle, e.g., sterile saline, before use. Methods for use of bacteriophage in injectable form have been described, for example in Merril C R, Biswas B, Carlton R, Jensen N C, Creed G J, Zullo S, et al. Long-circulating bacteriophage as antibacterial agents. Proc Natl Acad Sci USA. 1996; 93 (8): 3188-92, which is incorporated by reference herein in relevant part.

For topical administration to the epidermis, the bacteriophage(s) may be formulated as ointments, creams, or lotions. Ointments and creams may, for example, be formulated with an aqueous or oily base with the addition of suitable thickening and/or gelling agents. Lotions may be formulated with an aqueous or oily base and will in general also contain one or more emulsifying agents, stabilizing agents, dispersing agents, suspending agents, thickening agents, or coloring agents.

Pharmaceutical compositions or nutraceutical compositions suitable for topical administration in the mouth include unit dosage forms such as lozenges comprising a bacteriophage(s) of the invention in a flavored base, usually sucrose and acadia or tragacanth. Pastilles comprising one or more bacteriophages in an inert base such as gelatin and glycerin or sucrose and acacia are also provided. Mucoadherent gels and mouthwashes comprising a bacteriophage(s) of the invention in a suitable liquid carrier are additionally provided.

The present invention relates to stabilized bacteriophage formulations and their use as delivery systems. More particularly, the present invention pertains to stabilized bacteriophage formulations, methods for preparing stabilized bacteriophage formulations, and uses of stabilized bacteriophage formulations. For example, a pharmaceutical composition or nutraceutical composition may comprise at least one of the Deposited Bacteriophages and a water-soluble polymer and sugar, derivatives of cellulose, or polyvinylpyrrolidone low or medium molecular, or glycols with a molecular weight of 4000 or 6000, or sodium alginate, and sugars-trehalose and/or maltodextrin and/or lactose and/or mannitol as cellulose derivatives used sodium salt of carboxymethylcellulose, or a mixture thereof.

The present invention provides a method for producing a composition comprising, adsorbing an aqueous solution of bacteriophages, or phage components, onto a solid or powdered matrix to produce composition, and drying the composition to produce a composition, when drying is accomplished by convection drying, bed drying, drum drying, freeze drying (lyophilization), microwave-vacuum drying, shelf drying, infrared radiation drying, electrostatic drying, fluidized bed drying, or spray drying.

The present invention also pertains to the method described above wherein the matrix may be selected from the group consisting of skim milk powder, soya protein powder, whey protein powder, albumin powder, casein, gelatin, single cell proteins, algal protein, plant peptone, trehalose, maltodextrin, mannitol, powdered sugar, sugar alcohol, charcoal, latex beads, a water-soluble carbohydrate-based material, talc, chitin, and fish cartilage.

The present invention also provides a nutraceutical composition comprising at least one Deposited Bacteriophage, or phage component, adsorbed onto a matrix.

The present invention also provides a pharmaceutical composition comprising at least one Deposited Bacteriophage, or phage component, adsorbed onto a matrix.

The present invention includes the material as defined above, wherein the soluble matrix is selected from the group consisting of skim milk powder, soya protein, albumin powder, single cell proteins, trehalose, mannitol, sugar and sugar alcohol.

The compositions of the present invention are easy to prepare and exhibit the property of being stable over various lengths of time at refrigerator and room temperatures, from about −10° C. to about 25° C.

Compositions of the present invention with little or no loss in titer. The antibacterial compositions of the present invention may be used within lotions, lubricants, gels and creams, suppositories, toothpaste, be admixed with a pharmaceutically acceptable carrier for oral, nasal, or topical applications for example but not limited to skin, vaginal, ophthalmic, nasal, aural, anal, rectal, and other types of administration, or be used within wound dressings, and exhibit antimicrobial activity.

The present invention provides stabilized phage preparations in a dry form as a delivery system for powder inhalants. The present invention also provides a suitable matrix for preparing phage or phage compositions for encapsulation and delivery to the gut past the stomach acids.

Pharmaceutical compositions or nutraceutical compositions suitable for rectal administration are most preferably presented as unit dose suppositories. Suitable carriers include saline solution, nutrient broths, and other materials commonly used in the art. Compositions suitable for vaginal administration may be presented as pessaries, tampons, creams, gels, pastes, foams or sprays that contain a carrier in addition to a bacteriophage. Such carriers are well known in the art.

For administration by inhalation, the bacteriophage(s) according to the invention are conveniently delivered from an insufflator, nebulizer or a pressurized pack or other convenient means of delivering an aerosol spray. Pressurized packs may comprise a suitable propellant such as dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount.

Alternatively, for administration by inhalation or insufflation, the bacteriophage(s) of the invention may take the form of a dry powder composition, for example, a powder mix of the bacteriophage(s) and a suitable powder base such as lactose or starch. The powder composition may be presented in unit dosage form in, for example, capsules or cartridges or, e.g., gelatin or blister packs from which the powder may be administered with the aid of an inhalator or insufflator. For intra-nasal administration, the bacteriophage(s) of the invention may be administered via a liquid spray, such as via a plastic bottle atomizer. For topical administration to the eye, the bacteriophage(s) according to the invention can be administered as drops and gels.

Pharmaceutical compositions or nutraceutical compositions of the invention may also contain other adjuvants such as flavorings, colorings, anti-microbial agents, or preservatives. The invention also provides kits containing packaging and a bacteriophage(s) of the invention.

Dose and duration of therapy will depend on a variety of factors, including the patient age, patient weight, and tolerance of the phage. Bacteriophage may be administered to patients in need of the therapy provided by this invention by oral administration. Based on previous human experience in the former Soviet Union and Europe, a dose of phage between $10^6$ and $10^{11}$ PFU will be suitable in most instances. For example, the bacteriophage may be present in a composition in an amount between $10^3$ and $10^{11}$ PFU. The bacteriophage may be present in a composition in an amount about $10^3$, $10^4$, $10^5$, $10^6$, $10^7$, $10^8$, $10^9$, $10^{10}$, or $10^{11}$ PFU. The bacteriophage may be present in a composition in an amount between $10^3$ and $10^8$, $10^4$ and $10^9$, $10^5$ and $10^{10}$, or $10^7$ and $10^{11}$ PFU. The phage may be administered orally in, for example, mineral water, optionally with 1.0-3.0 grams of sodium bicarbonate added to reduce stomach acidity. Alternatively, sodium bicarbonate may be administered separately to the patient just prior to dosing with the phage. Phages also may be incorporated in a tablet or capsule which will enable transfer of phages through the stomach with no or little reduction of phage viability due to gastric acidity, and release of active phages in the small intestine (with potential additional protection against bile salts). The frequency of dosing will vary depending on how well the phage is tolerated by the patient and how effective a single versus multiple doses is at reducing bacterial (e.g., *Campylobacter*) gastrointestinal colonization.

The dose of Deposited Bacteriophage and duration of therapy for a particular patient can be determined by the skilled clinician using standard pharmacological approaches in view of the above factors. The response to treatment may be monitored by, analysis of blood, fecal matters, or body fluid levels of *Campylobacter*, or *Campylobacter* levels in relevant tissues or monitoring disease state in the patient. The skilled clinician will adjust the dose and duration of therapy based on the response to treatment revealed by these measurements.

One of the major concerns about the use of phages in clinical settings is the possible development of bacterial resistance against them. However, as with antimicrobial resistance, the development of resistance to phages takes time. The successful use of phages in clinical settings will require continual monitoring for the development of resistance, and, when resistance appears, the substitution of other phages to which the bacterial mutants are not resistant. In general, phage preparations may be constructed by mixing several separately grown and well-characterized lytic phages, in order to (i) achieve the desired, broad target activity of the phage preparation, (ii) ensure that the preparation has stable lytic properties, and (iii) minimize the development of resistance against the preparation. The invention provides for a method of formulating phage preparations comprising of one or more of Deposited Bacteriophage to reduce the frequency of bacterial resistance against phages.

The invention also provides for a method for modulating an animal's microbiome by preventing colonization or reducing colonization by *Campylobacter* spp. comprising administration of an effective amount of a composition comprising at least one of the isolated bacteriophage CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), and CJLB-15 (PTA-126846) deposited to the ATCC, said bacteriophage having lytic activity against *Campylobacter* strains, and variants thereof, wherein said variants retain the phenotypic characteristics of said bacteriophage and wherein said bacteriophage and variants thereof have lytic activity against *Campylobacter* strains. The composition may be a pharmaceutical composition or nutraceutical composition including dietary supplement, probiotic, and/or prebiotic. The composition may be formulated as a capsule, tablet, suppository, chewable composition, syrup, or gel. The capsule may be a gel capsule, preferably enteric coated gel capsule. In a method for modulating an animal's microbiome by preventing or reducing colonization by *Campylobacter* spp., the patient may be an adult, infant, or child, for example, a child is less than 5 years of age. The *Campylobacter* spp. strain may be *Campylobacter upsaliensis*, *Campylobacter jejuni* subsp. *jejuni*, *Campylobacter jejuni* subsp. *doylei*, *Campylobacter coli*, *Campylobacter lari*, *Campylobacter upsaliensis*, *Campylobacter helveticus*, *Campylobacter concisus*, *Campylobacter showae*, *Campylobacter curvus*, *Campylobacter rectus*, *Campylobacter gracilis*, *Campylobacter sputorum*, and *Campylobacter hominis*, or a combination thereof.

In a method for modulating an animal's microbiome by reducing colonization by *Campylobacter* spp. bacteria strains the patient may be colonized by a *Campylobacter* bacteria spp. strains. The bacteriophage may be present in the pharmaceutical composition or nutraceutical composition in an amount of $10^3$ and $10^{11}$ PFU. The method may reduce *Campylobacter* bacteria spp. colonization of the gastrointestinal tract, vagina, skin, or a combination thereof.

The development of neutralizing antibodies against a specific phage also is possible, especially after parenteral administration (it is less of a concern when phages are administered orally and/or locally). However, the development of neutralizing antibodies may not pose a significant obstacle in the proposed clinical settings, because the kinetics of phage action is much faster than is the host production of neutralizing antibodies. For example, phages can be used for a few days (e.g., 1-10 days), sufficient to reduce bacterial colonization during the time period when immunocompromised patients are most susceptible to the development of potentially fatal septicemia, but not long enough for phage-neutralizing antibodies to develop. If the development of anti-phage antibodies is a problem, several strategies can be used to address this issue. For example, different phages having the same spectrum of activity (but a different antigenic profile) may be administered at different times during therapy. On a more sophisticated level, therapeutic phages may be genetically engineered which will have a broad lytic range and/or be less immunogenic in humans and animals.

It will be appreciated that the amount of the present bacteriophages, required for use in treatment will vary not only with the particular carrier selected but also with the route of administration, the nature of the condition being treated and the age and condition of the patient. Ultimately the attendant health care provider may determine proper dosage.

Food Preservation

In one embodiment, the invention contemplates a method for the prevention of foodborne illnesses or spoilage caused by the Targeted Bacteria, comprising contacting a food product or products intended for humans or animals with a microbial growth inhibiting effective amount of a bacteriophage composition comprising the Deposited Bacteriophage. The modes of contact include, but are not limited to, spraying, misting, or fogging the Deposited Bacteriophages composition on the food product(s), or by dipping or soaking the food product(s) in a solution containing a concentration of the Deposited Bacteriophages sufficiently high to inhibit the growth of Targeted Bacteria, or adding, injecting or inserting the Deposited Bacteriophages into the food product(s) in a said concentration.

In another embodiment, the invention contemplates the application of the Deposited Bacteriophages composition to equipment associated with the processing of food product(s), such as cutting instruments, conveyor belts, and any other implements utilized in the production of food products, including the preparation, storage and packaging steps of food processing. The Deposited Bacteriophages can additionally be introduced into packaging materials used to contain food product(s), prior to or following transfer of the food product(s) to the packaging materials. Alternatively, the Deposited Bacteriophages can be useful in the local processing of food products located, for example, in the home or in a restaurant kitchen, using the same modes of contact as described supra.

In another embodiment of the invention, the Deposited Bacteriophages are added as a component of paper products, either during processing or after completion of processing of the paper products. Paper products to which the Deposited Bacteriophages may be added include, but are not limited to, paper towels, toilet paper, moist paper wipes. In a preferred embodiment of the invention, the Deposited Bacteriophages are added as a component of cleansing wipes. The Deposited Bacteriophages may be added in an aqueous state to a liquid-saturated paper product, or alternatively may be added in powder form, to dry paper products, or any combination thereof. In similar manner, the Deposited Bacteriophages may be incorporated into films such as those used for packaging foods, such as by impregnating or coating the film or plastic or paper containers or bags used for storing or transporting food products.

The methods of the invention further contemplate the application of the Deposited Bacteriophages to the floors, walls, ceilings, drains, or other environmental surfaces in structures such as the industrial food processing, military, or home environments. In a particularly preferred embodiment of the invention, the Deposited Bacteriophages are applied to refrigerated devices used to store or transport food or food products, including but not limited to, home and industrial refrigerators, deli-meat and cheese counters, refrigerated trucks, and mobile food-service vehicles.

In a non-limiting embodiment of the invention, the Deposited Bacteriophages of the invention are useful in preventing the colonization of, or inhibiting the growth of, Targeted Bacteria on processed or unprocessed food products by infecting, lysing or inactivating Targeted Bacteria present on said food product. Processed or unprocessed food products intended for humans in which the Deposited Bacteriophages are particularly useful in preventing the growth or colonization of Targeted Bacteria include, but are not limited to poultry and beef (particularly ground poultry), fresh vegetables exposed to Targeted Bacteria such as lettuce, spinach, green onions, and other fresh fruits and vegetables commonly grown out of doors in fields. Processed or unprocessed food products intended for animals in which the Deposited Bacteriophages are particularly useful include wet pet foods, moist pet foods, and dry pet foods intended for household pets, as well as feed intended for domesticated animals such as horses, cows, sheep, pigs, chickens, turkeys, and fish raised in farming or aquaculture environments.

The Deposited Bacteriophages can also be administered to potable and non-potable water sources to reduce or eliminate the presence of Targeted Bacteria.

Bacteriophage compositions of the invention may be provided in aqueous or non-aqueous embodiments for the preservation of food.

Aqueous embodiments of the Deposited Bacteriophages include aqueous compositions comprising, or alternatively consisting of, one of the Deposited Bacteriophages alone or in combination with other Deposited Bacteriophages, or with another bacteriophage or other bacteriophages. Aqueous embodiments of the Deposited Bacteriophages are available in solutions that include, but are not limited to, phosphate buffered saline, Luria-Bertani Broth or water with the levels of chlorine less than 10 ppm.

Non-aqueous embodiments of the Deposited Bacteriophages include, but are not limited to, dried compositions comprising, or alternatively consisting of, the Deposited Bacteriophages alone or in combination with other bacteriophage(s). Freeze-dried and spray-dried compositions may also include soluble and/or insoluble carrier materials as, for example, processing aids.

The Deposited Bacteriophages can be administered at a concentration effective to prevent the initial colonization of foods with Targeted Bacteria, or to inhibit the growth or colonization of food or food products, as well as the equipment used to process or store food. In a non-limiting embodiment of the invention, the Deposited Bacteriophages typically administered at a growth inhibiting effective amount of a concentration of about $10^7$ to about $10^{11}$ Plaque Forming Units (PFU)/mL. One of skill in the art is capable of ascertaining bacteriophage concentrations using widely known bacteriophage assay techniques. The Deposited Bacteriophages at such concentrations may be applied at, for example, about 1-2 mL/500 $cm^2$ of food surface or $10^6$-$10^{10}$ PFU/g food product.

Food Processing Uses

The present invention provides a method for preventing growth of microorganisms on food products comprising contacting a food product with an effective amount of a composition comprising at least one of the Deposited Bacteriophage for the prevention of growth of *Campylobacter* microorganisms on food products. The prevention of growth of microorganisms on food products is intended to provide a food product that is devoid of or contains minimal numbers of viable microorganisms that could cause illness in humans or animals or spoilage of the food product prior to ingestion. The food product may be fruit juices, vegetable juices, produce (including fruits, vegetables, grains, and oats), wheat kernels, flour, seafood and selfish, poultry, beef, lamb, or pork.

The prevention of growth of microorganisms on food products is intended to include but is not limited to the following mechanisms: (1) removal of attached microorganisms from the food products; (2) inhibition of attachment of microorganisms to the food products; (3) killing or inactivation of attached microorganisms on the food products; and (4) killing or inactivation of microorganisms which are not attached to the food product but which are present in liquids associated with the food products during processing; such as in chill tanks, or which are present on surfaces associated with food preparation, liquids remaining on such surfaces, such as countertops, cutting boards and sinks, and equipment used in food preparation and sanitization of the food.

The present invention has an important application in the food processing industry, as well as for home and institutional food preparation. The Deposited Bacteriophage compositions of the invention are readily available and the cost of carrying out the method of the present invention is not expensive as compared to existing antimicrobial processes. Unlike existing treatments using, for example, trisodium phosphate or irradiation, the use of the Deposited Bacteriophage compositions of the invention does not alter the appearance, color, taste, or texture of the food product. Moreover, the Deposited Bacteriophage compositions of the invention are non-toxic. The Deposited Bacteriophage compositions may be readily applied to food processing equipment and food processing workspaces. For example, a composition comprising the Deposited Bacteriophage may be applied by spraying onto a surface or equipment used in food processing. The Deposited Bacteriophage compositions may be readily applied to food preparation equipment and food preparation workspaces, e.g., surfaces used in food preparation work.

The Deposited Bacteriophage composition is applied for a period of time sufficient to kill *Campylobacter* bacteria present on the food product. It is important that the application time of the Deposited Bacteriophage compositions is for a sufficient time to result in significant prevention of growth of *Campylobacter* on the food product.

The present invention also includes methods of contacting the Deposited Bacteriophage compositions of the invention with food products, including but not limited to, spraying or misting or fogging the compound on the food product, or by immersing the food product in a composition comprising at least one of the Deposited Bacteriophages of the invention.

The present invention is intended to encompass any method that contacts the Deposited Bacteriophage compositions of the invention with a food product by any direct means, including spraying, misting, fogging, dipping, or soaking. But the present invention also is intended to include contact of the Deposited Bacteriophage compositions of the invention with the food by indirect means, such as applying the Deposited Bacteriophage compositions of the invention to equipment or food product processing or preparation surfaces in which the food product is contacted during processing, preparation, storage, and/or packaging.

Any type of method of contact of the Deposited Bacteriophage compositions with the food product is are preferred as long if it is capable of allowing a short application time: A method that utilizes a cabinet that provides spraying or misting or fogging of the food product is useful in the present invention. Machinery for use in such cabinets on a processing line in a food processing plant are adaptable for reducing the application time to a minimum while still obtaining efficacious antimicrobial effects on the food.

The present method is useful, for example, in a poultry processing plant for treating post-chilled chickens that have been immersed in a chill bath of cold water. The chickens are removed from the chill bath and treated with the Deposited Bacteriophage compositions of the invention for an application time sufficient to result in significant prevention of growth of microorganisms on the chickens. The treated chickens are subsequently packaged without further washing or rinsing. However, the method optionally may include, if deemed necessary, at least one washing step of the chickens prior to packaging. The optional washing step may include spraying or misting the food product with water or immersing the food product in a container or tank of water.

Further, the method of the present invention can optionally include a determination step prior to contacting the food product with the Deposited Bacteriophage compositions of the invention to determine the presence of microorganisms on the food before treatment. Any conventional methods for rapidly determining the presence of microorganisms can be utilized as the determination step, which for example, includes PCR and immunoassays.

Further, the method of the present invention can optionally include a determination step to select the Deposited Bacteriophage compositions that are most effective in reducing or eliminating *Campylobacter* in the food product. For example, *Campylobacter* strains could be screened for their susceptibility to each of the Deposited Bacteriophages by the drop-on-lawn method, also known as the "spot test" method, essentially as described in Example 9; once the testing results are available, the Deposited Bacteriophages most effective in lysing the targeted *Campylobacter* strains could be selected and formulated into the Deposited Bacteriophage composition that is most effective in reducing or eliminating *Campylobacter* in the food product.

Additionally, the method of the present invention optionally includes a step to determine the presence of the bacteriophage compositions of the invention on the surface of the food product after contact with the Deposited Bacteriophage compositions. This determination is performed immediately after the contacting step or after several washing steps. For example, the Deposited Bacteriophage compositions of the invention is extracted from the tissues of the food in a form suitable for high performance liquid chromatography (HPLC) analysis or PCR analysis or direct plating analysis.

The food processing industry, as well as home, restaurant or institutional food preparation, is in need of more effective products and processes for the prevention of growth of a broad range of contaminating microorganisms on many different food products and/or surfaces that the food products and juices or liquids from the food come in contact. This is especially true for microorganisms which are attached to the surfaces of food. As a result of increasing numbers of illnesses caused by foodborne pathogenic microorganisms, the food processing industry now requires more effective processes for the removal and prevention of a broader spectrum of microorganisms, and particularly for pathogenic microorganisms, such as *Campylobacter*, which are known to cause serious human diseases as a result of food contamination. The present invention provides a composition comprising at least one Deposited Bacteriophages of the invention and methods of preventing the growth of microorganisms on and in the food, as well as in liquids and on surfaces associated with food products and their preparation. This method of prevention is an important goal in preventing cross-contamination from infected food products; in removing attached microorganisms from food products; in inhibiting the attachment of microorganisms to the food products; and in preventing the growth of microorganisms that remain attached to the food products. Further, the method of the present invention can easily be adapted for use in a food processing plant.

Environmental Control

In another embodiment of the invention, the Deposited Bacteriophages are administered to environments to control the growth or viability of Targeted Bacteria. Environments in which the Deposited Bacteriophages are useful to control the growth or viability of Targeted Bacteria include, but are not limited to, abattoirs, meat processing facilities, feedlots, vegetable processing facilities, medical facilities (including hospitals, out-patient clinics, school and/or university infirmaries, and doctors' offices), military facilities, veterinary offices, animal husbandry facilities, public and private restrooms, and nursing and nursing home facilities. The invention further contemplates the use of the Deposited Bacteriophages for the battlefield decontamination of food stuffs, the environment, and personnel and equipment, both military and non-military.

The Deposited Bacteriophages are additionally useful alone or in combination with other bacteriophage(s) and/or other compounds (e.g., exopolysaccharide-degrading enzymes encoded by the phage genomes), for preventing the formation of biofilms, or controlling the growth of biofilms, in various environments. Aqueous embodiments of the Deposited Bacteriophages are available in solutions that include, but are not limited to, phosphate buffered saline, Luria-Bertani Broth or chlorine-free water (water that contains less than 10 ppm chlorine). In a particularly preferred embodiment, the Deposited Bacteriophages are used to control biofilm formation and growth in municipal water systems, industrial water systems, and personal water systems, as well as biofilms present in refrigerated environments.

The modes of administration include, but are not limited to, spraying, hosing, and any other reasonable means of dispersing aqueous or non-aqueous bacteriophage compositions, in an amount sufficiently high to inhibit the growth or viability of Targeted Bacteria. In a non-limiting embodiment of the invention, the Deposited Bacteriophages are useful in preventing the growth or viability of Targeted Bacteria by infecting, lysing, or inactivating Targeted Bacteria present in said environment. Administration of the Deposited Bacteriophages composition includes application to the floors, walls, counter-tops, ceilings, drains or any other environmental surface.

Bacteriophage compositions of the invention are available in aqueous or non-aqueous embodiments discussed earlier for Food Preservation applications.

In another embodiment of the invention, the Deposited Bacteriophages are added as a component of paper products, either during processing or after completion of processing of the paper products. Paper products to which the Deposited Bacteriophages may be added include, but are not limited to, paper towels, toilet paper, and moist paper wipes. In a preferred embodiment of the invention, the Deposited Bacteriophages are added as a component of cleansing wipes; it may be added in an aqueous state to a liquid-saturated paper product, or alternatively may be added in powder form such as a spray-dried preparation, to dry paper products, or any combination thereof.

The Deposited Bacteriophages can be administered at a concentration effective to inhibit the growth or viability of Targeted Bacteria in a particular environment. In a non-limiting embodiment of the invention, the Deposited Bacteriophages are administered at a concentration of about $10^7$ to $10^{11}$ PFU/mL. In another non-limiting embodiment of the invention, the Deposited Bacteriophages are administered at a concentration of about 10-100 mL/500 $cm^2$ of environmental surface. One of skill in the art is capable of ascertaining bacteriophage concentrations using widely known bacteriophage assay techniques.

Nutraceutical Uses (Dietary Supplements, Prebiotics, or Probiotics)

The Deposited Bacteriophages may be formulated into nutraceutical compositions, which could include one or more of the Deposited Bacteriophages and be in the form of dietary supplements, prebiotics, or probiotics.

In addition to one or more of the Deposited Bacteriophages, the nutraceutical compositions may also include one or more probiotic bacterial strains, preferably *Lactobacillus* species, preferably *L. acidophilus, L. rhamnosus, L. gasseri, L. reuteri, L. bulgaricus, L. plantarum, L. johnsonii, L. paracasei, L. casei, L. salivarius*, or *L. lactis*, *Bifidobacterium* species, preferably *B. bifidum, B. longum, B. breve, B. infantis, B. lactis,* or *B. adolescentis, Streptococcus thermophilus, Bacillus cerus, Bacillus subtilis, Enterococcus faecalis, Enterococcus faecium*, or a combination thereof.

In addition to one or more of the Deposited Bacteriophages, the nutraceutical compositions may also include one or more probiotic yeast strains, preferably *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii*, or a combination thereof.

In addition to one or more of the Deposited Bacteriophages, the nutraceutical compositions may also include one or more aforementioned probiotic bacterial strains and yeast strains.

The nutraceutical compositions may be administered to a patient, wherein the Deposited Bacteriophages lyse the Targeted Bacteria. This lysis of the Targeted Bacteria may lead to a better microflora balance and confer a health benefit on the patient. Combination of the Deposited Bacteriophages and aforementioned probiotic bacterial strains and yeast strains may provide enhanced health benefits. For example, lysis of the Targeted Bacteria by the Deposited Bacteriophages may reduce diarrhea caused by *Campylobacter*, whereas *Saccharomyces boulardii* may concurrently help alleviate other general digestion problems, e.g., irritable bowel syndrome.

Prevention or Treatment of Infection or Colonization

In another embodiment, the invention contemplates a method for the prevention or treatment of illnesses caused by the Targeted Bacteria, comprising contacting a microbial growth inhibiting effective amount of a bacteriophage composition comprising the Deposited Bacteriophages with a site or sites of infection of a host mammal infected with Targeted Bacteria.

At the time bacteriophages were discovered, with the age of antibiotics still in the future, bacteriophages were considered to be a potentially powerful cure for bacterial infections, and they were therapeutically utilized throughout the world during the pre-antibiotic era. The use of phages in humans was found to be very safe; however, phage therapy did not always work and, with the advent of antibiotics that were effective against a broad spectrum of pathogenic bacteria, it gradually fell out of favor in the United States and Western Europe. Several factors, including the lack of a broad understanding of phage biology, the "Soviet Taint," and inadequate diagnostic bacteriology techniques, contributed to the failure of some of the early phage therapy studies and to the associated decline of interest in phage therapy in the West. At the same time, phage therapy continued to be utilized in the former Soviet Union and Eastern Europe, where phage therapy still is being used to treat a wide range of bacterial diseases ranging from intestinal infections to septicemia. Comprehensive information about human and veterinary applications of bacteriophages has been recently reviewed by several investigators.

The infected mammalian host may be a human host or animal host. In particular, the host may be a bovine, poultry, or porcine host. Prevention of the infection by Targeted Bacteria, or treatment of infected persons or animals, is particularly preferred in immuno-compromised persons, pregnant females, and newborns and infants, who maybe at an elevated risk of infection by Targeted Bacteria. The modes of contact include, but are not limited to, spraying or misting the bacteriophage composition on the infected mammalian host, by injecting at a site or sites of infection a pharmaceutically acceptable composition containing a concentration of the Deposited Bacteriophages sufficiently high to inhibit the growth of Targeted Bacteria, or by ingesting a solution containing a concentration of the Deposited Bacteriophages sufficiently high to inhibit the growth of Targeted Bacteria. Additional routes of administration include but are not limited to oral, rectal, topical, ophthalmic, buccal, intravenous, otic, nasal, vaginal, inhalation, and intrapleural.

In another nonlimiting embodiment of the invention, the Deposited Bacteriophages are useful for preparing bacterial vaccines or bacterins that eliminate or reduce colonization of the Targeted Bacteria in, and/or their being shed by, various agriculturally important animals. One example of a practical application for that type of vaccine is in the poultry-raising industry, where its administration may significantly reduce colonization of poultry with the Targeted Bacteria; thus, improving public safety by reducing contamination of poultry with the Targeted Bacteria.

In yet another nonlimiting embodiment of the invention, the Deposited Bacteriophages are useful for preparing bacterial vaccines or bacterins that eliminate or reduce colonization of the Targeted Bacteria in, and/or their being shed by, various agriculturally important animals. One example of a practical application for that type of vaccine or bacterin is in the poultry-raising industry, where its administration may significantly reduce colonization of poultry with the Targeted Bacteria; thus, improving safety of the animals and enhancing their growth dynamics (e.g., improving feed conversion ratios in birds) by reducing or eliminating colonization of poultry with the Targeted Bacteria.

Bacteriophage compositions of the invention are available in aqueous or non-aqueous embodiments discussed earlier for Food Preservation applications.

The Deposited Bacteriophages can be administered at a concentration effective to inhibit the growth or viability of Targeted Bacteria in the infected host. In a non-limiting embodiment of the invention, the Deposited Bacteriophages are administered at a concentration of about $10^7$ to $10^{11}$ PFU/mL. In another non-limiting embodiment of the invention, the Deposited Bacteriophages are administered at a concentration of about 1-2 mL/500 cm$^2$ of food surface or $10^6$-$10^{10}$ PFU/g food product. One of skill in the art is capable of ascertaining bacteriophage concentrations using widely known bacteriophage assay techniques.

Depending on the severity of peculiarities of the infection, the Deposited Bacteriophages can be administered to animals (including humans) (i) orally, in tablet or liquid formulation ($10^5$-$10^{11}$ PFU/dose), (ii) rectally, (iii) locally (skin, eye, ear, nasal mucosa, etc.), in tampons, rinses and creams, (iv) as aerosols or intrapleural injections and (v) intravenously.

Use of Bacteriophage Derivatives

Derivatives, such as polypeptides, including but not limited to bacteriophage lytic enzymes, encoded by the bacteriophage or the bacteriophage progeny are used for applications designed to prevent the growth of Targeted Bacteria through cell wall lysis. In this context, lytic polypeptides are useful for the prevention of the growth of Targeted Bacteria on processed and unprocessed food products, as well as equipment used for the processing of said food products.

In another preferred embodiment of the invention, bacteriophage derivatives are useful for the treatment of one or more infections in a mammal, including humans, by administering their therapeutically effective amounts to the patient. This method is useful for the treatment of infections of the gastrointestinal system. Similarly, this method is useful in a prophylactic setting for the prevention of infection by Targeted Bacteria in pregnant mammals, including humans. This method of treatment is further useful for the prevention or other disorders or infections caused by Targeted Bacteria, such as acute bloody or non-bloody diarrhea, sometimes associated with hemolytic-uremic syndrome.

Another nonlimiting embodiment of the invention is that the bacteriophage derivatives such as lysins will be useful for preparing bacterial vaccines or bacterins that eliminate or reduce colonization of the Targeted Bacteria in, and/or their being shed by, various agriculturally-important animals. One example of a practical application for that type of vaccine is in the cattle-raising industry, where administration of such vaccines/bacterins may significantly reduce colonization of cattle with the Targeted Bacteria; thus, improving public safety by reducing contamination of beef with the Targeted Bacteria.

Detection Systems

The Deposited Bacteriophage, its progeny, recombinant bacteriophage, or derivatives of the above are useful in methods of screening environmental samples (including food products and food processing equipment) and clinical specimens for the presence of viable cells of Targeted Bacteria. For example, in one such system, recombinant bacteriophage containing a reporter system such as, for example, a luciferase reporter system is applied to the sample and analyzed at some time point in the future for the activation of the reporter molecule. The activation of the reporter molecule is indicative of the presence of viable cells of Targeted Bacteria.

The Deposited Bacteriophage, their progeny, recombinant bacteriophage, or derivatives such as lytic enzymes are useful in methods of screening environmental samples including food products and food processing equipment and clinical specimens for the presence of viable cells of Targeted Bacteria, by monitoring and measuring bacterial metabolism products such as bacterial adenosine kinase (AK) or adenosine triphosphate (ATP) released as a result of specific lysis of Targeted Bacteria. For example, when the released ATP is incubated with a luciferin/luciferase mixture, a rapid flash of peak light emission occurs within less than a second, followed by a steady glow lasting for several hours. By measuring the luminescence, it is possible to obtain a quantitative estimate of the number of bacterial cells in a sample. Although the basic approach involved in such detection-based assays is well-established, the existing assays have shortcomings that hinder their wide acceptance. For example, the various reagents that have been used to lyse bacteria and release their ATP have broad-specificity; therefore, ATP is released from all susceptible bacterial and eukaryotic cells present in the sample, which can cause false-positive readings. In this context, the original Deposited Bacteriophage, its progeny, recombinant bacteriophage, or derivatives such as lytic enzymes will specifically lyse Targeted Bacteria without affecting any other prokaryotic or eukaryotic cells that may be present in the sample, thus providing means for accurately and specifically identifying and detecting Targeted Bacteria.

Epidemiological Typing

The Deposited Bacteriophage, and/or their progeny and derivatives may be further useful as a tool for the epidemiological typing of Targeted Bacteria. For example, one of skill in the art can use the Deposited Bacteriophages of the invention to screen a panel of Targeted Bacteria isolates to aid in the taxonomic identification of the Targeted Bacteria, by determining which isolates yield a positive lytic reaction to the Deposited bacteriophage.

Preparation of Vaccines or Bacterins

The Deposited Bacteriophage, and/or its progeny and derivatives, also may be valuable for preparing bacterial lysates to be used as vaccines or bacterins. The immunogenicity of such vaccines or bacterins may be superior to that of so-called dead cell vaccines because phage-mediated lysis is a more effective and gentler approach for exposing protective antigens of bacteria than are approaches used to prepare the latter vaccines. For example, methods commonly used to inactivate bacterial pathogens for dead-cell vaccines, including but not limited to heat treatment, UV-irradiation, and chemical treatment, may deleteriously affect a vaccine's effectiveness by reducing the antigenicity of relevant immunological epitopes. The presence of viable bacteriophage may also serve as an additional efficacy-enhancing factor, increasing the effectiveness of a phage lysate via their antibacterial effect on the Targeted Bacteria.

Use of Recombinant Bacteriophage

In one embodiment of the invention, homologous recombination techniques are used to introduce sequences encoding alternative proteins, non-functional proteins, or non-coding sequences into the bacteriophage DNA sequence. Such techniques are useful to remove or "knock-out" undesired traits of the Deposited Bacteriophage, or alternatively to introduce different traits. In a particularly preferred embodiment of the invention, homologous recombination is used to "knock-out" ORFs encoding proteins that maybe involved in a lysogenic cycle of the bacteriophage.

In another embodiment of the invention, homologous recombination is used to add or knock-out genes involved in burst size. For example, homologous recombination is used to introduce alternative bacteriophage genes which delay the burst event or increase the phage burst size.

In another embodiment of the invention, recombinant bacteriophage harboring reporter system(s) is generated for various practical applications. One example of possible application of such system is species identification/confirmation of Targeted Bacteria as bacterial diagnostics. Another possible application is the detection of the presence of viable cells of Targeted Bacteria to which the Deposited Bacteriophages have specificity. Following the techniques of Loessner et al., for example, one of skill in the art can generate recombinant reporter bacteriophage. For example, the *Vibrio harveyi* luxAB gene may be introduced into the bacteriophage DNA sequence using techniques such as homologous recombination. An ideal target for the introduction of the luxAB gene is immediately downstream and in frame with an ORF encoding bacteriophage capsid protein, thereby creating a sequence encoding a fusion protein. The preferable location of introduction of the luxAB gene sequence is particularly before any sequence encoding a transcriptional terminator downstream of the ORF encoding a capsid protein. Other bacteriophage ORF sequences which may function as useful sources of luxAB gene-fusions include gene sequences encoding tail-sheath proteins, or any other late gene region sequences encoding phage head or tail proteins. The resulting recombinant bacteriophage may be used with methods of the invention to detect the presence of viable cells of Targeted Bacteria.

In addition to the *Vibrio harveyi* luxAB gene, other reporter genes which are useful for the generation of reporter bacteriophage include, but are not limited to, the firefly luciferase gene.

The invention further contemplates the introduction of one or more of the above-described recombinant events. For example, a recombinant bacteriophage of the invention may harbor one or more reporter gene(s) as well as lack one or more genes associated with certain undesirable biological functions of the bacteriophage.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The invention may be practiced in ways other than those particularly described in the foregoing description and examples. The teachings provided herein of the invention can be applied to other purposes, other than the examples described below.

All publications (e.g., Non-Patent Literature), patents, patent application publications, and patent applications mentioned in this specification are indicative of the level of skill of those skilled in the art to which this invention pertains. All such publications (e.g., Non-Patent Literature), patents, patent application publications, and patent applications are herein incorporated by reference to the same extent as if each individual publication, patent, patent application publication, or patent application was specifically and individually indicated to be incorporated by reference.

EXAMPLES

The invention will be described below on the basis of special embodiments, which, however, are in no way to be taken to mean a restriction of the general inventive concept. These examples and methods are specific embodiments; however, the present invention is not limited to these examples and methods. It is known to the person skilled in the art that the invention can be carried out in the same manner by modifying the examples and methods described and/or by replacing individual examples or methods or parts of examples or methods by alternative examples or methods or alternative parts of examples or methods.

Example 1—Deposited Bacteriophages Isolation

CJLB-4, CJLB-5, CJLB-7, CJLB-10, CJLB-12, CJLB-13, CJLB-14, and CJLB-15 bacteriophages were isolated from various environmental sources using lysis of the Targeted Bacteria to form plaques in bacterial lawns as a means of detecting the presence of bacteriophage having lytic specificity for the Targeted Bacteria. Plaques were harvested, diluted, and re-plated on bacterial lawns through a process of serial enrichment until a single bacteriophage species, or monophage, was obtained. This process allowed for selection of highly specific, lytic bacteriophage. The isolates obtained using the technique recited supra may be cultured using the techniques as set forth herein. The bacteriophage was deposited with the ATCC. The ATCC Deposit No. of the bacteriophages are shown in parenthesis adjacent to the bacteriophage: CJLB-4 (PTA-126839), CJLB-5 (PTA-126840), CJLB-7 (PTA-126841), CJLB-10 (PTA-126842), CJLB-12 (PTA-126843), CJLB-13 (PTA-126844), CJLB-14 (PTA-126845), and CJLB-15 (PTA-126846).

Example 2—Deposited Bacteriophages Concentration

Concentration of the Deposited Bacteriophages may be determined using techniques known in the art. When a single phage particle encounters a permissive bacterium, it will lyse it with the concomitant release of newly formed phage particles. When phages are mixed with host cells and poured in a layer of soft agar on the surface of a nutrient agar plate supporting bacterial growth, the cells will resume growth. In areas where no phages are present the bacteria will grow to stationary phase, forming a smooth opaque layer or lawn in the overlay. In areas where phages are present, phage progeny from each infected bacterium will infect neighboring bacteria, resulting in a growing zone of lysis full of liberated phage which eventually becomes visible to the naked eye as a plaque in the otherwise smooth bacterial lawn. These plaques can be counted, and their number is widely used for expressing phage titer in plaque-forming units or PFU. Using this approach, concentration of the Deposited Bacteriophages may be determined. Briefly: (1) Various dilutions of the Deposited Bacteriophages preparation are prepared; for example, by mixing 0.1 ml of phage sample with 9.9 ml of sterile Mueller Hinton broth. The samples are gently but thoroughly mixed. 0.5 ml of this mixture (which is a $10^{-2}$ dilution of the original sample) is mixed with 4.5 ml of sterile Mueller Hinton broth ($10^{-3}$ dilution). Several 10-fold dilutions are prepared in a similar fashion; (2) the contents of the tubes (1 ml of various dilutions) are transferred into sterile 10 ml culture tubes and 0.1 ml of host bacterial culture are added. The sample is mixed gently before proceeding immediately to the next step; (3) 3-5 ml of warm (45-50° C.) 0.7% *Campylobacter* blood agar (top agar) are added. The sample is mixed quickly and very gently. Then, the entire contents of the culture tube are poured onto a plate containing solidified *Campylobacter* blood agar (bottom agar). The plates are slid in circles a few times on the bench top immediately after pouring; (4) after sitting at room temperature for 10 min to allow the top agar to harden, the plates are inverted and placed into a 37° C. incubator and incubated overnight; (5) the next morning, the number of plaques on the plate with 30-300 individual well-spaced plaques are counted and the titer calculated and expressed as PFU/ml of the starting sample.

Example 3—Production of the Deposited Bacteriophages

The Deposited Bacteriophages are produced using a culture system. More specifically, strain of the host Targeted Bacteria or other closely related bacterial species on which the bacteriophage can propagate is cultured in batch culture, followed by inoculation of the bacteriophage at the predetermined multiplicity of infection (MOI). Following incubation and bacterial lysis, the bacteriophage is harvested and purified and/or concentrated to yield phage progeny suitable for the uses enumerated herein. Purification and concentration procedures included variously processing through filtration system(s), centrifugation (including continuous-flow centrifugation) or other known bacteriophage purification and concentration techniques.

The invention provides compositions comprising active viral particles of the bacteriophage capable of lysing strains of Targeted Bacteria. The concentration of bacteriophage is determined using phage titration protocols. The final concentration of the bacteriophage is adjusted by concentration, if a more concentrated phage composition is desired, via filtration, centrifugation, or other means, or by dilution, if a less concentrated phage composition is desired, with water or buffer to yield a phage titer of $10^6$ to $10^{12}$ PFU/mL, preferably $10^9$ to $10^{11}$ PFU/mL. The resulting bacteriophage compositions are generally stored at 2-8° C.; alternatively, preparations can be freeze or spray-dried for storage, or can be encapsulated and stabilized with protein, lipid, polysaccharide, or mixtures thereof. Upon reconstitution, the phage titer can be verified using phage titration protocols and host bacteria. One of skill in the art is capable of determining bacteriophage titers using widely known bacteriophage assay techniques.

Example 4—Application of the Deposited Bacteriophages for Preservation of Food Products The bacteriophage produced using the methods of the present invention may be dispersed in an appropriate aqueous solution or dried powder and applied to the surface of food products. Alternatively, the bacteriophage may be included with a cheese culture or other microbially active foodstuff prior to or during processing.

Example 5—Application of the Deposited Bacteriophages for Preventing Foodborne Campylobacteriosis The bacteriophage produced using the methods of the present invention may be given to animals (including humans) in an appropriate aqueous solution or enteric coated gel capsule to enhance gut resilience against *Campylobacter* bacteria and prevent, or reduce the severity of, foodborne illness (including diarrhea, cramps, fever, and pain or other discomfort such as bloating) due to consumption of foods that may be contaminated with *Campylobacter*.

Example 6—Isolation of the Bacteriophage DNA

Bacteriophage DNA, a derivative of the bacteriophage, can be used for various applications such as for preparing DNA-based vaccines, and also for analytical purposes, e.g., for identifying the bacteriophage such as genome sequencing or RFLP profile determination and comparison. Phage DNA can be isolated using a suitable commercial kit such as the Lambda Mini Kit (Qiagen, Inc.; Valencia, CA) or the standard phenol extraction technique. For example, 0.75 ml of phage in phosphate-buffered saline solution at a titer of $10^8$-$10^{11}$ PFU/ml is collected. 10 µl of Proteinase K (20 mg/ml) and 2 µl of RNAse (10 mg/ml) is added, followed by incubation at 37° C. for 30 minutes, and a subsequent incubation at 56° C. for 30 minutes. Following incubation, 75 µl of a mixture of 10% SDS (0.1 ml), 0.5 M EDTA (0.1 ml) and 0.8 ml of water is added and incubated at room temperature for 5 min. 0.75 ml of a phenol:chloroform: isoamylalcohol (25:24:1) solution is mixed well with the sample, followed by centrifugation at 13,000 RPM for five (5) min. Next, the supernatant (approximately 600 µl) is carefully removed and transferred to a clean eppendorf tube. 0.6 ml of chloroform is added to the supernatant, mixed well, and centrifuged at 13,000 RPM for five (5) min. The supernatant is then carefully extracted (approximately 500 µl). Next, 0.1 volumes of 3M sodium acetate (40 ml) is added to the solution, followed by 2.5 volumes of cold 95% ethanol (1 ml) to precipitate the bacteriophage DNA. The solution is allowed to incubate at −20° C. for 1 hour, followed by centrifugation at 13,000 RPM for thirty (30) min. Following centrifugation, the pellet is washed with 1 ml of 70% cold ethanol, and the supernatant is poured from the pellet. The pellet is allowed to air dry and is then resuspended in 30-300 µl of TE (10 mM tris-HCL, pH=8.0-8.5, 1 mM EDTA).

Example 7—Restriction Fragment Length Polymorphism (RFLP) Profile

RFLP can be used to identify the Deposited Bacteriophages or its progeny. The progeny will have a substantially equivalent RFLP DNA profile as the RFLP DNA profile of the original bacteriophage, as defined by Tenover. A reference RFLP profile of the Deposited Bacteriophages are shown in FIG. 2-FIG. 9. DNA was isolated from the bacteriophage using Qiagen Plasmid Miniprep or Midiprep kits (Valencia, CA) according to the manufacturer's directions. The DNA was quantitated by measuring absorbance at 260 nm. Approximately 0.5-1 mg of DNA was digested with an appropriate restriction enzyme, and RFLP profile was determined on 0.8-1.2% agarose gel after staining with ethidium bromide.

Example 8—Genome Analysis and Average Nucleotide Identity of the C. jejuni Phages Full genome sequencing and sequence analysis could be used to identify the Deposited Bacteriophages or its progeny. The progeny will have ANI≥95% to be considered "Same Species" (including "Substantially Equivalent" to the Deposited Bacteriophages, or its "Progeny" or "Derivative") as defined by Olm and Jain.

Eight lytic bacteriophages were sequenced on the MiSeq Sequencer with read length 2×250 bp. Reads were trimmed for illumina adapter, length (≥50 bp), quality (q≥20) and mapped to ('. jejuni RefSeq NC_002163.1. The unmapped reads were collected and assembled using Unicycler assembler. The sequences are shown in FIGS. 10-17 and correspond to SEQ ID NO. 1-24. The strain delineation was assessed by calculating average nucleotide identity over genome (gANI). The GenBank accession numbers for the Deposited Bacteriophages are given in Section "*Genome Analysis and Average Nucleotide Identity of the C. jejuni lytic phages*." Table A below summarizes the Sequence Identification Numbers referred to in this application.

TABLE A

| SEQ ID NO. and Correspondence Sequence Names ||
|---|---|
| SEQ ID NO. | Sequence Name |
| 1 | FIGS. 10A-10K-(CJLB-4 [organism = Campylobacter phage CJLB-4] partial genome) |
| 2 | FIGS. 11A-11I-(CJLB-5 [organism = Campylobacter phage CJLB-5] partial genome) |
| 3 | FIGS. 12A-12AF-(CJLB-7 [organism = Campylobacter phage CJLB-7] complete genome) |
| 4 | FIGS. 13A-13AF-(MB-10 [organism = Campylobacter phage CJLB-10] complete genome) |
| 5 | FIGS. 14A-14AO-(CJLB-12 [organism = Campylobacter phage CJLB-12] complete genome) |
| 6 | FIGS. 15A-15N-(CJLB-13-1 [organism = Campylobacter phage CJLB-13] partial genome contig_1) |
| 7 | FIGS. 15N-15Z-(CJLB-13-2 [organism = Campylobacter phage CJLB-13] partial genome contig_2) |
| 8 | FIGS. 15Z-15AJ-(CJLB-13-3 [organism = Campylobacter phage CJLB-13] partial genome contig_3) |
| 9 | FIGS. 15AJ-15A5-(CJLB-13-4 [organism = Campylobacter phage CJLB-13] partial genome contig_4) |
| 10 | FIGS. 15A5-15BA-(CJLB-13-5 [organism = Campylobacter phage CJLB-13] partial genome contig_5) |
| 11 | FIG. 15BA-(CJLB-13-6 [organism = Campylobacter phage CJLB-13] partial genome contig_6) |
| 12 | FIGS. 15BA-15BB-(CJLB-13-7 [organism = Campylobacter phage CJLB-13] partial genome contig_7) |

TABLE A-continued

SEQ ID NO. and Correspondence Sequence Names

| SEQ ID NO. | Sequence Name |
|---|---|
| 13 | FIGS. 16A-16AN-(CJLB-14 [organism = Campylobacter phage CJLB-14] complete genome) |
| 14 | FIGS. 17A-17M-(CJLB-15-1 [organism = Campylobacter phage CJLB-15] partial genome contig_1) |
| 15 | FIGS. 17M-17X-(CJLB-15-2 [organism = Campylobacter phage CJLB-15] partial genome contig_2) |
| 16 | FIGS. 17X-17AE-(CJLB-15-3 [organism = Campylobacter phage CJLB-15] partial genome contig_3) |
| 17 | FIGS. 17AE-17AT-(CJLB-15-4 [organism = Campylobacter phage CJLB-15] partial genome contig_4) |
| 18 | FIGS. 17AT-17BC-(CJLB-15-5 [organism = Campylobacter phage CJLB-15] partial genome contig_5) |
| 19 | FIGS. 17BC-17BL-(CJLB-15-6 [organism = Campylobacter phage CJLB-15] partial genome contig_6) |
| 20 | FIG. 17BM-(CJLB-15-7 [organism = Campylobacter phage CJLB-15] partial genome contig_7) |
| 21 | FIGS. 17BM-17BN-(CJLB-15-8 [organism = Campylobacter phage CJLB-15] partial genome contig_8) |
| 22 | FIGS. 17BN-17BP-(CJLB-15-9 [organism = Campylobacter phage CJLB-15] partial genome contig_9) |
| 23 | FIG. 17BP-(CJLB-15-10 [organism = Campylobacter phage CJLB-15] partial genome contig_10) |
| 24 | FIGS. 17BP-BQ-(CJLB-15-11 [organism = Campylobacter phage CJLB-15] partial genome contig_11) |
| 25 | FIG. 17BQ-(CJLB-15-12 [organism = Campylobacter phage CJLB-15] partial genome contig_12) |
| 26 | FIG. 17BQ-(CJLB-15-13 [organism = Campylobacter phage CJLB-15] partial genome contig_13) |

Example 9—Lytic Specificity of the Deposited Bacteriophages

Sixty-one *Campylobacter* species strains were screened for their susceptibility to the Deposited Bacteriophages by the drop-on-lawn method, also known as the "spot test" method. Strains were streaked onto Blood Base II+5% bovine blood agar plates and incubated at 42° C. overnight under microaerobic conditions (10% $CO_2$, 5% $O_2$). Three to five colonies of each strain were inoculated into Vegitone Infusion Broth adjusted with 100 mM $MgSO_4$ and 10 mM $CaCl_2$) and incubated at 42° C. under microaerobic conditions overnight. The following day, a 1:10 subculture of the overnight culture was grown at 42° C. under microaerobic conditions for 1.5 hrs (OD600 approximately 0.15-0.2). Five hundred microliters (500 μL) of each strain was mixed with 4.5 mL blood-free Bolton soft agar and poured onto a blood-free Bolton agar plate. After the soft agar hardened, 5 μl of the bacteriophage were spotted in triplicate onto the plates inoculated with the strains of Targeted Bacteria. Lytic activity was observed after overnight incubation at 42° C. under microaerobic conditions. Lytic specificity results are presented in Table 2. One or more of the Deposited Bacteriophages lysed 54 (100%) of the 54 strains of Targeted Bacteria examined. In contrast, the Deposited Bacteriophages lysed 0 (0%) of 30 non-*Campylobacter* species strains (Table 3).

TABLE 2

Lytic activity of each Deposited Bacteriophage at ca. $2 \times 10^4$ PFU/mL against 61 strains in Intralytix's *Campylobacter* collection

| | DEPOSITED BACTERIOPHAGES | | | | | | | |
|---|---|---|---|---|---|---|---|---|
| STRAIN ID | CJLB-4 | CJLB-5 | CJLB-7 | CJLB-10 | CJLB-12 | CJLB-13 | CJLB-14 | CJLB-15 |
| Cl2 | + | − | − | + | − | − | − | − |
| Cj3 | − | − | − | − | − | − | − | − |
| Cl3 | + | + | + | + | − | − | − | − |

TABLE 2-continued

Lytic activity of each Deposited Bacteriophage at ca. $2 \times 10^4$ PFU/mL against 61 strains in Intralytix's *Campylobacter* collection

| | DEPOSITED BACTERIOPHAGES | | | | | | | |
|---|---|---|---|---|---|---|---|---|
| STRAIN ID | CJLB-4 | CJLB-5 | CJLB-7 | CJLB-10 | CJLB-12 | CJLB-13 | CJLB-14 | CJLB-15 |
| Cj5 | − | + | + | + | + | − | − | + |
| Cl6 | + | − | − | + | − | − | − | − |
| Cj7 | − | + | − | − | − | + | + | + |
| Cj8 | − | − | − | − | − | − | − | − |
| Cj9 | − | + | − | − | + | + | + | + |
| Cj11 | − | − | − | − | − | − | − | − |
| Cj12 | − | − | − | − | − | − | − | − |
| Cl15 | − | − | − | − | + | + | + | + |
| Cj16 | − | + | + | + | − | − | − | − |
| Cj17 | − | − | − | − | − | − | − | − |
| Cj21 | − | − | − | − | − | − | − | − |
| Cj24 | − | − | − | − | − | − | − | − |
| Cj26 | − | − | − | − | + | + | + | + |
| Cj29 | − | + | + | + | − | − | − | − |
| Cj33 | − | + | + | − | − | + | + | + |
| Cj36 | − | − | − | − | − | + | − | + |
| Cj39 | − | − | − | − | − | − | − | − |
| Cj40 | − | + | − | − | − | + | + | + |
| Cj43 | − | − | − | − | − | − | − | − |
| Cj45 | − | − | − | − | − | + | + | + |
| Cj48 | + | + | + | + | − | − | − | − |
| Cj50 | + | + | + | + | + | + | − | − |
| Cj55 | + | + | + | + | − | − | − | − |
| Cj60 | − | − | − | − | − | − | − | − |
| Cj65 | − | − | − | − | − | − | − | − |
| Cjp66 | − | − | − | − | + | + | + | + |
| Cj70 | − | nt | − | − | − | + | + | + |
| Cj75 | − | − | − | − | − | − | − | − |
| Cj78 | + | + | + | + | − | − | − | − |
| Cj80 | − | − | − | − | − | − | − | − |
| Cjp80 | − | − | − | − | − | − | − | − |
| Cjp81 | − | + | − | − | − | − | − | − |
| Cj82 | − | − | − | + | − | − | − | − |
| Cj87 | − | − | − | − | − | − | − | − |
| Cj151 | − | + | − | − | − | − | − | − |
| Cj157 | + | + | − | + | − | − | − | − |
| Cj158 | − | − | − | − | − | − | − | − |
| Cj159 | − | − | + | − | − | − | − | − |
| Cj160 | + | + | + | + | − | + | + | + |
| Cj161 | − | − | − | − | − | − | − | − |
| Cj162 | − | − | − | − | − | − | − | − |
| Cj163 | + | + | + | + | − | − | + | − |
| Cj164 | − | − | − | − | − | − | + | − |
| Cj165 | − | − | − | − | − | − | + | − |
| Cj166 | − | − | − | − | − | − | − | − |
| Cj167 | − | − | − | − | − | + | + | + |
| Cj168 | + | − | − | + | − | + | − | − |
| Cj169 | + | − | − | + | − | − | + | − |
| Cj170 | − | nt | − | − | − | − | − | − |
| Cj171 | − | nt | − | − | − | + | + | + |
| Cj172 | − | − | − | − | − | − | − | − |
| Cj173 | − | + | − | − | + | + | + | + |
| Cj176 | − | − | − | − | − | − | − | − |
| Cj200 | − | + | − | − | + | + | + | + |
| Cj201 | nt | nt | nt | nt | nt | + | + | nt |
| Cj204 | − | + | − | − | + | + | + | + |
| Cj658 | + | + | − | − | + | − | − | − |
| Cj662 | − | + | + | + | − | + | + | − |
| Total killed (% of tested) | 22% | 39% | 22% | 28% | 17% | 33% | 34% | 28% | nt - Not Tested

TABLE 3

Lytic activity of each Deposited Bacteriophage at ca. $2 \times 10^4$ PFU/mL against non-*Campylobacter* strains

NON-*CAMPYLOBACTER* STRAINS

| INTRALYTIX ID | ORIGINAL ID | SPECIES | $2 \times 10^4$ PFU/ML | | | | | | | |
|---|---|---|---|---|---|---|---|---|---|---|
| | | | CJLB-4 | CJLB-5 | CJLB-7 | CJLB-10 | CJLB-12 | CJLB-13 | CJLB-14 | CJLB-15 |
| SA-36 | ATCC25923 | *Staphylococcus aureus* | − | − | − | − | − | − | − | − |
| SA-37 | ATCC29213 | *Staphylococcus aureus* | − | − | − | − | − | − | − | − |
| SA-211 | ATCC700699 | *Staphylococcus aureus* | − | − | − | − | − | − | − | − |
| SA-298 | ATCC49775 | *Staphylococcus aureus* | − | − | − | − | − | − | − | − |
| SA-299 | ATCC14458 | *Staphylococcus aureus* | − | − | − | − | − | − | − | − |
| Lm 314 | ATCC19117 | *Listeria monocytogenes* | − | − | − | − | − | − | − | − |
| Lm 315 | ATCC19118 | *Listeria monocytogenes* | − | − | − | − | − | − | − | − |
| *L. innocua* 316 | ATCC51724 | *Listeria innocua* | − | − | − | − | − | − | − | − |
| Lm 317 | ATCC19116 | *Listeria monocytogenes* | − | − | − | − | − | − | − | − |
| *L. innocua* 318 | ATCC33090 | *Listeria innocua* | − | − | − | − | − | − | − | − |
| Ab3 | ATCC19606 | *Acinetobacter baumannii* | − | − | − | − | − | − | − | − |
| Ab4 | HER401 | *Acinetobacter baumannii* | − | − | − | − | − | − | − | − |
| Ab5 | 4308-2 | *Acinetobacter baumannii* | − | − | − | − | − | − | − | − |
| Ab6 | 3247-1 | *Acinetobacter baumannii* | − | − | − | − | − | − | − | − |
| Ab7 | 1673-2 | *Acinetobacter baumannii* | − | − | − | − | − | − | − | − |
| E102 | WCC188 | *Enterococcus* spp. | − | − | − | − | − | − | − | − |
| E402 | ATCC11823 | *Enterococcus faecalis* | − | − | − | − | − | − | − | − |
| E403 | ATCC19433 | *Enterococcus faecalis* | − | − | − | − | − | − | − | − |
| E404 | 1133455 | *Enterococcus avium* | − | − | − | − | − | − | − | − |
| E405 | 1126611 | *Enterococcus faecalis* | − | − | − | − | − | − | − | − |
| Pa76 | ATCC10145 | *Pseudomonas aeruginosa* | − | − | − | − | − | − | − | − |
| Pa161 | ATCC15692 | *Pseudomonas aeruginosa* | − | − | − | − | − | − | − | − |
| Pa162 | ATCC51674 | *Pseudomonas aeruginosa* | − | − | − | − | − | − | − | − |
| Pa163 | ATCC43390 | *Pseudomonas aeruginosa* | − | − | − | − | − | − | − | − |
| Pa164 | ATCC39324 | *Pseudomonas aeruginosa* | − | − | − | − | − | − | − | − |
| Bc11 | ATCC25416 | *Burkholderia cepacia* | − | − | − | − | − | − | − | − |
| Bc12 | ATCC25608 | *Burkholderia cepacia* | − | − | − | − | − | − | − | − |
| Bc24 | ATCC25609 | *Burkholderia cepacia* | − | − | − | − | − | − | − | − |
| Bc25 | ATCC25610 | *Burkholderia cepacia* | − | − | − | − | − | − | − | − |
| Bc38 | ATCC BAA-1911 | *Burkholderia cepacia* | − | − | − | − | − | − | − | − |

Example 10—Detection of Targeted Bacteria in Food Samples

The bacteriophage or its derivative, such as lytic enzyme, produced using the methods of the present invention is used to specifically lyse Targeted Bacteria without affecting any other prokaryotic or eukaryotic cells that may be present in the sample; thus, specifically eliciting their release of measurable bacterial products such as AK or ATP. Briefly: (1) Samples of the food to be analyzed are obtained and suspended in appropriate buffer, (2) The Deposited Bacteriophages are added to the suspensions, as a result of which the Targeted Bacteria cells present in the samples are lysed and their ATP is released, (3) A luciferin+luciferase preparation is added to the mixtures, and (5) The mixtures' luminescence is measured within 60 sec, and the results are displayed on a handheld luminometer. It may be possible to establish a correlation between the luminometer readings and the number of Targeted Bacteria cells lysed (in general, the average amount of ATP per bacterial cell is 0.5-1.0 fg; precise correlation between the luminometer readings and the number of Targeted Bacteria cells should be experimentally established). If Targeted Bacteria cells are not present in the food samples analyzed, bacterial lysis and ATP-release will not occur. Detection of *Campylobacter* species or strain in a food sample employing the deposited bacteriophages or derivatives thereof, as described above, for example, is also contemplated by this invention.

Example 11—Preparing Vaccines and Bacterins

One example of utilizing bacteriophages to prepare vaccines and bacterins is to use the lytic Deposited Bacteriophages to lyse specific strains of the Targeted Bacteria, which will yield bacterial lysates containing minimally affected immunological epitopes of the bacteria. The phage may be removed from the final vaccine/bacterin preparation. Alternatively, it may be retained unaltered in the preparation because its lytic activity against Targeted Bacteria that may be present in the mammalian organism being vaccinated may increase the preparation's efficacy. In one preferred embodiment of the present invention: (i) the most prevalent, problematic strains of the Targeted Bacteria are chosen so that the vaccine/bacterin contains the immunological epitopes that are most relevant for protecting against the infection, and (ii) the bacteriophage is kept unaltered in the final vaccine/bacterin, at levels ranging from $10^6$-$10^{10}$ PFU/ml.

Bacteriophage-based vaccines and bacterins also may be prepared by using derivatives of the Deposited Bacteriophages to lyse the Targeted Bacteria. An example of the general methodology can be briefly outlined from a recent study, Panthel K, Jechlinger W, Matis A, Rohde M, Szostak M, Lubitz W, et al. Generation of *Helicobacter pylori* ghosts by PhiX protein E-mediated inactivation and their evaluation as vaccine candidates. Infect Immun. 2003; 71 (1): 109-16, which is incorporated by reference herein in relevant part, of an *Helicobacter pylori* bacterin. The authors used *E. coli-H. pylori* shuttle plasmid pHel2 and lysis gene e of bacteriophage φX174 to construct *H. pylori* lysis plasmid pHPC38, which they introduced into *H. pylori* strain P79. At a pre-determined time, the authors triggered e gene-expression to elicit bacterial lysis, and they found that the lysate/bacterin protected BALB/c mice against *H. pylori* infection. Vaccination using a vaccine comprising bacterins produced by lysis of *Campylobacter* species or strain employing the deposited bacteriophages or derivatives thereof is also contemplated by this invention. Production of the vaccine as well as vaccination using such a vaccine may be performed by methods known to a person of ordinary skill in the art.

Example 12—Application of the Deposited Bacteriophages for Treating Campylobacteriosis One or more of the Deposited Bacteriophage produced according to Example 3 may be embedded in nanosized polymeric microgel particles including a cross-linked polymer network of polyionic segments and neutral segments as described in Vinogradov, S. V., Colloidal microgels in drug delivery applications. Curr Pharm Des, 2006. 12 (36): p. 4703-4712, ("Vinogradov"), which is incorporated herein by reference in relevant part. The microgel particles will have diameters of about 1 µm to about 4 µm, suitable sized for phagocytosis by macrophages. Preferably, non-mammalian carbohydrates such as mannose, chitosan, and β-glucan may be incorporated into the microgel particles to induce phagocytosis of the microgel particles by macrophages. The microgel particles may be given to animals (including humans) to enhance resilience against *Campylobacter* bacteria and to reduce the risk and/or severity of illness. For example, the phage-containing microgel particles may be given to humans by intravenous or intradermal or intraparenchymal injection of an appropriate phage-containing microgel preparation to prevent and/or treat *Campylobacter* infections caused by consumption of foods or drinking water that may be contaminated with *Campylobacter*.

All publications, patents and patent applications are herein incorporated by reference in their entirety to the same extent as if each individual publication, patent or patent application was specifically and individually indicated to be incorporated by reference in its entirety.

Those skilled in the art will recognize or be able to ascertain using no more than routine experimentation, many equivalents to the specific embodiments of the invention described herein. Such equivalents are intended to be encompassed by the following claims.

SEQUENCE LISTING (26 sequences)

SEQ ID NO: 1 - DNA, 48361 bp, Camplyobacter Phage CJLB-4
atgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgtattgaaggctcggtctggccaaagtccatccgtggctccacgccaaaagtgagaggcacctgtcagattgagcgtgcagccagtgaatccccgcattttatgcgttttcatgttgcctgcccgcattgcggggaggagcagtatcttaaatttggcgacaaagagacgccgtttggcctcaaatggacgccggatgacccctccagcgtgttttatctctgcgagcataatgcctgcgtcatccgccagcaggagctggactttactgatgcccgttatatctgcgaaaagaccgggatctggacccgtgatggcattctctggttttcgtcatccggtgaagagattgagccacctgacagtgtgacctttcacatctggacagcgtacagcccgttcaccacctgggtgcagattgtcaaagactggatgaaaacgaaaggggatacgggaaaacgtaaaaccttcgtaaacaccacgctcggtgagacgtgggaggcgaaaattggcgaacgtccggatgctgaagtgatggcagagcggaaagagcattattcagcgcccgttcctgaccgtgtggcttacctgaccgccggtatcgactcccagctggaccgctacgaaatgcgcgtatggggatgggggccgggtgaggaaagctggctgattgaccggcagattattatgggccgccacgacgatgaacagacgctgctgcgtgtggatgaggccatcaataaaacctatacccgccggaatggtgcagaaatgtcgatatcccgtatctgctgggatactggcgggattgacccgaccattgtgtatgaacgctcgaaaaaacatgggctgttccgggtgatccccattaaaggggcatccgtctacggaaagccggtggccagcatgccacgtaagcgaaacaaaaacggggtttaccttaccgaaatcggtacggataccgcgaaagagcagatttataaccgcttcacactgacgccggaaggggatgaaccgcttcccggtgccgttcacttcccgaataacccggatatttttgatctgaccgaagcgcagcagctgactgctgaagagcaggtcgaaaaatgggtggatggcaggaaaaaaatactgtgggacagcaaaaagcgacgcaatgaggcactcgactgcttcgtttatgcgctggcggcgctgcgcatcagtatttcccgctggcagctggatctcagtgcgctgctggcgagcctgcaggaagaggatggtgcagcaaccaacaagaaaacactggcagattacgcccgtgccttatccggagaggatgaatgacgcgacaggaagaacttgccgctgcccgtgcggcactgcatgacctgatgacaggtaaacgggtggcaacagtacagaaagacggacgaagggtggagtttacggccacttccgtgtctgacctgaaaaaatatattgcagagctggaagtgcagaccggcatgacacagcgacgcaggggacctgcaggattttatgtatgaaaacgcccaccattcccacccttctggggccggacggcatgacatcgctgcgcgaatatgccggttatcacggcggtggcagcggatttggagggcagttgcggtcgtggaacccaccgagtgaaagtgtggatgcagccctgttgcccaactttacccgtggcaatgcccgcgcagacgatctggtacgcaataacggctatgccgccaacgccatccagctgcatcaggatcatatcgtcgggtcttttttccggctcagtcatcgcccaagctggcgctatctgggcatcggggaggaagaagcccgtgccttttcccgcgaggttgaagcggcatggaaagagtttgccgaggatgactgctgctgcattgacgttgagcgaaaacgcacgtttaccatgatgattcgggaaggtgtggccatgcacgcctttaacggtgaactgttcgttcaggccacctgggataccagttcgtcgcggcttttccggacacagttccggatggtcagcccgaagcgcatcagcaacccgaacaataccggcgacagccggaactgccgtgccggtgtgcagattaatgacagcggtgcggcgctgggatattacgtcagcgaggacgggtatcctggctggatgccgcagaaatggacatggataccccgtgagttacccggcgggcgcgcctcgttcattcacgtttttgaacccgtggaggacgggcagactcgcggtgcaaatgtgttttacagcgtgatggagcagatgaagatgctcgacacgctgcagaacacgcagctgcagagcgccattgtgaaggcgatgtatgccgccaccattgagagtgagctggatacgcagtcagcgatggattttattctgggcgcgaacagtcaggagcagcgggaaaggctgaccggctggattggtgaaattgccgcgtattacgccgcagcgccggtccggctgggaggcgcaaaagtaccgcacctgatgccgggtgactcactgaacctgcagacggctcaggatacggataacggctactccgtgtttgagcagtcactgctgcggtatatcgctgccgggctgggtgtctcgtatgagcagctttcccggaattacgcccagatgagctactccacggcacgggccagtgcgaacgagtcgtgggcgtactttatggggcggcgaaaattcgtcgcatcccgtcaggcgagccagatgtttctgtgctggctggaagaggccatcgttcgccgcgtggtgacgttaccttcaaaagcgcgcttcagttttcaggaagcccgcagtgcctgggggaactgcgactggataggctccggtcgtatggccatcgatggtctgaaagaagttcaggaagcggtgatgctgatagaagccggactgagtacctacgagaaagagtgcgcaaaacgcggtgacgactatcaggaaatttttgcccagcaggtccgtgaaacgatggagcgccgtgcagccggtcttaaaccgcccgcctgggcggctgcagcatttgaatccgggctgcgacaatcaacagaggaggagaagagtgacagcagagctgcgtaatctcccgcatattgccagcatggcctttaatgagccgctgatgcttgaacccgcctatgcgcgggttttcttttgtgcgcttgcaggccagcttgggatcagcagcctgacggatgcggtgtccggcgacagcctgactgcccaggaggcactcgcgacgctggcattatccggtgatgatgacggaccacgacaggcccgcagttatcaggtcatgaacggcatcgccgtgctgccggtgtccggcacgctggtcagccggacgcgggcgctgcagccgtactcggggatgaccggttacaacggcattatcgcccgtctgcaacaggctgccagcgatccgatggtggacggcattctgctcgatatggacacgcccggcgggatggtggcgggggcatttgactgcgctgacatcatcgcccgtgtgcgtgacataaaaccggtatgggcgcttgccaacgacatgaactgcagtgcaggtcagttgcttgccagtgccgcctcccggcgtctggtcacgcagaccgcccggacaggctccatcggcgtcatgatggctcacagtaattacggtgctgcgctggagaaacagggtgtggaaatcacgctgatttacagcggcagccataaggtggatggcaacccctacagccatcttccggatgacgtccgggagacactgcagtcccggatggacgcaacccgccagatgtttgcgcagaaggtgtcggcatataccggcctgtccgtgcaggttgtgctggataccgaggctgcagtgtacagcggtcaggaggccattgatgccggactggctgatgaacttgttaacagcaccgatgcgatcaccgtcatgcgtgatgcactggatgcacgtaaatcccgtctctcaggagggcgaatgaccaaagagactcaatcaacaactgtttcagccactgcttcgcaggctgacgttactgacgtggtgccagcgacggagggcgagaacgccagcgcggcgcagccggacgtgaacgcgcagatcaccgcagcggttgcggcagaaaacagccgcattatggggatcctcaactgtgaggaggctcacggacgcgaagaacaggcacgcgtgctggcagaaacccccggtatgaccgtgaaaacggcccgccgcattctggccgcagcaccacagagtgcacaggcgcgcagtgacactgcgctggatcgtctgatgcagggggcaccggcaccgctggctgcaggtaacccggcatctgatgccgttaacgatttgctgaacacaccagtgtaagggatgtttatgacgagcaaagaaacctttacccattaccagccgcagggcaacagtgacccggctcataccgcaaccgcgcccggcggattgagtgcgaaagcgcctgcaatgaccccgctgatgctggacacctccagccgtaagctggttgcgtgggatggcaccaccgacggtgctgccgttggcattcttgcggttgctgctgaccagaccagcaccacgctgacgttctacaagtccggcacgttccgttatgaggatgtgctctggccggaggctgccagcgacgagacgaaaaaacggaccgcgtttgccggaacggcaatcagcatcgtttaactttacccttcatcactaaaggccgcctgtgcggctttttttacgggatttttttatgtcgatgtacacaaccgcccaactgctggcggcaaatgagcagaaatttaagtttgatccgctgtttctgcgtctctttttccgtgagagctatcccttcaccacggagaaagtctatctctcacaaattccgggactggtaaacatggcgctgtacgtttcgccgattgtttccggtgaggttatccgttcccgtggcggctccacctctgaatttacgccgggatatgtcaagccgaagcatgaagtgaatccgcagatgaccctgcgtcgcctgccggatgaagatccgcagaatctggcggacccggcttaccgccgccgtcgcatcatcatgcagaacatgcgtgacgaagagctggccattgctcaggtcgaagagatgcaggcagtttctgccgtgcttaagggcaaatacaccatgaccggtgaagccttcgatccggttgaggtggatatgggccgcagtgaggagaataacatcacgcagtccggcggcacggagtggagcaagcgtgacaagtccacgtatgacccgaccgacgatatcgaagcctacgcgctgaacgccagcggtgtggtgaatatcatcgtgttcgatccgaaaggctgggcgctgttccgttccttcaaagccgtcaaggagaagctggatacccgtcgtggctctaattccgagctggagacagcggtgaaagacctgggcaaagcggtgtcctataaggggatgtatggcgatgtggccatcgtcgtgtattccggacagtacgtggaaaacggcgtcaaaaagaacttcctgccggacaacacgatggtgctggggaacactcaggcacgcggtctgcgcacctatggctgcattcaggatgcggacgcacagcgcgaaggcattaacgcctctgcccgttacccgaaaaactgggtgaccaccggcgatccggcgcgtgagttcaccatgattcagtcagcaccgctgatgctgctggctgaccctgatgagttcgtgtccgtacaactggcgtaatcatggcccttcggggccattgtttctctgtggaggagtccatgacgaaagatgaactgattgcccgtctccgctcgctgggtgaacaactgaaccgtgatgtcagcctgacggggacgaaagaagaactggcgctccgtgtggcagagctgaaagaggagcttgatgacacggatgaaactgccggtcaggacacccctctcagccgggaaaatgtgctgaccggacatgaaaatgaggtgggatcagcgcagccggataccgtgattctggatacgtctgaactggtcacggtcgtggcactggtgaagctgcatactgatgcacttcacgccacgcgggatgaacctgtggcatttgtgctgccgggaacggcgtttcgtgtctctgccggtgtggcagccgaaatgacagagcgcggcctggccagaatgcaataacgggaggcgctgtggctgatttcgataacctgttcgatgctgccattgcccgcgccgatgaaacgatacgcgggtacatgggaacgtcagccaccattacatccggtgagcagtcaggtgcggtgatacgtggtgtttttgatgaccctgaaaatatcagctatgccggacagggcgtgcgcgttgaaggctccagcccgtccctgtttgtccggactgatgaggtgcggcagctgcggcgtggagacacgctgaccatcggtgaggaaaatttctgggtagatcgggtttcgccggatgatggcggaagttgtcatctctggcttggacggggcgtaccgcctgccgttaaccgtcgccgctgaaagggggatgtatggccataaaaggtcttgagcaggccgttgaaaacctcagccgtatcagcaaaacggcggtgcctggtgccgccgcaatggccattaaccgcgttgcttcatccgcgatatcgcagtcggcgtcacaggttgcccgtgagacaaaggtacgccggaaactggtaaaggaaagggccaggctgaaaagggccacggtcaaaaatccgcaggccagaatcaaagttaaccggggggatttgcccgtaatcaagctgggtaatgcgcgggttgtcctttcgcgccgcaggcgtcgtaaaaaggggcagcgttcatccctgaaaggtggcggcagcgtgcttgtggtgggtaaccgtcgtattcccggcgcgtttattcagcaactgaaaaatggccggtggcatgtcatgcagcgtgtggctgggaaaaaccgttaccccattgatgtggtgaaaatcccgatggcggtgccgctgaccacggcgtttaaacaaaatattgagcggatacggcgtgaacgtcttccgaaagagctgggctatgcgctgcagcatcaactgaggatggtaataaagcgatgaaacatactgaactccgtgcagccgtactggatgcactggagaagcatgacaccggggcgacgttttttgatggtcgccccgctgtttttgatgaggcggattttccggcagttgccgtttatctcaccggcgctgaatacacgggcgaagagctggacagcgatacctggcaggcggagctgcatatcgaagttttcctgcctgctcaggtgccggattcagagctggatgcgtggatggagtcccggatttatccggtgatgagcgatatcccggcactgtcagatttgatcaccagtatggtggccagcggctatgactaccggcgcgacgatgatgcgggcttgtggagttcagccgatctgacttatgtcattacctatgaaatgtgaggacgctatgcctgtaccaaatcctacaatgccggtgaaaggtgccgggaccaccctgtgggtttataaggggagcggtgacccttacgcgaatccgctttcagacgttgactggtcgcgtctggcaaaagttaaagacctgacgcccggcgaactgaccgctgagtcctatgacgacagctatctcgatgatgaagatgcagactggactgcgaccgggcaggggcagaaatctgccggagataccagcttcacgctggcgtggatgcccggagagcaggggcagcaggcgctgctggcgtggtttaatgaaggcgatacccgtgcctataaaatccgcttcccgaacggcacggtcgatgtgttccgtggctgggtcagcagtatcggtaaggcggtgacggcgaaggaagtgatcacccgcacggtgaaagtcaccaatgtgggacgtccgtcgatggcagaagatcgcagcacggtaacagcggcaaccggcatgaccgtgacgcctgccagcacctcggtggtgaaagggcagagcaccacgctgaccgtggccttccagccggagggcgtaaccgacaagagctttcgtgcggtgtctgcggataaaacaaaagccaccgtgtcggtcagtggtatgaccatcaccgtgaacggcgttgctgcaggcaaggtcaacattccggttgtatccggtaatggtgagtttgctgcggttgcagaaattaccgtcaccgccagttaatccggagagtcagcgatgttcctgaaaaccgaatcatttgaacataacggtgtgaccgtcacgctttctgaactgtcagccctgcagcgcattgagcatctcgccctgatgaaacggcaggcagaacaggcggagtcagacagcaaccggaagtttactgtggaagacgccatcagaaccggcgcgtttctggtggcgatgtccctgtggcataaccatccgcagaagacgcagatgccgtccatgaatgaagccgttaaacagattgagcaggaagtgcttaccacctggcccacggaggcaatttctcatgctgaaaacgtggtgtaccggctgtctggtatgtatgagtttgtggtgaataatgcccctgaacagacagaggacgccgggcccgcagagcctgtttctgcgggaaagtgttcgacggtgagctgagttttgccctgaaactggcgcgtgagatggggcgacccgactggcgtgccatgcttgccgggatgtcatccacggagtatgccgactggcaccgcttttacagtacccattattttcatgatgttctgctggatatgcacttttccgggctgacgtacaccgtgctcagcctgtttttcagcgatccggatatgcatccgctggatttcagtctgctgaaccggcgcgaggctgacgaagagcctgaagatgatgtgctgatgcagaaagcggcagggcttgccggaggtgtccgctttggcccggacgggaatgaagttatccccgcttccccggatgtggcggacatgacggaggatgacgtaatgctgatgacagtatcagaagggatcgcaggaggagtccggtatggctgaaccggtaggcgatctggtcgttgatttgagtctggatgcggccagatttgacgagcagatggccagagtcaggcgtcatttttctggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagtccgtggctgatcctgctgcaacagggggggcaggtgaaggactccttcggcgggatgatccccatgttcagggggcttgccggtgcgatcaccctgccgatggtgggggccacctcgctggcggtggcgaccggtgcgctggcgtatgcctggtatcagggcaactcaaccctgtccgatttcaacaaaacgctggtcctttccggcaatcaggcgggactgacggcagatcgtatgctggtcctgtccagagccgggcaggcggcagggctgacgtttaaccagaccagcgagtcactcagcgcactggttaaggcgggggtaagcggtgaggctcagattgcgtccatcagccagagtgtggcgcgtttctcctctgcatccggcgtggaggtggacaaggtcgctgaagccttcgggaagctgaccacagacccgacgtcggggctgacggcgatggctcgccagttccataacgtgtcggcggagcagattgcgtatgttgctcagttgcagcgttccggcgatgaagccggggcattgcaggcggcgaacgaggccgcaacgaaagggtttgatgaccagacccgccgcctgaaagagaacatgggcacgctggagacctgggcagacaggactgcgcgggcattcaaatccatgtgggatgcggtgctggatattggtcgtcctgataccgcgcaggagatgctgattaaggcagaggctgcgtataagaaagcagacgacatctggaatctgcgcaaggatgattattttgttaacgatgaagcgcgggcgcgttactgggatgatcgtgaaaaggcccgtcttgcgcttgaagccgcccgaaagaaggctgagcagcagactcaacaggacaaaaatgcgcagcagcagagcgataccgaagcgtcacggctgaaatataccgaagaggcgcagaaggcttacgaacggctgcagacgccgctggagaaatataccgcccgtcaggaagaactgaacaaggcactgaaagacgggaaaatcctgcaggcggattacaacacgctgatggcggcggcgaaaaaggattatgaagcgacgctgaaaaagccgaaacagtccagcgtgaaggtgtctgcgggcgatcgtcaggaagacagtgctcatgctgccctgctgacgcttcaggcagaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgccattgatgcgaaaagccgggggctgactgaccggcaggcagaacgggaagccacggaacagcgcctgaaggaacagtatggcgataatccgctggcgctgaataacgtcatgtcagagcagaaaaagacctgggcggctgaagaccagcttcgcgggaactggatggcaggcctgaagtccggctggagtgagtgggaagagagcgccacggacagtatgtcgcaggtaaaaagtgcagccacgcagacctttgatggtattgcacagaatatggcggcgatgctgaccggcagtgagcagaactggcgcagcttcacccgttccgtgctgtccatgatgacagaaattctgcttaagcaggcaatggtggggattgtcgggagtatcggcagcgccattggcggggctgttggtggcggcgcatccgcgtcaggcggtacagccattcaggccgctgcggcgaaattccattttgcaaccggaggatttacgggaaccggcggcaaatatgagccagcggggattgttcaccgtggtgagtttgtcttcacgaaggaggcaaccagccggattggcgtggggaatctttaccggctgatgcgcggctatgccaccggcggttatgtcggtacaccgggcagcatggcagacagccggtcgcaggcgtccgggacgtttgagcagaataaccatgtggtgattaacaacgacggcacgaacgggcagataggtccggctgctctgaaggcggtgtatgacatggcccgcaagggtgcccgtgatgaaattcagacacagatgcgtgatggtggcctgttctccggaggtggacgatgaagaccttccgctggaaagtgaaacccggtatggatgtggcttcggtcccttctgtaagaaaggtgcgctttggtgatggctattctcagcgagcgcctgccgggctgaatgccaacctgaaaacgtacagcgtgacgctttctgtcccccgtgaggaggccacggtactggagtcgtttctggaagagcacgggggctggaaatcctttctgtggacgccgccttatgagtggcggcagataaaggtgacctgcgcaaaatggtcgtcgcgggtcagtatgctgcgtgttgagttcagcgcagagtttgaacaggtggtgaactgatgcaggatatccggcaggaaacactgaatgaatgcacccgtgcggagcagtcggccagcgtggtgctctgggaaatcgacctgacagaggtcggtggagaacgttattttttctgtaatgagcagaacgaaaaaggtgagccggtcacctggcaggggcgacagtatcagccgtatcccattcaggggagcggttttgaactgaatggcaaaggcaccagtacgcgccccacgctgacggtttctaacctgtacggtatggtcaccgggatggcggaagatatgcagagtctggtcggcggaacggtggtccggcgtaaggtttacgcccgttttctggatgcggtgaacttcgtcaacggaaacagttacgccgatccggagcaggaggtgatcagccgctggcgcattgagcagtgcagcgaactgagcgcggtgagtgcctcctttgtactgtccacgccgacggaaacggatggcgctgtttttccgggacgtatcatgctggccaacacctgcacctggacctatcgcggtgacgagtgcggttatagcggtccggctgtcgcggatgaatatgaccagccaacgtccgatatcacgaaggataaatgcagcaaatgcctgagcggttgtaagttccgcaataacgtcggcaactttggcggcttcctttccattaacaaactttcgcagtaaatcccatgacacagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccgtatgtcgccggaagactggctgcaggcagaaatgcagggtgagattgtggcgctggtccacagccaccccggtggtctgccctggctgagtgaggccgaccggcggctgcaggtgcagagtgatttgccgtggtggctggtctgccgggggacgattcataagttccgctgtgtgccgcatctcaccgggcggcgctttgagcacggtgtgacggactgttacacactgttccgggatgcttatcatctggcggggattgagatgccggactttcatcgtgaggatgactggtggcgtaacggccagaatctctatctggataatctggaggcgacggggctgtatcaggtgccgttgtcagcggcacagccgggcgatgtgctgctgtgctgttttggttcatcagtgccgaatcacgccgcaatttactgcggcgacggcgagctgctgcaccatattcctgaacaactgagcaaacgagagaggtacaccgacaaatggcagcgacgcacacactccctctggcgtcaccgggcatggcgcgcatctgcctttacggggatttacaacgatttggtcgccgcatcgaccttcgtgtgaaaacgggggctgaagccatccgggcactggccacacagctcccggcgtttcgtcagaaactgagcgacggctggtatcaggtacggattgccgggcgggacgtcagcacgtccgggttaacggcgcagttacatgagactctgcctgatggcgctgtaattcatattgttcccagagtcgccggggccaagtcaggtggcgtattccagattgtcctgggggctgccgccattgccggatcattctttaccgccggagccacccttgcagcatggggggcagccattggggccggtggtatgaccggcatcctgttttctctcggtgccagtatggtgctcggtggtgtggcgcagatgctggcaccgaaagccagaactccccgtatacagacaacggataacggtaagcagaacacctatttctcctcactggataacatggttgcccagggcaatgttctgcctgttctgtacggggaaatgcgcgtggggtcacgcgtggtttctcaggagatcagcacggcagacgaaggggacggtggtcaggttgtggtgattggtcgctgatgcaaaatgttttatgtgaaaccgcctgcgggcggttttgtcatttatggagcgtgaggaatgggtaaaggaagcagtaaggggcataccccgcgcgaagcgaaggacaacctgaagtccacgcagttgctgagtgtgatcgatgccatcagcgaagggccgattgaaggtccggtggatggcttaaaaagcgtgctgctgaacagtacgccggtgctggacactgaggggaataccaacatatccggtgtcacggtggtgttccgggctggtgagcaggagcagactccgccggagggatttgaatcctccggctccgagacggtgctgggtacggaagtgaaatatgacacgccgatcacccgcaccattacgtctgcaaacatcgaccgtctgcgctttaccttcggtgtacaggcactggtggaaaccacctcaaagggtgacaggaatccgtcggaagtccgcctgctggttcagatacaacgtaacggtggctgggtgacggaaaaagacatcaccattaagggcaaaaccacctcgcagtatctggcctcggtggtgatgggtaacctgccgccgcgcccgtttaatatccggatgcgcaggatgacgccggacagcaccacagaccagctgcagaacaaaacgctctggtcgtcatacactgaaatcatcgatgtgaaacagtgctacccgaacacggcactggtcggcgtgcaggtggactcggagcagttcggcagccagcaggtgagccgtaattatcatctgcgcgggcgtattctgcaggtgccgtcgaactataacccgcagacgcggcaatacagcggtatctgggacggaacgtttaaaccggcatacagcaacaacatggcctggtgtctgtgggatatgctgacccatccgcgctacggcatggggaaacgtcttggtgcggcggatgtggataaatgggcgctgtatgtcatcggccagtactgcgaccagtcagtgccggacggctttggcggcacggagccgcgcatcacctgtaatgcgtacctgaccacacagcgtaaggcgtgggatgtgctcagcgatttctgctcggcgatgcgctgtatgccggtatggaacgggcagacgctgacgttcgtgcaggaccgaccgtcggataagacgtggacctataaccgcagtaatgtggtgatgccggatgatggcgcgccgttccgctacagcttcagcgccctgaaggaccgccataatgccgttgaggtgaactggattgacccgaacaacggctgggagacggcgacagagcttgttgaagatacgcaggccattgcccgttacggtcgtaatgttacgaagatggatgcctttggctgtaccagccgggggcaggcacaccgcgccgggctgtggctgattaaaacagaactgctggaaacgcagaccgtggatttcagcgtcggcgcagaagggcttcgccatgtaccgggcgatgttattgaaatctgcgatgatgactatgccggtatcagcaccggtggtcgtgtgctggcggtgaacagccagacccggacgctgacgctcgaccgtgaaatcacgctgccatcctccggtaccgcgctgataagcctggttgacggaagtggcaatccggtcagcgtggaggttcagtccgtcaccgacggcgtgaaggtaaaagtgagccgtgttcctgacggtgttgctgaatacagcgtatgggagctgaagctgccgacgctgcgccagcgactgttccgctgcgtgagtatccgtgagaacgacgacggcacgtatgccatcaccgccgtgcagcatgtgccggaaaaagaggccatcgtggataacggggcgcactttgacggcgaacagagtggcacggtgaatggtgtcacgccgccagcggtgcagcacctgaccgcagaagtcactgcagacagcggggaatatcaggtgctggcgcgatgggacacaccgaaggtggtgaagggcgtgagtttcctgctccgtctgaccgtaacagcggacgacggcagtgagcggctggtcagcacggcccggacgacggaaaccacataccgcttcacgcaactggcgctggggaactacaggctgacagtccgggcggtaaatgcgtgggggcagcagggcgatccggcgtcggtatcgttccggattgccgcaccggcagcaccgtcgaggattgagctgacgccgggctattttcagataaccgccacgccgcatcttgccgtttatgacccgacggtacagtttgagttctggttctcggaaaagcagattgcggatatcagacaggttgaaaccagcacgcgttatcttggtacggcgctgtactggatagccgccagtatcaatatcaaaccgggccatgattattacttttatatccgcagtgtgaacaccgttggcaaatcggcattcgtggaggccgtcggtcgggcgagcgatgatgcggaaggttacctggattttttcaaaggcaagataaccgaatcccatctcggcaaggagctgctggaaaaagtcgagctgacggaggataacgccagcagactggaggagttttcgaaagagtggaaggatgccagtgataagtggaatgccatgtgggctgtcaaaattgagcagaccaaagacggcaaacattatgtcgcgggtattggcctcagcatggaggacacggaggaaggcaaactgagccagtttctggttgccgccaatcgtatcgcatttattgacccggcaaacgggaatgaaacgccgatgtttgtggcgcagggcaaccagatattcatgaacgacgtgttcctgaagcgcctgacggcccccaccattaccagcggcggcaatcctccggccttttccctgacaccggacggaaagctgaccgctaaaaatgcggatatcagtggcagtgtgaatgcgaactccgggacgctcagtaatgtgacgatagctgaaaactgtacgataaacggtacgctgagggcggaaaaaatcgtcggggacattgtaaaggcggcgagcgcggcttttccgcgccagcgtgaaagcagtgtggactggccgtcaggtacccgtactgtcaccgtgaccgatgaccatccttttgatcgccagatagtggtgcttccgctgacgtttcgcggaagtaagcgtactgtcagcggcaggacaacgtattcgatgtgttatctgaaagtactgatgaacggtgcggtgatttatgatggcgcggcgaacgaggcggtacaggtgttctcccgtattgttgacatgccagcgggtcggggaaacgtgatcctgacgttcacgcttacgtccacacggcattcggcagatattccgccgtatacgtttgccagcgatgtgcaggttatggtgattaagaaacaggcgctgggcatcagcgtggtctgagtgtgttacagaggttcgtccgggaacgggcgttttattataaaacagtgagaggtgaacgatgcgtaatgtgtgtattgccgttgctgtctttgccgcacttgcggtgacagtcactccggcccgtgcggaaggtggacatggtacgtttacggtgggctattttcaagtgaaaccgggtacattgccgtcgttgtcgggcggggataccggtgtgagtcatctgaaagggattaacgtgaagtaccgttatgagctgacggacagtgtgggggtgatggcttccctggggttcgccgcgtcgaaaaagagcagcacagtgatgaccggggaggatacgtttcactatgagagcctgcgtggacgttatgtgagcgtgatggccggaccggttttacaaatcagtaagcaggtcagtgcgtacgccatggccggagtggctcacagtcggtggtccggcagtacaatggattaccgtaagacggaaatcactcccgggtatatgaaagagacgaccactgccagggacgaaagtgcaatgcggcatacctcagtggcgtggagtgcaggtatacagattaatccggcagcgtccgtcgttgttgatattgcttatgaaggctccggcagtggcgactggcgtactgacggattcatcgttggggtcggttataaattctgattagccaggtaacacagtgttatgacagcccgccggaaccggtgggcttttttgtggggtgaatatggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgaaacgaacagaaaagcccactggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggcctttccggcaggtgcgccgatcccgtggccatcagatatcgttccgtctggctacgtcctgatgcaggggcaggcgtttgacaaatcagcctacccaaaacttgctgtcgcgtatccatcgggtgtgcttcctgatatgcgaggctggacaatcaaggggaaacccgccagcggtcgtgctgtattgtctcaggaacaggatggaattaagtcgcacacccacagtgccagtgcatccggtacggatttggggacgaaaaccacatcgtcgtttgattacgggacgaaaacaacaggcagtttcgattacggcaccaaatcgacgaataacacgggggctcatgctcacagtctgagcggttcaacaggggccgcgggtgctcatgcccacacaagtggtttaaggatgaacagttctggctggagtcagtatggaacagcaaccattacaggaagtttatccacagttaaaggaaccagcacacagggtattgcttatttatcgaaaacggacagtcagggcagccacagtcactcattgtccggtacagccgtgagtgccggtgcacatgcgcatacagttggtattggtgcgcaccagcatccggttgttatcggtgctcatgcccattctttcagtattggttcacacggacacaccatcaccgttaacgctgcgggtaacgcggaaaacaccgtcaaaaacattgcatttaactatattgtgaggcttgcataatggcattcagaatgagtgaacaaccacggaccataaaaatttataatctgctggccggaactaatgaatttattggtgaaggtgacgcatatattccgcctcataccggtctgcctgcaaacagtaccgatattgcaccgccagatattccggctggctttgtggctgttttcaacagtgatgaggcatcgtggcatctcgttgaagaccatcggggtaaaaccgtctatgacgtggcttccggcgacgcgttatttatttctgaactcggtccgttaccggaaaattttacctggttatcgccgggaggggaatatcagaagtggaacggcacagcctgggtgaaggatacggaagcagaaaaactgttccggatccgggaggcggaagaaacaaaaaaaagcctgatgcaggtagccagtgagcatattgcgccgcttcaggatgctgcagatctggaaattgcaacgaaggaagaaacctcgttgctggaagcctggaagaagtatcgggtgttgctgaaccgtgttgatacatcaactgcacctgatattgagtggcctgctgtccctgttatggagtaatcgttttgtgatatgccgcagaaacgttgtatgaaataacgttctgcggttagttagtatattgtaaagctgagtattggtttatttggcgattattatcttcaggagaataatggaagttctatgactcaattgttcatagtgtttacatcaccgccaattgcttttaagactgaacgcatgaaatatggtttttcgtcatgttttgagtctgctgttgatatttctaaagtcggttttttttcttcgttttctctaactattttccatgaaatacatttttgattattatttgaatcaattccaattacctgaagtctttcatctataattggcattgtatgtattggtttattggagtagatgcttgcttttctgagccatagctctgatatccaaatgaagccataggcatttgttattttggctctgtcagctgcataacgccaaaaaatatatttatctgcttgatcttcaaatgttgtattgattaaatcaattggatggaattgtttatcataaaaaattaatgtttgaatgtgataaccgtcctttaaaaaagtcgtttctgcaagcttggctgtatagtcaactaactcttctgtcgaagtgatatttttaggcttatctaccagttttagacgctctttaatatcttcaggaattattttattgtcatattgtatcatgctaaatgacaatttgcttatggagtaatcttttaattttaaataagttattctcctggcttcatcaaataaagagtcgaatgatgttggcgaaatcacatcgtcacccattggattgtttatttgtatgccaagagagttacagcagttatacattctgccatagattatagctaaggcatgtaataattcgtaatcttttagcgtattagcgacccatcgtctttctgatttaataatagatgattcagttaaatatgaaggtaatttcttttgtgcaagtctgactaacttttttataccaatgtttaacatactttcatttgtaataaactcaatgtcattttcttcaatgtaagatgaaataagagtagcctttgcctcgctatacatttctaaatcgccttgtttttctatcgtattgcgagaatttttagcccaagccattaatggatcatttttccatttttcaataacattattgttataccaaatgtcatatcctataatctggtttttgtttttttgaataataaatgttactgttcttgcggtttggaggaattgattcaaattcaagcgaaataattcagggtcaaaatatgtatcaatgcagcatttgagcaagtgcgataaatctttaagtcttctttcccatggttttttagtcataaaactctccattttgataggttgcatgctagatgctgatatattttagaggtgataaaattaactgcttaactgtcaatgtaatacaagttgtttgatctttgcaatgattcttatcagaaaccatatagtaaattagttacacaggaaatttttaatattattattatcattcattatgtattaaaattagagttgtggcttggctctgctaacacgttgctcataggagatatggtagagccgcagacacgtcgtatgcaggaacgtgctgcggctggctggtgaacttccgatagtgcgggtgttgaatgatttccagttgctaccgattttacatattttttgcatgagagaatttgtaccacctcccaccgaccatctatgactgtacgccactgtccctaggactgctatgtgccggagcggacattacaaacgtccttctcggtgcatgccactgttgccaatgacctgcctaggaattggttagcaagttactaccggattttgtaaaaacagccctcctcatataaaaagtattcgttcacttccgataagcgtcgtaattttctatctttcatcatattctagatccctctgaaaaaatcttccgagtttgctaggcactgatacataactcttttccaataattggggaagtcattcaaatctataataggtttcagatttgcttcaataaattctgactgtagctgctgaaacgttgcggttgaactatatttccttataacttttacgaaagagtttctttgagtaatcacttcactcaagtgcttccctgcctccaaacgatacctgttagcaatatttaatagcttgaaatgatgaagagctctgtgtttgtcttcctgcctccagttcgccgggcattcaacataaaaactgatagcacccggagttccggaaacgaaatttgcatatacccattgctcacgaaaaaaaatgtccttgtcgatatagggatgaatcgcttggtgtacctcatctactgcgaaaacttgacctttctctcccatattgcagtcgcggcacgatggaactaaattaataggcatcaccgaaaattcaggataatgtgcaataggaagaaaatgatctatattttttgtctgtcctatatcaccacaaaatggacatttttcacctgatgaaacaagcatgtcatcgtaatatgttctagcgggtttgtttttatctcggagattattttcataaagcttttctaatttaacctttgtcaggttaccaactactaaggttgtaggctcaagagggtgtgtcctgtcgtaggtaaataactgacctgtcgagcttaatattctatattgttgttctttctgcaaaaaagtggggaagtgagtaatgaaattatttctaacatttatctgcatcataccttccgagcatttattaagcatttcgctataagttctcgctggaagaggtagttttttcattgtactttaccttcatctctgttcattatcatcgcttttaaaacggttcgaccttctaatcctatctgaccattataattttttagaatggtttcataagaaagctctgaatcaacggactgcgataataagtggtggtatccagaatttgtcacttcaagtaaaaacacctcacgagttaaaacacctaagttctcaccgaatgtctcaatatccggacggataatatttattgcttctcttgaccgtaggactttccacatgcaggattttggaacctcttgcagtactactggggaatgagttgcaattattgctacaccattgcgtgcatcgagtaagtcgcttaatgttcgtaaaaaagcagagagcaaaggtggatgcagatgaacctctggttcatcgaataaaactaatgacttttcgccaacgacatctactaatcttgtgatagtaaataaaacaattgcatgtccagagctcattcgaagcagatatttctggatattgtcataaaacaatttagtgaatttatcatcgtccacttgaatctgtggttcattacgtcttaactcttcatatttagaaatgaggctgatgagttccatatttgaaaagttttcatcactacttagttttttgatagcttcaagccagagttgtctttttctatctactctcatacaaccaataaatgctgaaatgaattctaagcggagatcgcctagtgattttaaactattgctggcagcattcttgagtccaatataaaagtattgtgtaccttttgctgggtcaggttgttctttaggaggagtaaaaggatcaaatgcactaaacgaaactgaaacaagcgatcgaaaatatccctttgggattcttgactcgataagtctattattttcagagaaaaaatattcattgttttctgggttggtgattgcaccaatcattccattcaaaattgttgttttaccacacccattccgcccgataaaagcatgaatgttcgtgctgggcatagaattaaccgtcacctcaaaaggtatagttaaatcactgaatccgggagcactttttctattaaatgaaaagtggaaatctgacaattctggcaaaccatttaacacacgtgcgaactgtccatgaatttctgaaagagttacccctctaagtaatgaggtgttaaggacgctttcattttcaatgtcggctaatcgatttggccatactactaaatcctgaatagctttaagaaggttatgtttaaaaccatcgcttaatttgctgagattaacatagtagtcaatgctttcacctaaggaaaaaaacatttcagggagttgactgaattttttatctattaatgaataagtgcttacttcttctttttgacctacaaaaccaattttaacatttccgatatcgcatttttcaccatgctcatcaaagacagtaagataaaacattgtaacaaaggaatagtcattccaaccatctgctcgtaggaatgccttatttttttctactgcaggaatatacccgcctctttcaataacactaaactccaacatatagtaacccttaattttattaaaataaccgcaatttatttggcggcaacacaggatctctcttttaagttactctctattacatacgttttccatctaaaaattagtagtattgaacttaacggggcatcgtattgtagttttccatatttagctttctgcttccttttggataacccactgttattcatgttgcatggtgcactgtttataccaacgatatagtctattaatgcatatatagtatcgccgaacgattagctcttcaggcttctgaagaagcgtttcaagtactaataagccgatagatagccacggacttcgtagccatttttcataagtgttaacttccgctcctcgctcataacagacattcactacagttatggcggaaaggtatgcatgctgggtgtggggaagtcgtgaaagaaaagaagtcagctgcgtcgtttgacatcactgctatcttcttactggttatgcaggtcgtagtgggtggcacacaaagctttgcactggattgcgaggctttgtgcttctctggagtgcgacaggtttgatgacaaaaaattagcgcaagaagacaaaaatcaccttgcgctaatgctctgttacaggtcactaataccatctaagtagttgattcatagtgactgcatatgttgtgttttacagtattatgtagtctgttttttatgcaaaatctaatttaatatattgatatttatatcattttacgtttctcgttcagcttttttatactaagttggcattataaaaaagcattgcttatcaatttgttgcaacgaacaggtcactatcagtcaaaataaaatcattatttgatttcaattttgtcccactccctgcctctgtcatcacgatactgtgatgccatggtgtccgacttatgcccgagaagatgttgagcaaacttatcgcttatctgcttctcatagagtcttgcagacaaactgcgcaactcgtgaaaggtaggcggatccccttcgaaggaaagacctgatgcttttcgtgcgcgcataaaataccttgatactgtgccggatgaaagcggttcgcgacgagtagatgcaattatggtttctccgccaagaatctctttgcatttatcaagtgtttccttcattgatattccgagagcatcaatatgcaatgctgttgggatggcaatttttacgcctgttttgctttgctcgacataaagatatccatctacgatatcagaccacttcatttcgcataaatcaccaactcgttgcccggtaacaacagccagttccattgcaagtctgagccaacatggtgatgattctgctgcttgataaattttcaggtattcgtcagccgtaagtcttgatctccttacctctgattttgctgcgcgagtggcagcgacatggtttgttgttatatggccttcagctattgcctctcggaatgcatcgctcagtgttgatctgattaacttggctgacgccgccttgccctcgtctatgtatccattgagcattgccgcaatttcttttgtggtgatgtcttcaagtggagcatcaggcagacccctccttattgctttaattttgctcatgtaatttatgagtgtcttctgcttgattcctctgctggccaggattttttcgtagcgatcaagccatgaatgtaacgtaacggaattatcactgttgattctcgctgtcagaggcttgtgtttgtgtcctgaaaataactcaatgttggcctgtatagcttcagtgattgcgattcgcctgtctctgcctaatccaaactctttacccgtccttgggtccctgtagcagtaatatccattgtttcttatataaaggttagggggtaaatcccggcgctcatgacttcgccttcttcccatttctgatcctcttcaaaaggccacctgttactggtcgatttaagtcaacctttaccgctgattcgtggaacagatactctcttccatccttaaccggaggtgggaatatcctgcattcccgaacccatcgacgaactgtttcaaggcttcttggacgtcgctggcgtgcgttccactcctgaagtgtcaagtacatcgcaaagtctccgcaattacacgcaagaaaaaaccgccatcaggcggcttggtgttctttcagttcttcaattcgaatattggttacgtctgcatgtgctatctgcgcccatatcatccagtggtcgtagcagtcgttgatgttctccgcttcgataactctgttgaatggctctccattccattctcctgtgactcggaagtgcatttatcatctccataaaacaaaacccgccgtagcgagttcagataaaataaatccccgcgagtgcgaggattgttatgtaatattgggtttaatcatctatatgttttgtacagagagggcaagtatcgtttccaccgtactcgtgataataattttgcacggtatcagtcatttctcgcacattgcagaatggggatttgtcttcattagacttataaaccttcatggaatatttgtatgccgactctatatctataccttcatctacataaacaccttcgtgatgtctgcatggagacaagacaccggatctgcacaacattgataacgcccaatctttttgctcagactctaactcattgatactcatttataaactccttgcaatgtatgtcgtttcagctaaacggtatcagcaatgtttatgtaaagaaacagtaagataatactcaacccgatgtttgagtacggtcatcatctgacactacagactctggcatcgctgtgaagacgacgcgaaattcagcattttcacaagcgttatcttttacaaaaccgatctcactctcctttgatgcgaatgccagcgtcagacatcatatgcagatactcacctgcatcctgaacccattgacctccaaccccgtaatagcgatgcgtaatgatgtcgatagttactaacgggtcttgttcgattaactgccgcagaaactcttccaggtcaccagtgcagtgcttgataacaggagtcttcccaggatggcgaacaacaagaaactggtttccgtcttcacggacttcgttgctttccagtttagcaatacgcttactcccatccgagataacaccttcgtaatactcacgctgctcgttgagttttgattttgctgtttcaagctcaacacgcagtttccctactgttagcgcaatatcctcgttctcctggtcgcggcgtttgatgtattgctggtttctttcccgttcatccagcagttccagcacaatcgatggtgttaccaattcatggaaaaggtctgcgtcaaatccccagtcgtcatgcattgcctgctctgccgcttcacgcagtgcctgagagttaatttcgctcacttcgaacctctctgtttactgataagttccagatcctcctggcaacttgcacaagtccgacaaccctgaacgaccaggcgtcttcgttcatctatcggatcgccacactcacaacaatgagtggcagatatagcctggtggttcaggcggcgcatttttattgctgtgttgcgctgtaattcttctatttctgatgctgaatcaatgatgtctgccatctttcattaatccctgaactgttggttaatacgcttgagggtgaatgcgaataataaaaaaggagcctgtagctccctgatgattttgcttttcatgttcatcgttccttaaagacgccgtttaacatgccgattgccaggcttaaatgagtcggtgtgaatcccatcagcgttaccgtttcgcggtgcttcttcagtacgctacggcaaatgtcatcgacgtttttatccggaaactgctgtctggctttttttgatttcagaattagcctgacgggcaatgctgcgaagggcgttttcctgctgaggtgtcattgaacaagtcccatgtcggcaagcataagcacacagaatatgaagcccgctgccagaaaaatgcattccgtggttgtcatacctggtttctctcatctgcttctgctttcgccaccatcatttccagcttttgtgaaagggatgcggctaacgtatgaaattcttcgtctgtttctactggtattggcacaaacctgattccaatttgagcaaggctatgtgccatctcgatactcgttcttaactcaacagaagatgctttgtgcatacagcccctcgtttattatttatctcctcagccagccgctgtgctttcagtggatttcggataacagaaaggccgggaaatacccagcctcgctttgtaacggagtagacgaaagtgattgcgcctacccggatattatcgtgaggatgcgtcatcgccattgctccccaaatacaaaaccaatttcagccagtgcctcgtccattttttcgatgaactccggcacgatctcgtcaaaactcgccatgtacttttcatcccgctcaatcacgacataatgcaggccttcacgcttcatacgcgggtcatagttggcaaagtaccaggcattttttcgcgtcacccacatgctgtactgcacctgggccatgtaagctgactttatggcctcgaaaccaccgagccggaacttcatgaaatcccgggaggtaaacgggcatttcagttcaaggccgttgccgtcactgcataaaccatcgggagagcaggcggtacgcatactttcgtcgcgatagatgatcggggattcagtaacattcacgccggaagtgaattcaaacagggttctggcgtcgttctcgtactgttttccccaggccagtgctttagcgttaacttccggagccacaccggtgcaaacctcagcaagcagggtgtggaagtaggacattttcatgtcaggccacttctttccggagcggggttttgctatcacgttgtgaacttctgaagcggtgatgacgccgagccgtaatttgtgccacgcatcatccccctgttcgacagctctcacatcgatcccggtacgctgcaggataatgtccggtgtcatgctgccaccttctgctctgcggctttctgtttcaggaatccaagagcttttactgcttcggcctgtgtcagttctgacgatgcacgaatgtcgcggcgaaatatctgggaacagagcggcaataagtcgtcatcccatgttttatccagggcgatcagcagagtgttaatctcctgcatggtttcatcgttaaccggagtgatgtcgcgttccggctgacgttctgcagtgtatgcagtattttcgacaatgcgctcggcttcatccttgtcatagataccagcaaatccgaaggccagacgggcacactgaatcatggctttatgacgtaacatccgtttgggatgcgactgccacggccccgtgatttctctgccttcgcgagttttgaatggttcgcggcggcattcatccatccattcggtaacgcagatcggatgattacggtccttgcggtaaatccggcatgtacaggattcattgtcctgctcaaagtccatgccatcaaactgctggttttcattgatgatgcgggaccagccatcaacgcccaccaccggaacgatgccattctgcttatcaggaaaggcgtaaatttctttcgtccacggattaaggccgtactggttggcaacgatcagtaatgcgatgaactgcgcatcgctggcatcacctttaaatgccgtctggcgaagagtggtgatcagttcctgtgggtcgacagaatccatgccgacacgttcagccagcttcccagccagcgttgcgagtgcagtactcattcgttttatacctctgaatcaatatcaacctggtggtgagcaatggtttcaaccatgtaccggatgtgttctgccatgcgctcctgaaactcaacatcgtcatcaaacgcacgggtaatggattttttgctggccccgtggcgttgcaaatgatcgatgcatagcgattcaaacaggtgctggggcaggcctttttccatgtcgtctgccagttctgcctctttctcttcacgggcgagctgctggtagtgacgcgcccagctctgagcctcaagacgatcctgaatgtaataagcgttcatggctgaactcctgaaatagctgtgaaaatatcgcccgcgaaatgccgggctgattaggaaaacaggaaagggggttagtgaatgcttttgcttgatctcagtttcagtattaatatccattttttataagcgtcgacggcttcacgaaacatcttttcatcgccaataaaagtggcgatagtgaatttagtctggatagccataagtgtttgatccattctttgggactcctggctgattaagtatgtcgataaggcgtttccatccgtcacgtaatttacgggtgattcgttcaagtaaagattcggaagggcagccagcaacaggccaccctgcaatggcatattgcatggtgtgctccttatttatacataacgaaaaacgcctcgagtgaagcgttattggtatgcggtaaaaccgcactcaggcggccttgatagtcatatcatctgaatcaaatattcctgatgtatcgatatcggtaattcttattccttcgctaccatccattggaggccatccttcctgaccatttccatcattccagtcgaactcacacacaacaccatatgcatttaagtcgcttgaaattgctataagcagagcatgttgcgccagcatgattaatacagcatttaatacagagccgtgtttattgagtcggtattcagagtctgaccagaaattattaatctggtgaagtttttcctctgtcattacgtcatggtcgatttcaatttctattgatgctttccagtcgtaatcaatgatgtattttttgatgtttgacatctgttcatatcctcacagataaaaaatcgccctcacactggagggcaaagaagatttccaataatcagaacaagtcggctcctgtttagttacgagcgacattgctccgtgtattcactcgttggaatgaatacacagtgcagtgtttattctgttatttatgccaaaaataaaggccactatcaggcagctttgttgttctgtttaccaagttctctggcaatcattgccgtcgttcgtattgcccatttatcgacatatttcccatcttccattacaggaaacatttcttcaggcttaaccatgcattccgattgcagcttgcatccattgcatcgcttgaattgtccacaccattgatttttatcaatagtcgtagtcatacggatagtcctggtattgttccatcacatcctgaggatgctcttcgaactcttcaaattcttcttccatatatcaccttaaatagtggattgcggtagtaaagattgtgcctgtcttttaaccacatcaggctcggtggttctcgtgtacccctacagcgagaaatcggataaactattacaacccctacagtttgatgagtatagaaatggatccactcgttattctcggacgagtgttcagtaatgaacctctggagagaaccatgtatatgatcgttatctgggttggacttctgcttttaagcccagataactggcctgaatatgttaatgagagaatcggtattcctcatgtgtggcatgttttcgtctttgctcttgcattttcgctagcaattaatgtgcatcgattatcagctattgccagcgccagatataagcgatttaagctaagaaaacgcattaagatgcaaaacgataaagtgcgatcagtaattcaaaaccttacagaagagcaatctatggttttgtgcgcagcccttaatgaaggcaggaagtatgtggttacatcaaaacaattcccatacattagtgagttgattgagcttggtgtgttgaacaaaactttttcccgatggaatggaaagcatatattattccctattgaggatatttactggactgaattagttgccagctatgatccatataatattgagataaagccaaggccaatatctaagtaactagataagaggaatcgattttcccttaattttctggcgtccactgcatgttatgccgcgttcgccaggcttgctgtaccatgtgcgctgattcttgcgctcaatacgttgcaggttgctttcaatctgtttgtggtattcagccagcactgtaaggtctatcggatttagtgcgctttctactcgtgatttcggtttgcgattcagcgagagaatagggcggttaactggttttgcgcttaccccaaccaacaggggatttgctgctttccattgagcctgtttctctgcgcgacgttcgcggcggcgtgtttgtgcatccatctggattctcctgtcagttagctttggtggtgtgtggcagttgtagtcctgaacgaaaaccccccgcgattggcacattggcagctaatccggaatcgcacttacggccaatgcttcgtttcgtatcacacaccccaaagccttctgctttgaatgctgcccttcttcagggcttaatttttaagagcgtcaccttcatggtggtcagtgcgtcctgctgatgtgctcagtatcaccgccagtggtatttatgtcaacaccgccagagataatttatcaccgcagatggttatctgtatgttttttatatgaatttattttttgcaggggggcattgtttggtaggtgagagatctgaattgctatgtttagtgagttgtatctatttatttttcaataaatacaattggttatgtgttttgggggcgatcgtgaggcaaagaaaacccggcgctgaggccgggttattcttgttctctggtcaaattatatagttggaaaacaaggatgcatatatgaatgaacgatgcagaggcaatgccgatggcgatagtgggtatcatgtagccgcttatgctggaaagaagcaataacccgcagaaaaacaaagctccaagctcaacaaaactaagggcatagacaataactaccgatgtcatatacccatactctctaatcttggccagtcggcgcgttctgcttccgattagaaacgtcaaggcagcaatcaggattgcaatcatggttcctgcatatgatgacaatgtcgccccaagaccatctctatgagctgaaaaagaaacaccaggaatgtagtggcggaaaaggagatagcaaatgcttacgataacgtaaggaattattactatgtaaacaccaggcatgattctgttccgcataattactcctgataattaatccttaactttgcccacctgccttttaaaacattccagtatatcacttttcattcttgcgtagcaatatgccatctcttcagctatctcagcattggtgaccttgttcagaggcgctgagagatggcctttttctgatagataatgttctgttaaaatatctccggcctcatcttttgcccgcaggctaatgtctgaaaattgaggtgacgggttaaaaataatatccttggcaaccttttttatatcccttttaaattttggcttaatgactatatccaatgagtcaaaaagctccccttcaatatctgttgcccctaagacctttaatatatcgccaaatacaggtagcttggcttctaccttcaccgttgttcggccgatgaaatgcatatgcataacatcgtctttggtggttcccctcatcagtggctctatctgaacgcgctctccactgcttaatgacattcctttcccgattaaaaaatctgtcagatcggatgtggtcggcccgaaaacagttctggcaaaaccaatggtgtcgccttcaacaaacaaaaaagatgggaatcccaatgattcgtcatctgcgaggctgttcttaatatcttcaactgaagctttagagcgatttatcttctgaaccagactcttgtcatttgttttggtaaagagaaaagtttttccatcgattttatgaatatacaaataattggagccaacctgcaggtgatgattatcagccagcagagaattaaggaaaacagacaggtttattgagcgcttatctttccctttatttttgctgcggtaagtcgcataaaaaccattcttcataattcaatccatttactatgttatgttctgaggggagtgaaaattcccctaattcgatgaagattcttgctcaattgttatcagctatgcgccgaccagaacaccttgccgatcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggcttttttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatgtactaaggaggttgtatggaacaacgcataaccctgaaagattatgcaatgcgctttgggcaaaccaagacagctaaagatctcggcgtatatcaaagcgcgatcaacaaggccattcatgcaggccgaaagatttttttaactataaacgctgatggaagcgtttatgcggaagaggtaaagcccttcccgagtaacaaaaaaacaacagcataaataaccccgctcttacacattccagccctgaaaaagggcatcaaattaaaccacacctatggtgtatgcatttatttgcatacattcaatcaattgttatctaaggaaatacttacatatggttcgtgcaaacaaacgcaacgaggctctacgaatcgagagtgcgttgcttaacaaaatcgcaatgcttggaactgagaagacagcggaagctgtgggcgttgataagtcgcagatcagcaggtggaagagggactggattccaaagttctcaatgctgcttgctgttcttgaatggggggtcgttgacgacgacatggctcgattggcgcgacaagttgctgcgattctcaccaataaaaaacgcccggcggcaaccgagcgttctgaacaaatccagatggagttctgaggtcattactggatctatcaacaggagtcattatgacaaatacagcaaaaatactcaacttcggcagaggtaactttgccggacaggagcgtaatgtggcagatctcgatgatggttacgccagactatcaaatatgctgcttgaggcttattcgggcgcagatctgaccaagcgacagtttaaagtgctgcttgccattctgcgtaaaacctatgggtggaataaaccaatggacagaatcaccgattctcaacttagcgagattacaaagttacctgtcaaacggtgcaatgaagccaagttagaactcgtcagaatgaatattatcaagcagcaaggcggcatgtttggaccaaataaaaacatctcagaatggtgcatccctcaaaacgagggaaaatcccctaaaacgagggataaaacatccctcaaattgggggattgctatccctcaaaacagggggacacaaaagacactattacaaaagaaaaaagaaaagattattcgtcagagaattctggcgaatcctctgaccagccagaaaacgacctttctgtggtgaaaccggatgctgcaattcagagcggcagcaagtgggggacagcagaagacctgaccgccgcagagtggatgtttgacatggtgaagactatcgcaccatcagccagaaaaccgaattttgctgggtgggctaacgatatccgcctgatgcgtgaacgtgacggacgtaaccaccgcgacatgtgtgtgctgttccgctgggcatgccaggacaacttctggtccggtaacgtgctgagcccggccaaactccgcgataagtggacccaactcgaaatcaaccgtaacaagcaacaggcaggcgtgacagccagcaaaccaaaactcgacctgacaaacacagactggatttacggggtggatctatgaaaaacatcgccgcacagatggttaactttgaccgtgagcagatgcgtcggatcgccaacaacatgccggaacagtacgacgaaaagccgcaggtacagcaggtagcgcagatcatcaacggtgtgttcagccagttactggcaactttcccggcgagcctggctaaccgtgaccagaacgaagtgaacgaaatccgtcgccagtgggttctggcttttcgggaaaacgggatcaccacgatggaacaggttaacgcaggaatgcgcgtagcccgtcggcagaatcgaccatttctgccatcacccgggcagtttgttgcatggtgccgggaagaagcatccgttaccgccggactgccaaacgtcagcgagctggttgatatggtttacgagtattgccggaagcgaggcctgtatccggatgcggagtcttatccgtggaaatcaaacgcgcactactggctggttaccaacctgtatcagaacatgcgggccaatgcgcttactgatgcggaattacgccgtaaggccgcagatgagcttgtccatatgactgcgagaattaaccgtggtgaggcgatccctgaaccagtaaaacaacttcctgtcatgggcggtagacctctaaatcgtgcacaggctctggcgaagatcgcagaaatcaaagctaagttcggactgaaaggagcaagtgtatgacgggcaaagaggcaattattcattacctggggacgcataatagcttctgtgcgccggacgttgccgcgctaacaggcgcaacagtaaccagcataaatcaggccgcggctaaaatggcacgggcaggtcttctggttatcgaaggtaaggtctggcgaacggtgtattaccggtttgctaccagggaagaacgggaaggaaagatgagcacgaacctggtttttaaggagtgtcgccagagtgccgcgatgaaacgggtattggcggtatatggagttaaaagatgaccatctacattactgagctaataacaggcctgctggtaatcgcaggcctttttatttgggggagagggaagtcatgaaaaaactaacctttgaaattcgatctccagcacatcagcaaaacgctattcacgcagtacagcaaatccttccagacccaaccaaaccaatcgtagtaaccattcaggaacgcaaccgcagcttagaccaaaacaggaagctatgggcctgcttaggtgacgtctctcgtcaggttgaatggcatggtcgctggctggatgcagaaagctggaagtgtgtgtttaccgcagcattaaagcagcaggatgttgttcctaaccttgccgggaatggctttgtggtaataggccagtcaaccagcaggatgcgtgtaggcgaatttgcggagctattagagcttatacaggcattcggtacagagcgtggcgttaagtggtcagacgaagcgagactggctctggagtggaaagcgagatggggagacagggctgcatgataaatgtcgttagtttctccggtggcaggacgtcagcatatttgctctggctaatggagcaaaagcgacgggcaggtaaagacgtgcattacgttttcatggatacaggttgtgaacatccaatgacatatcggtttgtcagggaagttgtgaagttctgggatataccgctcaccgtattgcaggttgatatcaacccggagcttggacagccaaatggttatacggtatgggaaccaaaggatattcagacgcgaatgcctgttctgaagccatttatcgatatggtaaagaaatatggcactccatacgtcggcggcgcgttctgcactgacagattaaaactcgttcccttcaccaaatactgtgatgaccatttcgggcgagggaattacaccacgtggattggcatcagagctgatgaaccgaagcggctaaagccaaagcctggaatcagatatcttgctgaactgtcagactttgagaaggaagatatcctcgcatggtggaagcaacaaccattcgatttgcaaataccggaacatctcggtaactgcatattctgcattaaaaaatcaacgcaaaaaatcggacttgcctgcaaagatgaggagggattgcagcgtgtttttaatgaggtcatcacgggatcccatgtgcgtgacggacatcgggaaacgccaaaggagattatgtaccgaggaagaatgtcgctggacggtatcgcgaaaatgtattcagaaaatgattatcaagccctgtatcaggacatggtacgagctaaaagattcgataccggctcttgttctgagtcatgcgaaatatttggagggcagcttgatttcgacttcgggagggaagctgcatgatgcgatgttatcggtgcggtgaatgcaaagaagataaccgcttccgaccaaatcaaccttactggaatcgatggtgtctccggtgtgaaagaacaccaacaggggtgttaccactaccgcaggaaaaggaggacgtgtggcgagacagcgacgaagtatcaccgacataatctgcgaaaactgcaaataccttccaacgaaacgcaccagaaataaacccaagccaatcccaaaagaatctgacgtaaaaaccttcaactacacggctcacctgtgggatatccggtggctaagacgtcgtgcgaggaaaacaaggtgattgaccaaaatcgaagttacgaacaagaaagcgtcgagcgagctttaacgtgcgctaactgcggtcagaagctgcatgtgctggaagttcacgtgtgtgagcactgctgcgcagaactgatgagcgatccgaatagctcgatgcacgaggaagaagatgatggctaaaccagcgcgaagacgatgtaaaaacgatgaatgccgggaatggtttcaccctgcattcgctaatcagtggtggtgctctccagagtgtggaaccaagatagcactcgaacgacgaagtaaagaacgcgaaaaagcggaaaaagcagcagagaagaaacgacgacgagaggagcagaaacagaaagataaacttaagattcgaaaactcgccttaaagccccgcagttactggattaaacaagcccaacaagccgtaaacgccttcatcagagaaagagaccgcgacttaccatgtatctcgtgcggaacgctcacgtctgctcagtgggatgccggacattaccggacaactgctgcggcacctcaactccgatttaatgaacgcaatattcacaagcaatgcgtggtgtgcaaccagcacaaaagcggaaatctcgttccgtatcgcgtcgaactgattagccgcatcgggcaggaagcagtagacgaaatcgaatcaaaccataaccgccatcgctggactatcgaagagtgcaaggcgatcaaggcagagtaccaacagaaactcaaagacctgcgaaatagcagaagtgaggccgcatgacgttctcagtaaaaaccattccagacatgctcgttgaaacatacggaaatcagacagaagtagcacgcagactgaaatgtagtcgcggtacggtcagaaaatacgttgatgataaagacgggaaaatgcacgccatcgtcaacgacgttctcatggttcatcgcggatggagtgaaagagatgcgctattacgaaaaaattgatggcagcaaataccgaaatatttgggtagttggcgatctgcacggatgctacacgaacctgatgaacaaactggatacgattggattcgacaacaaaaaagacctgcttatctcggtgggcgatttggttgatcgtggtgcagagaacgttgaatgcctggaattaatcacattcccctggttcagagctgtacgtggaaaccatgagcaaatgatgattgatggcttatcagagcgtggaaacgttaatcactggctgcttaatggcggtggctggttctttaatctcgattacgacaaagaaattctggctaaagctcttgcccataaagcagatgaacttccgttaatcatcgaactggtgagcaaagataaaaaatatgttatctgccacgccgattatccctttgacgaatacgagtttggaaagccagttgatcatcagcaggtaatctggaaccgcgaacgaatcagcaactcacaaaacgggatcgtgaaagaaatcaaaggcgcggacacgttcatctttggtcatacgccagcagtgaaaccactcaagtttgccaaccaaatgtatatcgataccggcgcagtgttctgcggaaacctaacattgattcaggtacagggagaaggcgcatgagactcgaaagcgtagctaaatttcattcgccaaaaagcccgatgatgagcgactcaccacgggccacggcttctgactctctttccggtactgatgtgatggctgctatggggatggcgcaatcacaagccggattcggtatggctgcattctgcggtaagcacgaactcagccagaacgacaaacaaaaggctatcaactatctgatgcaatttgcacacaaggtatcggggaaataccgtggtgtggcaaagcttgaaggaaatactaaggcaaaggtactgcaagtgctcgcaacattcgcttatgcggattattgccgtagtgccgcgacgccgggggcaagatgcagagattgccatggtacaggccgtgcggttgatattgccaaaacagagctgtgggggagagttgtcgagaaagagtgcggaagatgcaaaggcgtcggctattcaaggatgccagcaagcgcagcatatcgcgctgtgacgatgctaatcccaaaccttacccaacccacctggtcacgcactgttaagccgctgtatgacgctctggtggtgcaatgccacaaagaagagtcaatcgcagacaacattttgaatgcggtcacacgttagcagcatgattgccacggatggcaacatattaacggcatgatattgacttattgaataaaattgggtaaatttgactcaacgatgggttaattcgctcgttgtggtagtgagatgaaaagaggcggcgcttactaccgattccgcctagttggtcacttcgacgtatcgtctggaactccaaccatcgcaggcagagaggtctgcaaaatgcaatcccgaaacagttcgcaggtaatagttagagcctgcataacggtttcgggattttttatatctgcacaacaggtaagagcattgagtcgataatcgtgaagagtcggcgagcctggttagccagtgctctttccgttgtgctgaattaagcgaataccggaagcagaaccggatcaccaaatgcgtacaggcgtcatcgccgcccagcaacagcacaacccaaactgagccgtagccactgtctgtcctgaattcattagtaatagttacgctgcggccttttacacatgaccttcgtgaaagcgggtggcaggaggtcgcgctaacaacctcctgccgttttgcccgtgcatatcggtcacgaacaaatctgattactaaacacagtagcctggatttgttctatcagtaatcgaccttattcctaattaaatagagcaaatccccttattgggggtaagacatgaagatgccagaaaaacatgacctgttggccgccattctcgcggcaaaggaacaaggcatcggggcaatccttgcgtttgcaatggcgtaccttcgcggcagatataatggcggtgcgtttacaaaaacagtaatcgacgcaacgatgtgcgccattatcgcctagttcattcgtgaccttctcgacttcgccggactaagtagcaatctcgcttatataacgagcgtgtttatcggctacatcggtactgactcgattggttcgcttatcaaacgcttcgctgctaaaaaagccggagtagaagatggtagaaatcaataatcaacgtaaggcgttcctcgatatgctggcgtggtcggagggaactgataacggacgtcagaaaaccagaaatcatggttatgacgtcattgtaggcggagagctatttactgattactccgatcaccctcgcaaacttgtcacgctaaacccaaaactcaaatcaacaggcgccggacgctaccagcttctttcccgttggtgggatgcctaccgcaagcagcttggcctgaaagacttctctccgaaaagtcaggacgctgtggcattgcagcagattaaggagcgtggcgctttacctatgattgatcgtggtgatatccgtcaggcaatcgaccgttgcagcaatatctgggcttcactgccgggcgctggttatggtcagttcgagcataaggctgacagcctgattgcaaaattcaaagaagcgggcggaacggtcagagagattgatgtatgagcagagtcaccgcgattatctccgctctggttatctgcatcatcgtctgcctgtcatgggctgttaatcattaccgtgataacgccattacctacaaagcccagcgcgacaaaaatgccagagaactgaagctggcgaacgcggcaattactgacatgcagatgcgtcagcgtgatgttgctgcgctcgatgcaaaatacacgaaggagttagctgatgctaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagttgcccatatcgatgggcaactcatgcaattattgtgagcaatacacacgcgcttccagcggagtataaatgcctaaagtaataaaaccgagcaatccatttacgaatgtttgctgggtttctgttttaacaacattttctgcgccgccacaaattttggctgcatcgacagttttcttctgcccaattccagaaacgaagaaatgatgggtgatggtttcctttggtgctactgctgccggtttgttttgaacagtaaacgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgtcaggtgcgatgaatcgtcattgtattcccggattaactatgtccacagccctgacggggaacttctctgcgggagtgtccgggaataattaaaacgatgcacacagggtttagcgcgtacacgtattgcattatgccaacgccccggtgctgacacggaagaaaccggacgttatgatttagcgtggaaagatttgtgtagtgttctgaatgctctcagtaaatagtaatgaattatcaaaggtatagtaatatcttttatgttcatggatatttgtaacccatcggaaaactcctgctttagcaagattttccctgtattgctgaaatgtgatttctcttgatttcaacctatcataggacgtttctataagatgcgtgtttcttgagaatttaacatttacaacctttttaagtccttttattaacacggtgttatcgttttctaacacgatgtgaatattatctgtggctagatagtaaatataatgtgagacgttgtgacgttttagttcagaataaaacaattcacagtctaaatcttttcgcacttgatcgaatatttctttaaaaatggcaacctgagccattggtaaaaccttccatgtgatacgagggcgcgtagtttgcattatcgtttttatcgtttcaatctggtctgacctccttgtgttttgttgatgatttatgtcaaatattaggaatgttttcacttaatagtattggttgcgtaacaaagtgcggtcctgctggcattctggagggaaatacaaccgacagatgtatgtaaggccaacgtgctcaaatcttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagagcaattgaggcagcgttggtgaagcacgataataatatgaaggattattccctggtggttgactgatcaccataactgctaatcattcaaactatttagtctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagtctccgacggcaggcttcaatgacccaggctgagaaattcccggaccctttttgctcaagagcgatgttaatttgttcaatcatttggttaggaaagcggatgttgcgggttgttgttctgcgggttctgttcttcgttgacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgt

SEQ ID NO: 2 - DNA, 38542 bp, Camplyobacter Phage CJLB-5
agtcgagttctacctcaaggatagcttgctttttgctccactatctaaacaattatatccgtcagttttgactggtactgagacaggcgataactggatacgcaaggacatggaagtcgatacagatagcgaagaagtgcttatctccacggccttgcgtaatctacgtaaatattgctatccagctatcacatacgaagcagatggatattttgatttagatatcggagacactgtcaaaatccaagacacaggctttagtcctatgttggtgctggaagctcgtgtcagtgagcaacaaatcagctttactaatccaagcgaaaacaagacggtctttgcaaactttcaagctcttcaaaacaaggtatcagatagcttgctaactcgcatggctaagctggcagagcaagcgataccgtatgagctgaaattatccacagaccaaggaacgacctttaaaaatagcacagggcaaagcttgctcatggctacactagaaaagaatggcaaggtgtacgagccaatcatcttctacaagaaaggcgactctatcatcggcagcggtagtcaaatgcttgtgcgtgcgacagactttgagggtactctgcaagtaacggttgaagcctatctaaatgacgagaaagtggcaacagcagaagtgacttttagcaacgtggctgacggtcaagccggtgcgaaaggtgacaaaggcgaccctggcgcacaaggtcctcccggccctaaaggcgataaaggagcgctcgacgaggagcaactcaaacaagtcaatgacaagattgacagcaaggccgacaacaagctaactgcagagcaactaaacgctttaacagaagccatgcaactagctaaggcggagttagaagccaaagcaagcattgacacagtcaacgaatggataaaatcctatcaagactatgtcaaagcagacgaagctggacgagctgcggcagaagctaaacttgtatctgcaagtcagagattaaccaagattgagaataatctgggcgacatggctgaaagatggagcttcttagacctctacatgagcgctagcaatgacggtttgaatatcggtaagaaagatggatcatcttctgtccgtatcgaccacgaccgcatcagcttttactctgcaggctctgaggtggcttatatctcgcaaggtgtcctcaagattgagaacggggtgttcactcgaacacttcaaattggacgctttagagaagaacagtataatctcaatccagatatgaatgtaatccgatatgtagggggaggtgcttaaacatggtcagatcaatttttaatggtgtatatggtcataacctgcaattagaagtcgtttcggatggatatagacaggacatagccggtaacttctccgtcatcaatgtgcaagttagactcatatctaatggatatgctgctatttatggcggagcgaataagacactgactgttaatgtcggaggagagtcaaagagcttttcggtagatgcagctatcagccaaaatcaaaataagttgatttttagcaatgattttagagttccgcacgaacaggacggcactaaatccgttaacgtttcggcaagactagacatcaatgtcggtggctatggttgggctatggccgatttgactaaacggctgccagacataccaagagcaagctctgggaatgatgtgacagccgttattggtcaaccagcgacaattaacattaatcgcaagaatgacgcttttaaacacgccgtatgggcaacctatggcagttttaataagcagataacgactgctaatgttgataccagcttttcttggacaccgccactagagctatgcgaacagacgccaaatagcgctagcggctttggtaatataaccattatcacttacgacggaagcagagagattgggcgtgatgtgaagcgtcttaatctctccatcccagatagtgtcaagccgactctgacaggtttcactctcacagacggcaatacaatagcgactaatatcgtttctggcggtgagcacttcatcaagattttgtctgacatcagagttaattttggtgcagcttctggggtttatggctctactatcacaggctattatgcggaaattgtcggcaaaaatcagtccacgacaaccaacggtggtggccttggtttgatgaactatgacggccaagttgttatcagagccagagtgacagatagccgagggcggacgagcaatgcgatagagcgtacagtgactatccttgactacttcccgccaatcctaaaatttgatgtatccagaaccggtctgaacggcggaacattgacgattacacggacagccaaagtcgctccgctaattgtcaatggatcgcaaaagaacaaaatgacgctgacattcaaggtcaagcccctttcggacaatagctacacatcagacacaggtcctgccgctggctcttggtcgagcatatcagaactcgttaacagtccagcgaacctatccggccagtatccggctgataagagttgggaggttgttggcagacttgaggataaagtgacaagcgcagaatttgtcgtagtcattacgacagagggcgcagtcatttcttacagtcgttttggtgttggcattaataaaatctgggagcgtggggcgcttgacgtcaaaggcgacatctatgcgaatgataaactcattcaaatgcaccagttgacgcagaagaacggtactgccatctatgcttatggtaaagattttgaccaagagcggacaacaggtgtctatttcaagaatggtacagaaaacaacaatccggctcgtcaatacggctggctgttggtacttaacagtaacaacgagtgcttccagatgttctttccgtccatagcaacagcagagccagctaagcgtgtcctgctagccggtaagtggagcgcatggtcaaccaatgcaaggagtgaccacgccaacctaaaacgcacagaatggacttctacaggtactacaggcgtgtactacaagcgccagggagatatcgtgtcgcttaggattgagataagagatgtcacagggaatgttagtcttggacgcataccaaacgaactgaccccaattcaaggtaacgccgccatgttaaatgtgccggttttcgagggtggatcaagtaacgacaggcatttacaaattaaccctgacggaggtatgactttgcttgcaagtaatgataaatacattgggacgcagataaactggtctatttaatcaaagaaaaggagatatatgtctaaattacaatttaatcgcaagagttggatttactcttcatccaacaacgaagtagagggtacccatgtcattctgacaaatgcagagggtgctttctatccagtattgcttcctaaagaagcgattgaccttccagtcgaagaactggaaaagcaagcccttgaagtcgtctatcaagagaatttcccagaccgtgctaagaaagaacaggacgaggaaatcaagaagaaattccaagaagccgacaagaaagagcaagaagctactctgcagcgtgcagaactgaaagaattactcgagcttgtcacttacatcgctcttggtatttctggtggtctggacatcaacagctacacagcactagcgcagaagattgatgcaccagtaaacggcaagcggtacacaggaccaacgtttgtcactatcgattatccgtacacaaccaatccgaagtggcagaaaggaaatcgaacaatcgtgaaatacacgggcgctactggttatacctacaccggccagtctgctgaagatatgcttaagtctggtgcatggactatcgtgctgccaaatatcagtaactaattagaaagggggtgattattatttgaaaccagagtaccagcttttaatgaccgtgggcggatttattatcacagtctacggtttttacaatgttctgcgtgcgaaaagcattgagcaagcaaccaaaatcaattcattggaattgcgcttgggctttttggagcagcagacgaaagaccatacacgtcgcttggacgaccacgacaagcagaaccaagctctcgtcgctatgacagagcaaatcaagaatttgacagaagatgtcaaagaactcaaaatcatgatcgaaaagaaaggaagttaaatcatgaacaaatttgcaaaaaaactcgctatcaaagtaatcaagactatggctcaagcagcgcttggtgtcattggctcatccgccctgctgacagaagtcaactgggtagtagttgcatcaacagtcgggcttgcaggtctgacatgtatcttgatgaacttgtctgaactaaaagaagactaataagggggtggtcttttgacgactcaaaaacaactacttgataagctggaaagtgtagtaaatcagcgcatggaagtgcctaccaatccttatggtgggcaatgtgttgctttgattgataacattttgcagtatcaagggctatacaagcttaattttagctatgtaaacgcaatagattgcttagaccaggcagcaagtctcggtctaaaagtaacacgctttaacggctcaaataggccgcctatcggttctgtatgggtatcaaattgctggccatatcacgagttcggacatatcggctttgtggttggttacactgcggatggtggaattatcaccatcgagcagaacatcgacggcaatgccgacgctctatacaacggcggatggacacgcaaggttattcgcaatctatcaagcgacggcacatttagctatgttaattggcaagcgccagcgcagcaaatggttggctggtttgagctgccatttgatgcaccaaaagcagatattgtaatcaaaaacttggaggatttaaaactaatgaaagaatttattgtaactagcaaaaaatatggatacggagtttttgtaggcgggaaatacgttggattgtccgacatcaagtcagtaaacagcatgaaagatagattaggtttcgctatcgttgagctgggagatgatgacttccttcgcttttcaaaagctcacggataagaacagaaaggagcttgctcctttataagacacttttaaataatacaccgcctcggcctattggtcggggcttttttgtttgcttcaaggggcaaaaagggggcataagtttaaaacttttgtatttttatgacaaaaaatatagatagttttatctctttatacgcttatttaatgcgttttaacgctattctatctttttagatgaacagcgagacacacccgtacagtacgttaataagaatttaaaaaccttgctatatcaatgtttcggcgttgttggcaaggtttttatttgttataaggggcaagcaaggggcaaaaaatctattttcgactattggcaatattgtctaaaatattctctatattggatttcatgctctttgttacatgggtatagatttgcatcgtagtattcgagtctttatgcccgactcttgccatgatagcttttactggtacatttctttcggcaagcatgctgattagtgtatgcctaaagatgtgggagctgaggggcttattaatcggcttatccaatctctgattagctttctgcagggtaatgttaaaagcgtttctttgtatcggcttcccatggttattgaggaagatataatctgtatcagagagttcagggttcgtactagtggctagttcatttagctcgataaactcatcgatgatctcaatttcacggttggtaagattagtcgtgcggtagcttgatatagttttcgtcagttctttcttggcgtttctgtcaatactgtctagtgtgccgtgtatatcaagctctctgctttctttgcggtaattgtgtctttcgatagctacagcttcaccgatgcggcagccattcaaagacataaattcagccaatagccccgctctgtatgttctagtgtttttatataattctttcaagagtgagtttagttcttctggctctaggtatttctcagtgactgattgcatattttccagcgtcaatacacgtttaggaagagtagtagccctggcaggattgtcagttatgatccttagctcttgagcataatcaaacactccgtttaagacaactttgatatggtttagttgagaagctgtgtagttggaattagcaatatatctcttaatataagcgacatcgatattgcggattggaacattaggagcaaagttattagatagtcttttgtatgctggtgtacgagcacggacactagaccgcctgacttccttttggtaaaatgtccaccattcttccaggacatcggcaaacagcctgtctgatgtcgtgagcttctggagaacattctcaatcttttcatctaaaatcttctgagcttcttttttagctcggctagagctgctatctagtgtgactgaaactctgcgccatttttcagtatatggatctttgtatctttcgaaaaatttatatttcccgttttctaatttctctatccacattgttttttctcctcatttttggtaaaatgagtacaagaaaacgaccttttgaatggttgtttcttatacaggatttccctacattcaagcttgccggccgagaatgtggggattttttttatttctctaataaaatttctatcttctgtttcaaatcttccagctcaatcatttcactattggctgtgcttatgtaatagtctatatcttgtttggcttctctttttccatcaggatggccatattggtttaagtaatcaatcatccgcttataaaaagcgatactatctcgcagataattttctttcatcctgtagtaatctatctcagatctagtcttgtcccaagtcgggaagtcaatatctaagttagtaggaaagcctttaaaagagtgaatttcccacagcgtggcatatttatcataaaattcttgcccggctgctgtaagttttgttttttcacccaaatcttctagatatccctcggccttgagctttctggttaccttttcagcattaagattatactggctaaagaagtatttggggattgctgtagacgacttacgcccttgcttagtcttcccccaccaaacgagcagcaaccactctctaagcttgtgaccgtcgcctgtcttaaaactgtcattgtaagctggcaaatcaaaactgcggccgtaataatctaccagactaggacgagtaatcaaaatatcgtaatagtcttcagagaagctagatttatctctcacaaccaaatcaacccttgcattatttttctttccaaatagagcgctaaaaatccccataatttgaacctcctaaagacctccggcaaactttagatactcgccttgtatcatgagttcgtccgtggtcgtttttaaattatattttttagcaaaattagaccagttaaatgctgctgggtcatcatagctggccagctcttcctggaccagatggcggatcatgaaacgattagcttcattctcgcagcgcatagcagagtgacgatatatagagccgatatgctctaagtgccctaattcgtgtagcagtactctgtgacgctctgcaggcgataaggagctgtttaagaaaatagtccttgtctctgcgtcatagaaaccacgcccagcccattggtctggctcgaaagtataaagtgatacctcatactgctccaacagttctttttctttatccataatctccctcacctaaacttatttcttgctattgaggtagccctctatgatacccttaatagctcgcttgtcgtcattggacaatggcttgccatcaaacagcataatgcgaccgtccaagtcgtcaagttctatttcatgctctggagctttttctcctgcgatagctgggttatctgtccgacctagtaagtagtcggtagatactccgaaataatctgccacttgatttaatttttttggtttcggttcactacttttccaagaatacaaggaatttctgctaaaaccgattttttcttcaagagcatttatagataaccctctcttttgggctagctctttaattatttcaaacgtcggaaacattgtcacatcagcctttctaagacatgacaaaaaatattttaaaaagttctataaaaatgcttgacattttttaaagagttttgtaaaatagtttttgtaagttaaagatttagtaaaaaaccttgtaaaaacttatctaaaaataaaatagctttggcgagcgcattgaattgatagatataacgttttatcaagccttttaatcatgcctacattttaaaactttctttaaaatttgtcaagcatttttataaaataatttactatttctttaactttctaattaagaaaggagtttcgctaatgaaaccaagacgctatccgtatacagggagattgaaaaaaccagccagacttatgataaaagagtggcaacaacattacgacaattatttgcaaacggtcggacgatacaaaaaaaccggctcaaacatcaaacctgaagaaattccaggttatcaagagccagtttttaaattcgatcgcaaaagattaaatgctatcgaattcaaaagtgacggattaaccattaatcgaatctaacgattgttcggtctggcagcttatcaagaataggctgacgattagaccagatggttctttcgcttgacataacaagcaaaactaatccgttttcaaaagtccggaccatgtactctatctcattagagtttgctccgaaaagaaaagtatcagaagtttttgagccgtacttaatatcaaaaacttcttcgtcaggaatgacgattttatattttgcaattttttcattcatcataatcacctcccttcgagatgattatagcacaaaaaagcacctctgggtgaggcgcttacaaaaaaattctgactaaattatatcacaaatgaaaggaaaagtaaatgcaagagatagcattatctgacaatttagcgcagattgagctagaaatcaatcaccacaagcaacttgccggtcagtcaatttgggaaatcggcagacggcttaatcatgttaaggagcatgacttggctcatggcgagtttagagactggcacgaaagacttggccttgacaaagactttgcttataagtcaatgaaaatcgctaaagaattgccaaatgtcgaaacgttacgacatttaggaacaacagcattgcatcttatcgcaaccttgccagatgaaaacaagcaagagcagattgaacggattgagcaaggcgacaatccaacagtcagagagctgcaagaagtaaagcgccaactcaacctcgcacgaagcgcaaacgacagcttgcgagagcaaaacgagcgcttagcagaacaagccttgaaaggtcttgaaaccaagacgattgaaaaggaagtcgtcaaagaaatcgaagtcgcaccagcagactacgacgctacaaagtcgctaaatgccacgctgctagaaaagaatagcaaactaaagcgtgaatacgatgacttaaacgaccgagcagcgtttatcgagcagcaatataacaagcttgtagaagaacgcaaggcagttgacgaaaagtctgctaagtatgacgagctgacagaagcaatcaagcagtcacaagggcagctaaacgaagcacaagcgaaaatcggcagctacaagagcctgctatcgtttatccgcaagggtaacgaaatggtcgtgaacatgggcggtctggtctatgtggacgaacaacggatattacattctgacagcaaagtcagaaacgaatttgaacagttgcaaaaagcaatcagcagacttgccgaggatatgggaagtatgctcaaggaaacagaagtattagaaggagaaattatatgacaaacgaaatcattggaaaaagcgcaagcagcgaacaatcactatcagaaatcagcgtaatgcggaaaatgctagatagcattgaaaatcacgagcaccgtatcactaatctcgaggacaccatgcgagttaacgcagtacaagaaaacatgctgacagaagaagtcaacaagaagattgtcggtttcttgcaaggaaagaaagcccctgcttatcgtgataatcatatccggggcaaggcatactcggacatcaatcatgcaatccgtaaacattttggagttcgccgacgtgaaattcctgctaagaacttccacgatgctgtatcgttcattcgtcgctggtctatcagtccagagctgaaagatgaaattttcaatgcaaatcagcaagtgtcactattcaattaaggagaaaacatgagtcaacaacacaaaaaatggattgagttggttaagcgtcgacttggtgaaaaaggttggagtcagtcggacctggcgacagttatcggagtaaagccggctacaataaaccgcctaatcaaagaagggcatggaagcgatagtctgaagcttgagatcactaaaaagctatctatatctgatagttggaccgtctttgaagaaaggtaggggagaagatgccgcaggtaaagataaaagaaatcatctacacaccagtcagcgggatggaagaaccgacaggcggagattatgatcatctaatgcaaaggtggcaagggctaacacttccgacggcaaaacaatttgtcaaagaaatgcgagaaaatccagaatttgagcaatatgtcttcaacccaacgcacaagctgatgtttgtagactatgagggttttcgcaagttctggaagtggaagcaactcaaccgctaccgtgctaaaaaaataagccttgccgagatagagtcggacaaggcactagcgaagcgattaggcttctaaaaagtatttgcttaattatatcacacaacgaggagaaaaaacaatggaaccaacattaggaagtcaacttttaggcgtaacattaatagccgctatcgcatttgtagcaggctggtacggcaatagaatggacgctcgtaagcgtgcaaaaaaagagcgtctggagcgcatgcaagccgaactgatggaacagtatcacgaagacttggagctgtaccacatggaacaacgacaagcggaaattgctgctttggcaatggctagaaaaggtatcacgccagcgtttgaatattaggaggggaaaataatgaaaaaaggaattaaattatcagtggtaggactaacagctgtagcaggcttgctaatcagcacaaatgtattggcaagtgaagttgctaaggacggaaaccaaattcagatcacagagcctgaaatcacatacagctcagaagcggctgaaacctatgtaaacaaagacctgacatatcacacggaaatccctgacgaggtagaaattaacgaaggtgatacactcacctacactctacctgagcagttgcagtggactactacacaggaatttgatgtgactagccctgagggagaggtagttggacgagcagtagcctctaatgacacacaagcggttactaccacctttaacagctactttgcagagcacccgcttaacaagagctttgacatgacgctcaagaccatgtggaagaaagaggtagtcacagagcgtgaaaagtatgacctcaatttcaacggcactattgttaagcaggcagaagttaagcctcagacacctgcaaactcacaggaaattgtggctaaatggggctggcaagacaaagatgacccttcccttgtgcaatggggaggacgagtgaactttgtgaaacaccacctcacagatgtaaatgtctcagatacatgggacgacaataacgagtacgtagagggctctatgcgtatctttgagctctcatcagcagagccttgggtcggtattcgtgaaatccctctctcagaggttggtgttcaattctacaagaatggttttaagttcagcttgcctgatgttaagaatattatcagtgtggagtacaaaacacgcttaaagaacaagctacaaaaccctgtgaatgtgctgagctttacagctatgggtcaagaatactcatttgaacgggaaatcacagtggctaacgctacaggaacagctaaaggcaaggtacgcccattcacttacgatgtaccaccagctcctgtgtatgatattccggagtttgagggaggtgtagtccctaatgacccaccagtattggataaaccagagcttaatatcaatgatattgagcaaacgccaccagcaccagtatttgagcttcctgagtggcaaggaggaactacaccgcttgaccctcctacagtagacaaacctgagtggaacggagggggagtgccaaacgatccgcctgtgttagacttgccagagttagtaattccatacgagcctaaaaagccagaattaccgcctaaaacgctcgaaaaagagccgcctgctccaagtgccaaggaagaaccgaaaaatgcagtagagagcaaattagagacctctgcgaacgggctgccgaagacgggagaagtcagtaatgtctttctgtcaatcttcggtatttcactactgattagcggagcgatgatttggcacgataacaagaaaaagtaaggaggagattgaaatagcaaatccaaaaaataggcgcttctattggttgcagctgtccgaggagtttttcaaatcgaaagaaatgaagctcctccgacggcttccaggaggcgaagagcacacgatcatctatctcaaactcatgctagcaagtctgcaagacaacggaaatatctattttgagggattggctgacagtctggcagaagaaatggctcttattatcgatgaagatgctgaagcggtcagaatgacactgatgttcctggagcaaaaaaagctattaacgacatcagacaattttgcttataagctggaacaagtaccagagatgataggcagcgaaaccgcaagcgcccgtagggttcgcaagcaccgagtcaaacaaaaagtgttacaatgcaacaccggtgtaacaaagtgtaacggagagatagatatagagttagataaagagatagaaatagataaagatataaatatagagtcagaagtagagatagagaaagaaaatgaaaacgaaactctaactgctgctgaaattgctcaatactatcaatccagaataggagtccttgacggcgtacagtatcagaaattgattgagtaccatacttttgaccacttggaacttgagcttatcaagcgagccattgacaaatcggctgataatgcggttagaaactttggatatgtcaattgcatcctgaaaaactgggcgcagaacggcatcaaaacgattgcccagcaggatgaagaccagaggcgatatctggaaaagaaaggcatctataagccggactctaatatccctgaatggtcgaaagaacatcccaattaccaagcgcctgaagagccaacgatactatcaagagaggagttcttagcacaagatgactaaaattaactacgatcaagtcgcagggaatgaatctctgtataagcagtataagaacacttttgctaaatggttcaacatgcagctatccagaaagcaatatgtggaatttgtggacgtgtgtcgagaacatgcgaacatgcacctcaatccgtttagcatgtgcgcctacattctcaaaaggccagtaggagaaattgtgactagattttttcaaaaaggagataaaacatgacaataccagaacttgaaacagctctactgtatcatgtaacgccaaatgagcgcaaacgcctgaagtggtacaagaaacatgacgtagtgaagtttgttaaggagttaggaaaactttggcgaaaatacaagggagaagaaaatggataaattacacaaacgaattttacaagccattcctgtaggaagtgatcggccgagaccacggcgggaaattgaacaaatgctcggcctgagcaagcgatctgtagaaaaggctattgaacgactgatatatcgagatggtattcctatcgtggcaatcaaacaagccgggcacaatggctattatctaccaaggaatgaagaagagcgccaggaaggtctgcaggcttacaaaggtcaaataaggacctcgcaacgccgagtatcaaaagttgagtcagttgacttggtgaagttccaccaggcactaaaggagggggtctatgctcgaaccgtttgattatgaccgctggttgacgacaccacctgaagaaaaaacggagcgtccggatcccgacaattggatttatagagctggacggtgggtgtatgtgggggacgaagtatgacagcatacctactgaaagaaattgatcgctggcgctctgagtatattcacctcggccatgaactgggcgaagttatcaacgagcagcaagatagaatcttggcactgagccaagaaaacaagcgtcttaggcgtgaaaattggaatttgaaacagacaaaaaggagaaaatagaatgactaatgaaatatcgacacaaaaagcaaagcgagatatatcaatcaatacaatggactggacagcccaagacatcaaacagtattttgacccagacaaccttttgacaccgaaacaagttgggatggcgttgtcgctcattaaagggcgagatttaaatccgttagccaacgaggtttacattgtcgcctaccgtaaaaagaacggcggaacagagtttagcttgattgtatcaaaagaagctttcctaaaacgagcaaatcgcaatccgcagcttgaaggctttgaagctggaattgttgtaattaacgaaagcggtttgcaagtggaaagaaaaggtgcactcgttctacctaatgacgaacttgtcggtggatgggctagagtttatcgaaaagattttcgtgtgccggttgaagtctatgtcagcatgaaagagtacaacaaaagtcagagcacttggaactcaatgccggctactatgatacggaaaacagctctagtaaatgcacttcgtgaagcattcccagaagaccttggcaatatgtataccgaagatgacggcggggagacttttgaccgtattaaagatgtcacaccgcaagaaagccgtgaagaagtgctagctcgcaaacagcagcaaatcgaacagatgaaacaggaagcagcggagcgagaagcaaagcagcaagcagaagctacaccatcagttgatcctgaaactggcgaagtgctaggccaagaaatggatctgttggagggagaggagttttagatgaccgcaaaaacaaaagatgtgacagatagcttggagctggttccggtgactgacttaaattttgactttaaactgacgccggccaaaattgaaattgaaggtaaggaagttctggaacaggccctgacagcctaccagaagaaatatgcaggctatgtcgtaactgaagataccattgtcggcgacacggctgtcaagaatgaactaggacgagtagagcgccagctcacagcagcagtcaaggaaaaactagacgaatacagcaagccgcttgacgaggttaaggcatgggtcaaagacattcttgacccggtaaaggcgctaaaggaagatattgcagagcaaatcaagacctttgaagctaaagagaccgaaaatcgcaaacagacggtcaaggacgcttttgagactgcaattgtagagaacggcacagatctagatataaacctctttgctatccactttgacgatctggccaagaaaaaatgctttatggcagacaacgtgcgcattaatcaagcgacgcttaagattatcagcgacctggtagcagaagaagcggccaaaaagcagcaacgtgagaccggtcttatacaaatctcagaagcggccggaaaggctggctttggtccggcggtttatatccgacggtacgagcaaggcgcagcgttaggagatgttctgcaggccatccttgacgacaaggaactggctgaccaagctaaggaaaaggcagaactagcaaagcgcattgaggaaataacgtctattgcagaagctaagaacctagctccccagaaatacgttgacatgctcaaggctggcaagtctgccctggatgtcatcaacatcctgcatgctgacgcatcagaaatgagacaggcgcaagctgaaactgagcgaaatacgcaatcagaggcggatgatttactctacaatcaattttacggcgcatcagaagctcctgacggagtttttaaccaatccgagggtaattatacccaagaacaaaaaaaagggcttaaaacgcaaaataaagcatctgacggcgtcggtaaaaaatatggttttaaattcacggttgatttgattttcccagcggagaacgcaaaggaaaccaaggagcaatttaaagaatggctcaatgctcacggagtgcagtttgaacctaaatcaaaatcagtaaaggtggaaatgtgaaatgattgaatttatcaaagaagcaggaatggctctgctatgggtgtttctaggataccttgtcggagaacgtaacagcaaaaaataataaaacaagccgggcatccttgtaaaactgcgaactagaaagcgtcaatcggttatgtgaccaatggacgagcgactgcccgtatttagccaaacttacacaaaggcagtcgcattttttgaaatgatatgactgaaatcaaagaaaaagccctagcgaagatgctagaggagttaaacaaaccgcatgatatcgcaatggaccgcattcataactggatatgcgaccaagaagacgaggatttgctccaggggatcttgaaagatgggtactctctgaaatgcgctctaaaatatgcaaaagaaaaagcccgtaaattcgctgaaaacggagtggcttgcattgatgataatactgttttcggatggattcgagaatattttgtctcaaattcgcaagtatccaatatcaagcaggtgcctgttgagggcatcaaaaagaataagtcaaacaagccaaaaaatcctcaagaagagaaggtcgacgtggccaaaatcaggaaaggtgctgggccagatgatgatattatcaaaaaacctaaaatcaagaaagagaaaggagtagtcgaaggtcagttggaccttttcgcagatttggcatgagcgagatcaacgaacaatgcaagcgagaagctgacagacgattgaaaccacctgcagacttctggagctggtgctactcgcaaatcacaacatacaagtggagcaataaagacaagaccataatcgcttcagatttggaccttggttattgtgtcgaaaagcgactcacaaagtcgtctcggcttactttttacgacaagacctactttttctcaatcattctcagtacatcgaagcgcatcgagatccaatcttatgaatttcggtcaaaattagtcgacggaaagcagttcattgattggcattttacaaatttagagcgatttgaaaatgataagcatgtgaaaatcggccaagattacactggccaatattatccgtatctatttgccaattattttggaggcggatattatacaggcaataaattctatccgaacaactggattggaaagctgaaaaaagtatccgaacttaaatatttgaaatttggtgagattgcttactgggaaatcgaacgtctctacaaatacaaatttgaaattgaatttgctcagaaaattcatgcttacaaattagctaatgaaatcatgggttatgtgtacaactggtcaccatctactggttatacaaaaggcgtggatatgcgaaccttaaaccgcagatggctccagaaaaataaacaatttttcaaaaattcaaatcgcagtttcactgagttcgagcttagccgccggattaaggagcgaaacggcaaacttgtgccaggcattgagtcttatctgacttaccatgatatcaagcatataccgaaaggtgtcgggatcaataaattccaaaattgggtcattaagcaaaaacttgattttaaagagtatatggactacttaaaaatgctggacacaatgggagttgagcctgagggtgatgctatgcttgtccctaaagactttaatgctatgcaccaacacacagtagagctttataaccaattcttagaggacgagcgcaagcgtaagaaagccgaagaagacaagaagctggagactgagtttaaacggcgtaagaaactggacaaggtcgtcagcgggtacagcttccatgtgccggacaaggtcgcagagcttatctacgaaggcaagaaacttcaccactgcgtcagctcatataccgataagcactttaaaggccagacgacaatcgtttttgtcagggctgagaacgcaccagaatgcccgctatacactctagaagtaaaagcgggtcatatagtccagttcagaggaaaatataaccacagcgtccctgaagatgtctgggatatagccagagattggatgcagcaagttaaattaattaaaaccactacagcagcataaggagaaaatatgcacaagataaaagttacagaaaacatcgaagcgctgattgagcgccaaaatcgtacaatcgaagttactacaagcctgccttgggatattgaagtggaatttgcacatcaagaccaagacgttagccttgacgagagcggtgacatctttgagccggtctttgaactggcattatatgctaaacctaagcaaaaattgactctgacgtcatcaggtcaagcaaacacgcacaaaaaagaagtcgcagaaatcatgaagttttttgacttcgtaaatgacaacaagaaaaacctgtttgaaatgacaggtgtgatgggagttgtggaatgagtctaatactatccattgacgcaagcacgagcgctacaggttgggccgtttttgacggctcacagcttgtagaaagcggggtgatcaaggccaagggcagctttttagagcgagccctagtgatggcctcagagttgcgaaaagtccagctgcggacaattaaagagcaagggaaaccctttgagtccattgccattgaaaagaataatgtcggaggtgtcaatcagcaatcagtcattaagattggtattgcaacaggaatcattctagggaaactgatagctgatgatgtttactttgtcaatgtctcaacctggcgcaagtacagcgctatcaaaggcagaggaaagaaagagctgaaacagcaggccatcagcttagttagccaactctatcagaaacaagtcaaggacgacgaagcagacgcaatcatgattggtcgctacttcgttgaaatgattgattttaaggacggattagaaagtcatagattgagcaggtgacagtatgacgaagtcagatttagaggcttacaaaataagccttgagcgctgcagaaatcgactagcagacaaacaggcggaaaaagaggtcatatcctcttttggccatggagcagcaaccagacgcagggaacggatgcgtgagaacatccgaaatttagaagagaaaatcaaggagttggaagatgactgagactaatgtccagaagttttacagaattctagctgaaaagaccgaagctttcggcacaaagaaagaaatgatggtacagttagggtttgagggtgcgaagttaaactctgaccgaactagacttaacagcgacgaaagagcaggacgctttccgccagttcggctgatgataaagctagacagcttgtttgatagagagttccttatcacttgcttgcgcgagaaaatggactgcaagacggttgataaacgctgggcggcggtcgcacaagattacatcgacgacaactcaaaaatcgggggggcgacgagtgacagcgaagcggagcgacagcgtaagctaagacgcagattgaaacgtgaaatgtacctagagaggtcttttggaatttaaagaggaggaaatatgcaacaatcaagaattgagagacttgagcacgaagtagccaggctgcagatattgacaacgttggccatggcagttctcatcgcaacactactagtctttatttatgcaactcaaggacaacttaatcaaattaaagaactaacaacaaggctggagcaagtggaaggagcaaacagatgataccaaaatttagggcttgggatggtggctcgttatgtcgcatgtatcaaccagacgaagtgatggtcgggaatggtgatatttggataatcgacgaagattcggtcgctggcgactggattgtgaataatgacattgaactcatgcaatcaacaggcctcaaagacaagaatggcaaggagatttttgagggggacatagttcaatatcaaaataccaaagtttcatctgctgacagtaaaggagttatcagatattttgataattgggccatgtttgggattgatatagaacacaacgaaccaagagcgctattcttcaacggcttggccgaccacatatcattagaggtcgtcggcaacatatacaaaaacccagaattgattgaatagaaaaaggccgacacactgcagcccttcggtatattttcgataaacctattataccacaaaagggaggcaaaaagtgagtaaggctaaagaattattaaacgagctacaaagtctagatttagatattcagagcaggatagacgaaatcaacgagcttgaagttggtttgctttcaagccctaagtttaagtctgacaaaatcaaaggaggtccaactcgaaaaattgatgatgtctactgccagcttatcgtgatgaaggaagccatagaacaggatacgagtgaaatcatcatgcgaaagattgaacttggacgactgatcaataagctgaaaaatcctaggcataggacggtattgaggatgacctacatcaataaaatgtacgttgatgacatctgtgacagtatgggcggtatgagctcgcctacttattatcgtttaaagaaacaagcgataaacgagttagatattattatttcagaattgatagagaatgatagcaatcgtacaggcatgaagtctgaaacctgctagaatggtagtatcaagatttgaagttaagacaccttaggcaacagcctagaaaagcttcgacaaaaactgccagcttgggttactggtggcgatagagtaggatgttttaatatcgcaaggcgaggcaataaatgccttgctttttttattccacaagaaagcgaggtagtccagtgagtgggtaatcttacggttaagcaagagaagttcgtccaaggtataatctccggactatctcagaggcaggcatatagagaggcttatccatcagcaaaaaagtggctagatagtagtgtggatagcaaggcagtagtcctcttgcaaaatgcaaaggttatgaaaaggtacagagagcttctaaaggagttctcgaatatgtccttgtggtccagggagcaggccttcaatgaatatgagtggttaaaaaacaaagctcgagcaagcattgaacaagacggaatcagacaagctaattccaatgcttttttatctgctttagacggcatgaatgaaatggcatggaaagatctggagttgacagacgagaagctgaggaaagaaatcgagctgcttaagattaagattgagagcggccaaggatctaagtctgatacaagtctcatgacggcccttttggaagccgtgaaaggcggtgactagctttggatataactttttctaagaagcagctagacatcatcaagcggccttttaattatgagctagaggttaatgaggggacacctcggagcggtaagactacggctggccactttcgatacgccaggtatctgattgagtctccggacgaaaatcaccttatagcagcctataaccaagagcaagcttaccgtctgtttattgatggtgatggcactggtctaatgcacatcttcgacggcgcttgtaaaatcaagcatgacgaacacggcgatcacttgctgattgatacgcctaacggacagaaacgggtttattacaaaggcggcgggaaggtaaatagtgttggtgctattactggtatgtcactaggctctgtggttttctgtgagattaacctcttacacatggatttcattcaggaagcacttagacgtacctgggcggccaaactacggtatcacttagcagacctcaatcctccagcgccacagcatccagtcatcaaggatgttttcgacgtgcagaatacacgctggacacattggactatggatgacaatcctattctttctgacgaacggaagcaatccatcattcaatcgctgaagaaaaacccttatctctataagcgggatgtactcggccagcgtgtcatgcctcagggtgtcatatacggcctgtttgacatcgagaagaatatcagcgatatattgaccggacagcctgtagagatgtatttctgtggcgacggtggccaatctgacgcaacatccatgagttgcaatatcgtaacaagacacagagaagatggcaagactttcttccgtctcaaccgtgttgctcattactaccatagcggagcggatacaggacaggttaaagcaatgtccacttatgcagttgagctcaaggtattcatccagtggtgtgttagcaagtaccagatgcgttatacagatgtctggattgacccagcgtgtagatcattgagagaggaattgcataaactgggaatacagaccagaggagccatgaacaacgctcatgatgtcagcagtaaagcgaaaggtattgaggtagggattgaacgtggtcaaaatattatctcatctggccagttcttacttatcaatcactctgaagaggagtatgatcattatcattttttgaaagagataggtctctacagccgagatgataacggcaggccgattgataaagacaaccacgcaatggacgaatttagatatagcgtgaacgtgttctatacacgatacgccaattttttagcaacaaggagccagtaaatgggcatcatacagactattagaaatctatttaagagaggacagtacgcaatgacgacagacagtctgacaagtattacagaccaccccaaaatcgctgtcactagcgcagaatatcaacgcattaacgataatctgaggtattttcaaagcaagtggcctaaggttgaatatctcaatacagatggaatcaggaagagtaggaaagccaatcatttaccgattgcacgaacagcggccaagaagattgcaagcctggtatttaacgagcaggcagaaatcaaactagatgacgatattgctaacgacttcgtccagaagacgctggcaaatgaccgctttaacaagaacttcgagaggtatcttgagagttgtttagctcttggaggtcttgctatgcggccttatgtggataacgaccgagtgcgggtgtcattcgtgcaagcgccagtattcttgccgctacaatccaatactcaggatgtatcaagcgccgctatcgtgaccaagacggtaaagtctgaagacaagagaaatgtgtattacacattgattgagtttcatgaatgggcaaaggatggaaagtatattgtcacgaacgaactttacaagtcaaaggatgttgataagattggcgatcgtgtggctttggctgaactttacgaggaccttgaggagacggtagagcttgacggactatcccgtcctctcttcacctacctcaaacccccagggatgaataacaaggacatcaattcgcccctcggtttgtctatctttgacaatgccaaaagcaccatcgactttatcaataccacttacgatgaatttaagtgggaagtcaagatggggcaacgcagggtagcagtacctgaaaatctaactgagacaaggatggtttcaagagatggtgatgttagtacagtccaaagatttgacagtgaacagaatgtctatctaaggctttcgacaagcgatatggacggaggtcagctcacagatctaacaactcctatcagagccgaagactatatcaagactattaacgagggtctgagtctctttgagatgcttctaggagtatctgcagggatgtttacctttgacggccagagcttgaagacggccacagaagtagtctcagagaactcggatacttatcaaatgcgtaacagtattgtgagcctggtagagcaatcaataaaagagctaatcatctcaatatgtgaaataggcaagctttatgatctctatcaaggagaagttccggagatggccaatatcacagtcaatcttgatgacggcgtctttacggacaaaaacaatgagctggaatactacactaaggcgctggcaagcggacttgtaagccgtgaatatgctatccaaaaagcgctgggagtatctgaagagggagccaagaagatgattatagctatccaaaacgaagctcaggtggccgctaatcaagccagaactcaagaagatattgatatttacggagaataagcaacatggccaaaagcaggaagaagccaatcaaactgaatgatgaacagctcttgctagaggctagccaagcagcggacatctatcaccagctaaccttagacctctttgaccaggtcattgatcgattaaaagagagggggacggtcagtcttgaagataacccctatatttggcagcttgagaaaatgtcagagatgggcttgctcaacgatgacaatgtcaagcttattgctgagcggtcagggatagctgagcaacagcttaggcatgtcatagagggcgagggatacagggtctaccaagacaccaagcagcagctcttagatacgctgggaaagtcagggagtgttgtaaatagtgaactccaagaccgtcttgcttcgtatgtcggccagaccatgagcgacatcagcaacctgacaaactcaaccctgccggccagtgtccgaagtgtctatcaatccatagttgaggagtccgcggcggctgttataacaggtttaaagaccgctgacaaggccatatcagacactgtcatgaaatgggctgacaagggcttttatggttttacagatagctcagggaaacgctggaaagcagatacttatgccaggaacctgattaaatccaccgcctggaggacatacaacgaggctagaacagcacctgctgaagagctcgggatagatactttttactattcacaaaagccagcggcccgagaaatgtgtgctcctctacagcacaggatagttaccactggaaaagctcggacggagcatggtgagaaaattttggctctggacgactacggttacggaagccccggaggatgccgaggcgtcaactgtagccatgtcatgacaccttttgtggttggagccaactacaagcctgaacttggtccggacgtaaaagatatcacgccggagcaggcgatagaaaacgccaatgcagaagcaaagcagagagccctagagcgttctatccggaacaacaaggaaaagctgcacgtcgccgaaaagttgggtgaccaggagcttataaatcgctacaaaaacaaagtacaaatccagcagggagctatgaggcaatatctgaaagataaaccattcttacatcgggattacagtcgggagaaatactatagcgacccctacacgcaggccaagaaagaggttaaacttagggaaaatctggccaagcttgaaaagcgcagatcagagcaaaaagaaatgcagaaaaagttcaattttgctgttgaaagtggtataattaagacagaaattaacaacgagcattttgaacggcatgtcaaagggactagagggtatgaagattatctaaattctaacctggccaaaggaaagaacatgccaagttatctgacaatcacaaaagaagaatgccagaaattagtggatcgctatgctggaactggacaatttaagtacaatccaaaaacagataaaatgcaggaaatcatctcacaaaacaaacctatcggaacttatatagaccctaaaactgggcaagttatcgaagatgttactgatttccgcattcattacagtaaaaccggtgcgcacatcgtgccaactatcaaagggaaaaggaaacgaagatgagtaagaagttatggaattatctacgctcaaaagttcgagtagttgatattaacggcaatatcattagcggacttgttacggattttgtcgatgaaatggataacgacgagcaagatgaaatcactatcctcattgacggatcaaattctgacagtcccactgaggtttctctatatgagagagatatctcatcaattcaagtaataactggcgcttagttaaaactaggcgcttttcttatatttaaaaatcaagactggctttgccggtcttttttcttgccctggagcatggcgtaaaactgtctgaattcgtccatgtgacgtaaaaaaggaggagttttagacatgagtttaaaacgagaaatgttagtcgaagccggtatcgaggacaaagagcagcttgataaaatcatggcagcgtacgggtcagggattgagtcagcgaagtccggattgcaggcagagattgacagttacaaacagcaacttgagcaacgcgaccaagctatcaaggacttacaggacaaagagggagcgagtgaggaagctaagaagcaactagcagacctacaggctcaatttgaaacctacaagacggacagcgaggctaatcttgcacagttgcaaaagaccaatgctgtagcccttgctttgaaagatgtaggagcttacaactctgaggacctcatgaagtttatcgacctagacaagatcgaactaggcgaggacggaaaaccagtcctagaagaaactatcaacggtcttaaagagtctagcccttacttgttccaacaaggacaagagcaagcaaagccgcaaccgcgcttttcagctggtggaaatccaccggctggaacaaaccaagaagacgcctttttgaaggctctaggattaaatgactaataggagaatgatcaatgacaattaactacatcactaaacatgagggcacctttgaaaagaaattgatgcaaggcgcccttacaaacattttggaaactcaacaagtaaattggctaggagccaagtcgttcgagttgccaaccatttcagttacaggctataaggcgcacactcgttctaaaggatacaacgctggtacagtatcaaacgacaaaaacgtttatacgcttggtttcgatcgtgacgttgagttcttcgtagatgctgcagacgtcgacgaaacaaaccaagagctttctgctgctaacgtatctaacacattcatcacagaacatgcaactccagaagttgatgcttaccgtttctctaagatggctacagaagctatcacaaatagccacttcaagtctgaggatgacctatcagaggtgaacatctacactaaattgaaagctgccctcttgccggttcgtaaatacggcgcacaaaacatcgttatgtatgtttctagcgaagttatggactttttggaacgctctaaagagttcacacgctcaatcgctactacatcgcctcaaggaattgatactcgtgtcacttcacttgacggagttcaacttatcgaagtttgggacgatgcacgcttcaagactaagtttgacttcactgaaggctttgttaaggcttcagatggtaaaaacattaacttcttgattgttgctaagccagcagtaattgccaaggctaagtttaactcaatctatcttttcgcccctggtcaacatacagaaggcgacggatatttgtaccaaaaccgcctctatcatgaccttttcgtcttaaaagccaagaaagacggggtctatgtatctcacaaatctgcttaataagggggtagaacatgcgtaagtacgaaaaagggaatcaagtatacaccgtgcaagaaggtagcttgcttgaaactcagctaatcgccgatggatttgaagaagtgattgaagatggccaaatctcagagattttggctactcattcactttcggacatgactttggcagagctgaaagctcttgcgaaagaaagaggggttgaaggttattcgaccaaatcgaaagacgagcttttggaggtactaaatggccaagtttaaagcaaaattgaacgtctatcttgctaagtctgaccgccactttgacaaagggcaagaatacgagctggatcaagacgaagccaatagaatcaatagtctgtttaatgaggttgttggtggtgattgccttgaacttgttgaagggcctgagaaagagttagttgaggtggagacatccactttttaaggaggtgttaaatggcctatttgaccaaacaagagtataaagacttaggttttggtgaggcgaaagactttgaaagtttgctcaagcgtgctgaaatggctatagacctctacactcgggatttttactcttacaatgactttgagcgtgattttgagccaaggcggcgggatgtaaagcgagctgtggcctttcaggttgcttatctggatagcacgggcatcatgacggccgaggacaagcaggcagtggccagcatgtcagtaggtcgaacatctgtaagctatcaaaatggctctcagagctcctctcaggggctttctttggctgctcgctataatctatctcgggatgcagaaaactggttgaaatcggccggatttggatttgtgagggtagaatatgatagataagagaatgcttactgactctgttaaaatccagaaaccgacaggaaaggatgactggggcaaagaaacctattcagaacccttgttactatccccttgcaagtttgaccgagtcttatcacacacaggagccggaagcaacagaagcgagacgaaaccatcaacggtgattgtttaccctcaattctgtccggtcgaattggacaagtcttacttaggcggtgtcgtcgacgatgacggtaccctctatcttgtccgcagtatcattccgcagtatcatccgctaaccagaaagcttctagcatatgaaatcgaggtgatttgatgtctggaggtgtcaaggtgtcttttaatctcaatgggattgagagaaaggtttctcctcaggctctggctaaaggaaagctagccatagctaaccagatgctcttggatatggatcaatttgttcctcgtaaaggaggagacttgagagggagcggaagcgtccaaagagaccgaatcacttactcaaagccatacgccagagctcaatactatggcagttcttacaacaaaaacagaagctttaaatttaggaggtattcaactccaggaactggcccaaggtgggacaagaaggcatcagctatccatgcgaaagactggtccaaggtcggccttagagccatgggagtacgaacatgatcaataacaacgacttttcgacggttctgctaaatcatatcaagaaactgaatctggctataccagctagacttgactacttgggagaacatgaggacttggttatctatccgctgccaggtggcaaggtagaggcagaagatatggcaggcacgcagacagtgagcctgccttttgaaattgctatcaagtcgcaggatcagtcactaaccaacgccacattgtggcttattaatacttctctatcgcagcttgatttggacttacctagtctgaatcagtcatacgaatttttaggtcttgaagtagctaagccgtttttgaatgacttagacgaacaaggcttctacatttatcagctggatatcacagccagcctcgaaatagaaaggaaataacaaaaacatggcaaaacgcaaaaacgccctacggaaacactacatcgctccgtttgacccggcaacacaagatacggagccagctaaagaaaaatacaaatggcttgcaaaggacatcacctcgtcatctccggaagttgatgaacagacagacgactctgcagacttcgcaggtgatggaacgcctgtagaaacaatcacatcagtcaaacgcggacgctcttttgaaggcaagcgtaatgacactgatgaagctcagaatatgattgcagatatgcaggacgaagtaggtgatggccgcaaagtatggtacaaggaagtggatgctgatggcaaaaaccagcgggtaggagtagccactgtctctggaatcgaaattggggacggcgaagcaaccgaacatgaaggttttaaagccaaaatcatgtgggatcagaaaccgaaaaaatctgctgtagtacctggttaaatttgaatgagggcgtacaatatgcgccctcttattttgtgtaaaggagaaaaaatcaaatggtagtaatcaatttacggaacaaagtaatcccgatcgactttggagagtttcaatttgaattttcaaagagtgacgaaaacatcgagaagatgcagtcattcgctcaagatctgcagttagaggctcagaaaattgtggacgaggacggcaaaggagatgtaaccaaagcaagagaaattcttaaacttgcctacaatggtatctttggcgatggttcttttgacaaggtctataatctctctggacagtccactgtcgactgcattaattatttcattgagattatgcagggtgttgaacaggagcaaatctcgaaagaaagtcaagaattgcttgatcgctatcttggtaagtagccatgtttgatttgtcaaggagatttagagatgagctagtccttgatgatacgagctatccgcttgacctgtcttttgacaatgttttgaggctcttcgatatgatacacgatgactacatccctgttatagccaagcctatctttgctctcaaaatattgctgaagactagcactgatagcgagaagcaggcggctgatggtcttttggaacgcttagatattgaaacggccttagaaatctataaacggatttccgaggaacacgtcgtcatcaaaagttccagaggcgaggttaaagagtatgacttggccggcaatcttattgaacgtataccaatagatgatgacgaggaagaagatgaaaaagaaccgcttttttctttgaaatatgacggtgtttacatctattcctcgtttctgcaggcgtacaatatagatttaattgaggcccagggtaaacttcactggcagaagtttaatgctcttttaaacggactgccaagcaatacgaagttcgcagaagtcctgaaaatacgctcgtgggagcctcaaaaagacgacactcaggaatacatcagcagcatgcgaaagttacaaacagaatatgcattgccagaagaaattgattactaacgaaaggaggaactaaatggcggacggaagagttgttattcaagttgatatgaacggcgacagagcgcagagcggcattagtaagctaaggggcttgctaggcggattgagcgataccggaacaaaggtcggatcagttttcaaatctgtcttaggagcgaatctaataagcggggctctaatgagtggtatcgaagctttgactggctccataaaaggtgctttttcaacggtcatttcagaaggtgctgcactccaacaatcgctaggaggagtcgagacgctttttaagggttcagcagataaagtcaaagcatatgctgacgaggctttcaggactgctggattatccgctaatgcctacatggaaaacgtgacaagcttttctgctagtttgttgcagtctttgggcggtgacacagagaaagctgcagatgtagctaacagagccatgattgacatgtccgacaacgcaaacaagatgggtacagatatcgggcgcatccaggatgcttaccaggggttcgccaaggataactacacgatgctggacaatctcaaattgggctatggtggcaccaagacggaaatgcagcgattgattaaagatgcggcggcgatgaaagacatccaagacgagttgaatgtctctgtagaagatggcaatatgtcctttgggaatatcgtgaacgctatttcagttatgcagaagaaacttgaaataacagggacgacagctaaggaagctagctcaaccctgagtggttcttttgcatcaatgaaagctgcttggcaaagcttggccgggaagttagctctgggtatggatatagggccatcgctcaaaaacttagtttctacaacgtccactttcttgcttgggaattttattcctatggtcggtaatattatgcggcaacttcctggtgctatttccagcgcaatatctgaagcagggccacagatacagcaggcttttaaaaccatgatgtctggacttgggatagatgcaaacttaacaatagctaagctatcgattgctatagataatgtaaaagcggctatttctgcagtcggaaatgcattcgcaagtgccggaagcaagacagcgtggctaaatactatcagtaacatcgtaggtgctgttatcaacacattttcggcgggagcgaaaattgtagagaacttcgtcaacgcatttgcgcagactggagcaataaaggcagcaaaaggagccatagacagcttaatttatgcttacaacaatgtaattactagcataggagatgcatctatctggtcgacgcttgggtctgttatcgggaatgtggtaacagtcatatcaaacgttgtaaaagccatcggagacttcattgcagggttagatccgtctatcgttcaagggataacaacagctctagttggtcttgtcgtaggttttaaagcattcaacttcctaaaatcattcaatccgtttagtattttcagacggaatgcagcagatgcatctaacggggcagctgaagctgtgacacaagggaaatctaaaatctctcaaatattgaatagcctaagttcagttatcaaatctatcggcggtgcgattaaatctgctgcagttggtatcggagtaggtattaaagcagctttaggcggtgtatcacaagttatcatggcttttggtgcagcgcttaaaacagcaggagtggctaacatcctagcctttggtgctgcggttggtattgctgcagtcggtattggagcaggagtagctattatcgccgctggctttgctcttttggcaactcaaagccaaggaataagcgcaatcattggagcggtaggccaagccttttctgcctttgcaacagctattatcggcgcattcgcacaagcgattgtaacggtagcgggagtacttccgacagttacatcggcacttgctgggctatctccgttagtcgtagcagtagggcaagcaatagcggcagcatctccattcgttacagccctaggagaagcatttacatctatcatctctgtgcttccgccagttatcacagctttgactgagggcgcagcggctatcgtaacagcattaacacctatcgttgagattgtagggaatgtgtttactaatatagctcaaatcgtagcagacgctatcgttaagattgttcaagctttagcgccgtttatgcccgctgtttcggaaatggtacaagcattagctcctgtactgcagtcaattgtcgaagcatttacgacgctagttagtcagataagcccaatcatcgacagtatagctaacctctttaagagcttaggagagtctatcaagactgttcttgacggcgctaaaggcgtgattgaaagctttggcggagcggtaagaaatatactagacggaatttctgggatattcgacgcaatcggaaacgctgctttaaatgccggaaaaggctttaaactgatggccgagggcgtggtcatgattaccaagacaaaccttggcgatatggccgctagtctagccgcagtagccactgggattggtgcgattgctgcaaatggcgcaggaatagcaactgcagggaatggcatgaaagcactaggtcaaggaatggcaatggtacaagcatatagcgcaagcgcttctgcttcgcttatgtcagtatcagcagtgcttcctgctttagcttctggattttcagcattagcaccagttattgccagtgctatggctagagctgtaacaagcgtacagtctggcatgaccttgatagtgacggtcattgtttcaagcgcagctcgtatgactgcagcaggactacaagcaggccaaggtgtatctcgtggagttaccaatggtatccggtctggtgtaggtcaagctacaagcgccatgaatactcttatattgtctgtccaacgtgtcggaaatatcggcgccaggaacatggttaatatcggcactcaaatcggaaacggcctagctcgtggcatgattgccgctttgccagcggtcacatcagcggctaatgcgctcgtggaccaggcagagagagcggcaaaagctagagcagatatccattcgccatccaggctctttagagaccaagttggtcggtatatcgctcaaggtatagctgtaggtattgagcagaatacctcagatgtggtagacagtcttgacaaagtccagcgagaaatgatgcgctacagcttccatccagagaaaatgatcagtcaatctgcaggatctatcacaagtcaagtgcagcttaaatcagccagtgatcgattgcagggtggccaaaataagagcgtcaaggataaagcggatgaatttcttcgcaaggcgttagaagtggcagaggaagccgtgaagagacctgtctatactgttctggatgacggcacactagtagctaagacaggagaaaaattcaaaaactggcaggataatcaaaactttattcgcaacaggatgagaggggtggaaatttgacaaaaatcatgactttcaacggagttgatatgtccaagtattttaaggtcttggatgttattatcccgataggaaacacaaggagtatcgcaacaagcgacgctccttttttgggcgtaaacgttcaaaatgtcaaaatcggacccaagagaattaaagttaagatcaagatgcaaaccaggactccggaagagatggaagagctgaaagatgaacttgctggtgtactgaatgtatctgaagcaaagcgtatcactttcaacttcaagccaggtaagtactacatgggctttgcttacgatgacattactccagacaatattactcgctggctacaaaaagcagaaattgattttttgatcccagacggcgtggcacactctacaacttacaagcgtgtagtggactatgaagaaaagcaaggcaagatggtctttgcgattgataataaggggacagcagacgcttatccaattatcacatttaaagccaatgacgaaaacggctattacggccttgtgagcgagcggtttgctttcgaggccggaagtatcgaggaagccgatatcgtgccatataagcactctgaaatcctctgggactatgttactggcgagggtattatcaagggtcttgcggacggtcagaagaatgtagcaatcctgaatgataattcccaaaacttgaacggaacactagccattcaaagcgtttggggcagacctcatttatcccttgctaatcctggaggtggccctcttggaaatcatgctggatcagtcacttgggaaattcccgctgatagcgtaggagaaaagggagcgcttcatgagtacatatggtggagacaaattttctgggttaatccagctaatcaatatggctttatcaagatttcatttactggtgaaaatggcgagttcctctatggcgttgaaaccattaagcgagtgaatggcctgaatacagagtataacttccttgctgctaatggaagcggcagctataagctggttaagcaatggacgttctggccgactcacaacccaagcgaaaatccgtttaacaaagatagcggtcaatccgacatcttacgcagagacgacgaagttcagctgttttggaatggttcgtatcagaaattcactgtccctgaaatcaaaggcaagaagtctattaaagtccatgttgcaatgggagcttttggcgataagccgctccctacacacatgtacttagatagtatcgtttatcgaaaagactttgtgaatggcacaaaagacatccctaacagatacgctgcaggaagtacgcttgtcattaacagtgaaaatgacagtgtatttctgaacaatcttccgaatctggatcaagtagttgatggctctctatggccggtcattccacccggtaagtctgaaatcgaaatcttgcagtctaattgggcgaggaaaaaaccgagtgtgacgattgaatttgaagaaaggtggctctaatgcttttaacaatccacgatagcgccttgaaaaaggtcgcttttatcgacaataacaagcagaccaccttgaatttcttcaacgacaagtggacacgctcacttgaaagtgcgacatcagtctttgagttttcagttttcaaaaagaaaattcaatctgacacatacgttgaacaagcatataagcacctcaatgagcgggcttttgtcagcttcaagtataaaggtcggtcttatctctttaacgtgatgaagaccgaagaaaatgagcagattatcaagtgttactgcgaaaatctcagtctagaactcatgctcgagtatcaagaggcatacaaagcccctaaagccatgacttttgaagagtatttgaaaacatggggaattctcagtgtcgctaaacttgatttaggtatcaatgagctaacagaccagcgcagagcgttgcagtgggagggacaagaaacctctcttgctcgcttaatctccctggctcgtaactttgatgctgaaatcgagtttgaaactcacttgaagtctaatagccagcttgaccgctttgttttgaacgtctataaagcacatagtgcagaaaatcaaggtgtcggacgcaagcgaaacgatgttgtgttgaagtatggcaagaatgtgcggagtattaagcggagcgttgacaagacgcagttatacaacgctatcaagccagttggacgcaaggaagaaaccaaggagacatcaaccaaggttgctaatccgtcagctacgcaagcggcaaacagtggcaagaaatatactggtggcggtctaaactacgctgggcatcctatgagtgctgctatagtccaaaccatcttaaatctctgtgtgcagtacaacatactgccgtcgggtatgatttgccagctttaccttgaaagctcttggggaagttcctatcttgctagggttgataacaactggtctggcatgtctggctctgcccaaactcggccaagcggtgtcaaggtcacaacaggaagcgcaagaccggctaacgagggcggaacatacttccactatgcgagcgtagacgactttatgaaagactatgcttatctgctggctgaacagactagcggcgggcggaagttctacggggtcaaaggcaagcagaacatcgaagaatacacgaaagggcttttccgtgttggaggtgcgctatatgactatgcggccgctggatatggccactatatcgctctcatgcgagatatcagaggtggggtcaatcgctctaatggcaatatactagacaagctagatgatctctggagacagcctaacaatcaattaagcagccctagccaaccagtgacaagagtagtcaaagccgataaaacaatcgctgttatcaacgaaatgaaaggactacaaggccggacagtcggtagcggccaatgttatggcttagctgcttggtattccatgaagttaggcggccctggtcttggcggtggcgtaactggtttttctggaaaagtcggtgctggtatggctgcggcttatatcggaacggactacgcttgggctaattttggttggtctgttgtccgtcctcgtgggactaatgagctgaaagccggctctttggcgaacatcaaagctcataacgctttcctaggaactggacagtatggccacgtttcaatcattattgctaataacggcagtacagtgacggtacttgagcaaaactatgctggtcgtcagtatgtgactcttgggacttataatgctcaggcttatttgggagccattgagacgctttgttatccaccggaactaaaagccggcaagacggttgagggtaggacagaaacaggcagcacagtcgatgtaccagtaccagagatagaacttaaagaagtaaccgtcagcaccacgcagattgtcatagaccccaagaaaaagcaagaatggaagaatgaaaaaggcga

SEQ ID NO: 3 - DNA, 124324 bp, Camplyobacter Phage CJLB-7
atattactaatatttatagagagggttttatgggtatattaaatacagctgttggtgcaatatcagatttttttggtggtgataaaacacaatcagctataactgaattagcacaaaaaatacaaaaaacatatggtattaattttgatttagaaagtttatatagcattgatacttttgctttaaaaaatgaagttcctggtgctggtagaattaatattcttgacttaccaaatatggatatattaatacaaagagtttcaatagatcctatttcatttgctgaaataaatgaatggataggttctagttgggtttatacccaaggacgacacgaattacaacaattaactataacttttagagatagtgatggtggttttttatattcagcttttaaaaaacttactggtcatttaaaagatcaatatccagatgatcagatgtggatcattaagataaggaaaagaacattaagagaatctaggaattacataaatcaatctgtacaaaacaatgaatttaaaaatggtggacatgttattgtagatacacaatgtgctatgataagaagtcatggtggattatcacttgatcaaaatagtaatggtttggcaacatttgatgtaacatttttatttgatccttttccaccacaaataagctattaaatataaataaaaataaaatggagattttataaatggctattacaaactatacagaatttgaaaagttatgccctaaaaatggtgaaattgcagatcaagatgtcctagggaaacctagtttacaattaaaaagggaacttgatactgttatgtctcaagtgaattcaattattggtattactgatccatcaaattgggatacaggcacaacatatacacaaaatcaaatagtaaaatataacaattctatatatgtttctttatcagatggaaatagagggaatcaaccagatacaagtccatcaaaatggaaaaaaataagtggaggttctatatcatcttctgttaatataactgttagttcaagtgattataatactccagttacagaagtttccgataattctctttcattaaaaccttcaaaagtatatgttaatggaaaccttattccaacaacaaattatacacatgatagtactttaacaaaaataacatttacaaatgaaatgtcagtatataaaaatgatgttgttacagtagaatattaataaaagtaggatatatcctactttatattttttaatgcattatttaaattcttctttaaaatcatccaattagtttcatttgctaaaactctaatatattcattagcagtgcataaattaaaataatatgattttttatttaatgaaaatgttagtgtttttgttatattatcatatttatactgaaatggaatatttttttcattttcaacatatcctaaaacccctctttttacttcaacaggtgttttatcaaaagcatataatataatttttataatagttataagtttattaccttttaagagtttttgtacctctttttggagtaattttgacataaaacaaaaaactaatggtttttttgatgatatagtttttttaagttctttaaccatatttttttcaacaaaagtcattataaacctttctaataaatattttaaaatatttattagaaagaaggatatacaatggacaaacagtttataaaagaaattaatatgctaattacatatgaagatttaaatgtgtttcatgaagtattagttgaaagtttaaaatattataatagctaaggtatttttaaggaattaagtaatacaattctctaaaaaggagaattgtatgagtataaagcatataatttcagataatacatttggagcaccaaaacctggatttgctttgaaaagcaagtttatatgtgataactataatgaacagttagaaaacataaaaatcccagttgataaattagatgaattactaaatgaaataaaaacatttttaaaaacttcttattatgaatgggatggtattgaaggtgataaaaatatatttgtttttaggttatctaacatatatattgaaataacttatagaataggtaaaagtgttcagttagatatgtattcaaacagtatagattttttaaaaggattctataacaatattttaaagaaatatattactggtactgatgagttattaatcaaaataaagagtttctatgaagaaaaaggggaattagtatatgtagattcatctaaaactaaagataattataaaaatattgattatgattattacccttttctagatttaaatgaaatgtttatacagtttctatttgcaaatagcaatattttaatattatatggccaacctggaacagggaaaacaaaacttgcagaatgttatttaaactttttgttaaatttggattataagaaatataaacatcttgaattagaagaaaaagtatttgataagtcagatgatgatggtaatttcataaatgttgcagttgtaaagaatgagagtttattagctggtgatgctttctggaatgagttattagcaaataggtataatttagtattatttgatgatttagattatctattgcctagatctgatattcaaaatggtatagatgcacaacgaaatcaatttatgtcacactttttatcatttactgaaggtataaataatgatattacatgcaaaacaaagtttataattacaacaaatagaaacattaatgagattgatcctgcattattaagagcaggtagaacatttgatatattaaacctaagaacattgactaaaaaagaagccttgaaaatatgggaaaacaatggtttacctaaaaaatcattcaacaaattaataaatgataacattcttcagtgtaatttaagtaatattatagaaggagaaaaatataacattgcttgtaaaaataattttaaaaattatctaaaagaaaatgacatatcacatatgaaaaatataaacaataaaaagatagggttaatttagtgaattaaattaagataatttcaagttaatgtttgatataatacaattaataaaggtgaaaggaaaataatgacagacaataaaattgtatatatggataatgaaataatagtattatttaaacctgcctcaccttataacaggttcattaacatcatttaataatacagttaaagtcttagaaaataacaaaattgttaataaagaaatagtgtataatcaaacattaacaaaacaaatagatgaagctattcaaaattcaatcgatgaatttactagaactggtggaaaatacgctaataaaatatcattaaagattgacaaagataacggtataataacaatatcagacaatggtaggggattaccaatagacacatatgttatggcaactaccaagtttagaacatcaagtaactatacctttttagaaaaagaaaaaaaagatagaatcacaataggtgcgcatggcataggttctaaattaataccattgtttagttctgagtatcaattaacaacaattactcttgaagggaatagaggtgttgtaaaatgtttaaataatatgtctataatagagcataaagaagataaagctcctgcttcatcaatacatggtgttacaattaagtttaaacccgattttgaaaggctagaattaaaagaaatcaatgatgacttaataaatcatatacatgcgttacttataaacatagcttattcaaatcctggtatagaatttacatttcagggaaaactaattaaagtaaaagagtttaaagaatttataaaatattactctgatagtttctcaatattgcaaagtgatgaaaacttagaacttgctatatttcctactgatgagtataagtttgttcatattgtaaattcacttgatttaaataaaggtggggtagcattagattatatttcaaataatattgtaaatgcttttggtaatcgtttaagaaagggatactccaaaattacaaatacagctgtaaaaagcaggataggtgtaattctgattcttaaaaataaaaagaatttaagatttggtggaggccaaacaaaagaagaaattaagaatactataactgaattaggaatacctacactaaaatatgctgactttgctgaactattattcaaaaatacacacattaaagacccaataattgagttatataaagttcaacaagaattagaaaatagaaaacaaaatacttttgaaagaaaagaagctaaagaaagatttaatcctaaatttactaaacatactaaagatcctaaatttatgtatatagcggaaggagatagcgcactttcttctttaatacaagcagtaggtagagattgcagtagtttcttacctttaacaggtaaattacaaaatgctttaaaatgttctacagcacaattattaaagaatcaaagagttatggatattgtagaagctatgggcttagggttacctgaaacaaaatatgaaaacatggtaatagctaccgatgctgatttggatggaaaccatattgcatgtttaattacagcactagtttacaaattacagccaaacttactaacagaaggtagagtatatagattaaaaacacctattatctcagtgttacaaaatgataagttaattagatggtattatacattaggtgaatatcaaaaagaccaagataatttacctaaaaatgctgaagttatatacatgaaagggttaggaagttggtctgcagctaattatagaatagtgtttgcaaaagatggtatagataactgcttagaaaaaattgagtggaaagataatgatgaaaaagttctagagcagtggatgtcagataatggcattgattttagaaagcaaatattaagtacaaaatcatttaatattgaaaacttataggccttcagtatgacaaatcaagagaaaatagagtatttacatactctaggctttcaagtaatatctgaaaatctaactactaatttagtagtaaaatgttctaaagagcatgtgtttaagcgagaattttatgattttcaaaaaggatatacagcatgccctacatgtgaaatagaacaaaaaataacttttttaaacagtttaggttttgaacctatatctgaaaatttaggaaaaaagctaaaagtgaaatgtcaaaaagggcatgtttttaaaagaacatttgggagttttaaagatggtattttaagctgccctgaatgtgagaaaaaagagaaatatggcttcttaaaagaattaggcttcgagattgtgtctaataatttaggcactaacttagaagtaaaatgtgagaaaggtcatatttttaagcgtccatataagagttttaaaaatggccacattaattgccctatatgtgaaacaaataataaacatagttttattgaaaatttgggttttgaaatattatctaataatcttactaatgatttagagataaaatgccaaaaaggtcatatttttaaaagaacatttgggagttttaaaaatggacagcaatgctgtcctatatgtgaagcagaaaataaacatgcttatttaaacagtctagggtttacaattatgtctgataatttagctgataatttagaagtaaaatgccaacaaggtcatgtgtttaaaaggacatttggcaatttttcaaaaggtcatcatttgtgcccgttttgttatccaaattatagtacattcgagcaagaagttagggaattaacaggtggaactaataactgggaaatattgaatggaaaagaactagatatttatttaccagaatacaacttagcaatagaatgtaatggtgatttttggcacagagaatcaatgaataaagataagaaatatcatttaaataaaacagaaaaatgtaaagagaaaggtattcagcttttacaaatattcgagtcatcttggatagagaaaaaagatatatggaagtcaattattaataataaactagggaagtctaagaagataatggctagaaaatgtattttgagagaggtatctaaaaaagaagagaaagagtttctggacacaaatcatcttcaaggcttcactggatcaggtatttgttatggactttattatcaagatgaattgatgtgcttaatgtcatttggaaaacctagatttacagataagtatgactgggagttaattaggctatgtactaagaagaacacaaatgtaataggtggtgcctctaaattattaaaatattttcataaaaatcacccaggctcattaataagctactcagatagattatattctgatggaagtatatatttgaaactaggattcacatttagtcactattctaaaccaggttatttttattttaagaataataaaacatattcaagacagcaatttatgaaacatttgttaaaagataaattagaaatatttgatccaaataagacagaatatgagaacatggtggaaaatggatatcatagagtatgggactgcggtcaaggtgtttgggttaaggaaattttaagttaaaatgttatataatatataaaatgaaaggatagaaatggatattaatacattatttaatgataatttatgtcaatatgcttcatatgataacattagaagtatagcaagcttaatcgatgggttcaaaaattcaggtcgtaaaatagtttattttagtaaagacttgactaattataaaaaagtttcaacattaaagtcagaaatagcatctaaatcacaatatttgcataatgaagatattttacctgatataattacaaattttgcaagagattttgattgtggtcctgttacattaccattatttaaaccattatcagctataggatgtaggacttcaccaacatcagctcaaccaagatattcttctataaaaaaatcagattattatgatcttttattcaataaagacgatgaagagattttagatcatcagtattttgaaggacaaaaaatagaaccaaagtttctattacctactttaccattaatattattaattaacaataacggtatgggtgtgggttttgcccaaaatataatgcaaagaagtgctgaagatgttaaacaagctattaaagacattttagataacaaacaaccaaaaccactagtcccatattttaaaggttataagggtactgttgaattacttaatacagaacatggtaaaaaacaatggaaatttaaaggtgtttatgaaaaaatagacacttataatttaaaaataacagaaacaacaccttatgctactaatgagagtatgttaatacattttaactcattaaaagagaaaaaaataataaaagattataaagactactcactaggtgacagttttgaatatgtaataaatgtaagtggagatttttggaataatcaaaatattcataaattattagggatagaaacaactgataccgaaaattttacttgtgctgatagaaacaatttcattaaaacctataaagatgagattgggatgttaaaagaatatatagatgttaaattagagtatatacaaaagagaaaacaacataaattatctaaatattcagaccaaattgaactgattaataataaaataaaattcatccaagcagtgttggataaaaaggttatatttgaaagaaagaaaaaagaggatattatcaaacaaataaataatataggtatagttgataatattgatacacttataaatatgcctttatattcattaagtgaagagagcataaatagtttgaatgaacagttgagtggtttgcaacaaagttttaatgagttatcacaaaaacacgttaaagatatttggttggatgatataaataaattatttgaaagattatgattgcatcatgatcttgatatattcattaataaaatgaatatatcaaggttatggtaagcttattaggttaactttctctttacttttaaagagaccatagcctgagtaataatatagaacacataaggttaatacgcagacctaaaataaggtccctcctttcaatcttcagatattcttaacctggtgttctctaaatataaaaggaatgatatgaaatttaattgtaaaaattttgcaaaagcgttattttactcaaaagatattaattatcttataaaattattcaaatatgccaaacaggaagataaaaaacaagcaatgcagattttattatgggccagagatgtaaatggaggaaatataaaaaattcaattttacttctaaaatatatcgctgaaaaaacaaataatattaatgacatgtttttaacatctgttgtaaaatatggctgttttaaagatttaaatgagatgtacaaagttgcaagtaattctaacaaagaaaaaatattggcattttattcaaaagagttgagattaaaaaaccagttagctgcaaaatggactccaagaaaaggaccattattttatgcattagcaaatagtttgtgtttaaaaattggtgactttagaagatatatcacaagtttatatatttcagtagaagcaaaaatgtgtgataacatgtgggatagtatatcattagatgagataccagaaagagctataaaaaaatataaaaaagcattggaaaaaagattgaaaatcactatttattgtaggaatccaaaacaaagaaagctaaagtttaaggggtgtgaaaaactactaaaacaatattattaaaatattgaaaaagctataatgaaaaagctaacatatattgttatttttttatgcattgtatttacaacaacatcacaatcagttatttttcatgctaaatataattttgaagatattattcaagaaaggttatcatatttaaaacaaaatatgataaaccacatttcaaaatataataacaaaaacgctactgaaataacaaactacatatttgaagtatctttaaaatataatctaaatccagtttttataatgtcgttaatacaatcagaatcatacttcaaatataaagtaaaacataaacataataatgttaagggaataagtggaataaattacaaaatgtggaagatggtattagccaaacataatataaaacatataaactcgttaaaaaatcaaatagaagctactgctattataataaatgatattaagaaaagatataaaactagtgatgacttagaaatattacattattacaagggaagggggtatgacaaatacttgaataaaagtgggttagatttagcccagtatagttatagcatgtatataaaaaatattaaaataatatataactaagataatcttaagattaaatgttgtataatatcaaatataataaaggagttagtaatgactataaaaaataaaattaatgatattaatgaaatactacagtcttatgttggagagttagtattatctgatattgatactcagaaaatagtagaaaatctaacagaattggaaactattataaaagatgctattaataagcaatcaaataatagtaaattaatattaggataaaaaatgagttatagttttgaacagtattgtaatagtaataattttaataagtttcagatatacttaataacacaacttagctacataaacaataaaaatgttgttgctatacaagatcccgagtatatggatgtatttaaagctattaaacaagagtattataaagcatcatcatataaacacagcgataaagaagaggtaatacctgagcattatactaaactggcaatagaacccattgattttatatataaaaataatttgaatttttgtgaaggtaacatagtaaaatatgtttcaagacttggcagtaaagatgataataaatcagagttaaagaaaatatttttctattttgattatttgttgcatggtaattatgatttgactaagaaaacctttaactaaaggtttttcttaacataaattattatataataactaaaattaaggaaggttatatgaaatatgtatttataggtggtggtgtagcaaatatatacactatttgttatggtatcatgaataatattattaatatgaaacatgatgaagtaattgttattgaaaaagggaaacatattaataataggatacctacaatagatattgtaaatggtcttctaggtggtggtgcatttagtgataataaaaatatattttcactacatgatgatcaacctatatttgagtacattaataagcaacaagttttagaatactatgattttttaaaaaataaactatttaaaatgtttttaccagaaaatgcttctatacacataacacaaccagttgaaacaggatcaaagtttgtaagtggttatggtaatatagctttaaaacaatctgagtgttatcatataggttcaactttggggcttgaaatgtgtaaaaacatgataaaatggcttgaaagtaaaggtgttacaatttattgtaactctacatatattccttcaaaacttgataaatgtataacagtaagagatacaaatggtattgaatcatatataacttatgataaactttttataggtcttggtagaagtggcatgaaagatattaaagaaacctttgaattaaacaacattaaatccgttgctgaccaaattcatataggatttaggtttgagtgtgaatataataatacaattcaagagttagcaaataatattcaatatgattttaagttctctaagaatattaacaaaaatcatcttaaagagttgagaacattttgtgttaatcatggaacagcagaagttgtaacagaaaaagtaaaaggatattctattcctattagagaacaagcaaatggacacgcttatggattacatgtaaaagacaaatggacgggaaaatctaactgggctattttaggttcttttaaaaatgtaaatgtagaagattatttatcacaaatagaaaccattactaatggtaaaatttatgaattaaatcagaactcatctttagagtttttaaattgttttgataacttaggtgactcactttcagaatttattaaggaactttgtgatatactacatataaaggaatggaaaggatattttccagaaataaaaataataggtcctagagttagttataataataattttacagtacaggattttagcaaaaatatcttttttgtaggtgattcagctattacaagaggtattattccagctgctgtaacaggcattcatgcattattaaattgaaagaggtaaaaatgaaaaatatagaaattttaaatatggttgaagagttggtgaaattaaacccaatattgttgattagtgaaaacttttctcatacttatgaattattaaaagaaaatgttagagaaagtaaaagtatagaaaataaaaaaataaaattgaactgtatatctgttaaattagatgatgatacaaaactaccatgctatgggactgttttatcagtacttatgaaggataatttagaaaatataataaataaaaacccacaatcattacttgaagtatcttttaaaatatgtattgatgtactacttgacttaattgataaatttatagaaatatatgattttaattatgaatcactacttttagttaataggataaaaatatgtgtgtattaaaaacatggctagaagacagtaatgcaaaattaccagaaatatcagtaatgggctctgcttgttacgatatgttttcaatagaagataaaacaattcaacctggtgggtttgagtatgttgaaaatggtgttagattaataattccagatggatattatataagatttaacactagaagtagcctaggatttataaaagatttatttgtttatcctggtatattagatgcttcttggagtggaaatttaaaagtaaaagtgtataattttggtaaggaaccatacactataaaaaaaggtgataagtattgtcagtttgagttattaaaatgtaatgaaagtaaaatagaaaacatatcaaaagatgattttgataacattacaaaaaatttagttagaggtaataacggtggatggggcagtagtggaaagtaaaacagagctttttaataagctctttgagtttagaaaacaaaaagatatgatggatgattgtattttagatgttataattgaatttggaaatcatattaatatggaacctgaattaatagcatcagaattgtctgactatgcaatattcagggatattgttgaaaaagacttaaaaaaattcaaatttacaagatatgatctaaaccaaagcgacatagatatatgggagtaaggaatactgcatgaaattgcactattatgatatttataatatttctaatggagtgtttcttacatttcaaaaaaacttaaaagaaaaattattatgtgtatctcatagcaaagatataatgaataaaaaaataggtttttatccgttaaacttttctgatagaggtgacttcattttattgtgtgtatatataatgtttaaatacagtccatctagtatttatggtttatgtgattatttaagaaattacaataaaacagaatatgagaagtttaaaaacacaataaaattctataaaaatataataaaaaaagacataacattattagaagagaaatacaaaaaaccgatgtttaaagaagtaatgcgtgaatataataaaaaacaaatatctttcgttactgtgtattggtatctaatgttatataatattaaagattttaatggtataaacaattctattatatgtgaaagtattttgaatgtttttaagtttttaaagtttacagatgaatcaaaagattacataaaaactgtatttaaacaaattgaaggcgaagtattatagattaaggtaattttaagtataactattatataataagtaaaaaagaaaggattgatttgaaaaatataaacgaaaaagaatatatatgggctgaaaaatatagaccgtctagagtagatgatatgattctaccagaccaacttcattcaaaaataaaagaatggattaattctggtgaaataccaaaccttggtttttttagtaacacacctggaactggaaaaacttcattaaacaaagcaatatgtgatgaattaggtgcaactcatttattcattaactcatcaaaagagagtggagtggatcttgctagaaataaaattacatcatttgcaagcagtgtttcaatagatggttcattaaaaattatatctttatcagaatgtgatgggatgacaaatgaattacaacgctcaatccgtgatataatagatgaatatacccaaaattgtagatttatattaacagcaaattatactgatagactaatagaacctattttgactcgtgttacatgtatagactttgataaagagtttaatgataataaaactgaactaggtgttaaaatacttgataggttggaatttatattacaaaatgaaaaagtagaatatgataagaaagatttacagaaacttattcaatgtttttatccatgtattagagagatgttaatagttatgcagcataatactgttaataataaattagtaatagatgaaaaagtatttgaaaatattaataattattccaatttagtcgaagctttaaagaaaaaagattatactgaagctagaaaaattatagcacaaacagtaagttatagtggtttttaccagtatttgtttaaaaatgttgataaattttttgagttagaaagcataccacaggctgtaatgcttatagaacattatagtgatcatgataggacaagtagagatagagaattatgtctaagtgctttagtagctgctcttataaaatacgacataaaacataaataattgaaaaggatataagtatgatatactcaaaatttttagttgaatctataaacgatttgaaaaacaacgataagaacattagcaataatattactagtttaatacttccaatagctaaagctaatttaaaggtaaatgttagttatggtaaaactatattagacagttatgaattaagttctatagttaatgactctgatatacaaattctgatatcattctttgttaaagaacgaactgctcgaataagaataaatctaataaaaccttgtataacagtgagagttactggtataaaagaagatattttaaatgaaatatacgaaaaagtagcaaacataagttttgatggagaaaaataccctcctattataattaattttgatgaaaaatcactgcaaaaattagcaagcgttatagcatcaaaagttgatgatatagataatatcattaaagatgagctatatgattgggaatattatgaaggtgacattggttcaaaagtaagagttggttatgatgataactcagctatgaaaataaaaaattatgaaggtgaatgggaaattgttattgataactttggtgctgaatttgatttagaagactctgatttatatgtaaaacctaaaaaataaacatgttttgatactcgttttttcgagtatcaaacatttaaaggatgcaaatgtttaattttttattttcatttataaagtcaaacataatttatattttgttaggatctttgttagcttttactgcttatagatatatttcattagaaaaatcaaatgctatattgattgaaaatgaaaaacaattaacacaaaatataaaaaattctaaaaaggaattagaaacacttaaaaattataataatcttactattgaggtttttagagaaaaagaagtaaaatataaggaagttcttaataacataaaaaatgttgagactaaaatacaaaaattaaagcttattagaaaggatgagaatgaaacacagtatattattgttaatttttagtacatttatgtttgttggctgttcaacagcaaccaaaacaataacaattactgaaaaagagtatttaaaatatcctcttgatgaaaaatacattcctcataaaataggtgttaaaatcatgaaacaggaaattaatggtaaagaatatctgttaatatctccaaatgattttatacttatacacaatcaatataaacatcttgaatttaactataataatctttataactcaatagagaagtttaattcacaagttaagtaatatttaagaatatttgtaatataatattcttaaatttattatacgaaaggaataaaatggttattattaatgatgataatatatattttgttagtaaaatagactcatttagtgtaattaaagacaattcatctagtattgtatttattaaatgtgggctacaagagtacaagtttacaattaaacataaaacatcaaaagaagtatataattttattatggaggcgataaatgaagaaaatgtaagccagcatcatgttgttatagatattaagaaatttagaaaggattaaaatgtcattaattaataaattattaaaaaatagcactctaaaagatagaactaataaacttgaagatagtaaatattttggtaaaactgaatttgttgaaacaccagtaccaatgttaaatcttgcattaagtggtaaaattaatggtgggctaacaccaggactaacagtaattgcaggtcctagcaaacattttaaaagtaattatgcacttgtaatgatggcttcatatttgcaaaaatatcctgatgctgtatgtattttttatgattctgaatttggtataactccagactatatggaaaactttggtattgatacaacaagagttatccatacaccagttatgaatgttgaggaattaaaatttgatattgcaaatcaattagaaaatatcgaagatggtgatagagttataataattctagatagcttaggaaacttagcaagtaaagctgaaatagaaaatgctataaatgaaaaatcagttgtagatatgcaaagaagcaaacatatcaagagtttgtttagaattgtaacaccttatttgtctatgaaacagatccctatggttgttgtaaatcatacttatgatgatattggatctttgtggggtggtcaagtggtatccggtggtactggtgtaatttatagtgctgatactatttttattattggaaaagcacaagaaaaagatagtaaaaagaatttacaaggttggcaatttacaataaatgttgaaaaatcaagattcatcaaagaaaaatcaaaaatacctattttagttacttttgataacggtataaataaatggtcaggtttggctgatctagggctagaacttggattcctacaaaaacaaggtgatagtcattttaatccatttacagagaaaaagttgtatttaaaaagtgcatcacaagagcagcttgatgagttctttagtgagctactctctaataaagattttgtagatgctctagaatataaatattctttactgaatgttacacctaataacgaaactaccgaaaataatgtttagggcgtatccctaaacattaatatggggaacacacatgactaaccacgaaaaaataatatttttaaacaatttaggatataaagctatttctgaaaacttatccaaaagtttaaaagttgaatgtaaacatggccatgtttttggaagaatgtttgatgattttaaaagaggttctgtaaattgtcctgaatgtgatagactaggaaaattaaactatttaaataatttaggttataaagcggtttcagagaacttagcagatagtttacatgtagaatgcccaaaaggtcatatttttaaaagagcatttggtgattttaaaaatggtaaaattaattgtcctaaatgtgatattcgaaataaattagattatttaaataatttgggatatgaggttgtttcagaaaatctatctaagggattagaagtaagatgctcaaatggacatgtttttaaaagagcatttgggaagttcaaagatggctttacaacttgtccaaaatgtaaagatactagtaaaataaattatataaacaatctaggatatgaaataatttctaataatttagctgatgaattaaaagtaagatgtatacaaggacatgtttttaatagaacttatggtaactttaaacaaggtaaaatagtatgtccaatatgcaacccttccactagctcatttgaaaaagaaatatctgaattattaggtaattatataagcaatgattattcagttttaagtgataaagaactagacttctatttaccagaacataacttagccatagaatgtaatggagactactggcattctgagcaaatgggtaaagataaaaattatcatttgaataaaacactaaaatgtgagagtaaaggtatccatcttctacacatttttgaacattcatggtacaataagaaagaaatatggactagtattataaacaacaaattaggaaagtctgagaaaataatggctaggaaatgtgttattaaagaagtacctaaagcagaagagaaagaattcctagatacaaatcatctccaaggatttactggtagttctatctgctatggactctattaccaagatgaactagtttgccttatgagttttggaaaacccagattcacaggtaagtatgactgggaattgataagactatgtactaagatgggactaaatgtaataggtggtgcttctaaattacttagctattttcataaaaataataaaggaagcctcataagctactcagatagactatattctaatggatcaatttacaaacaattgggattcgaatttagtcattattctaaaccaggttatttttattttaagaatggtgtagtttataatagacaacaatttatgaaacataaactaaaagataaactagagaaatttgatccaaacttgactgaatcagagaatatgaaagtaaatgggtataatagagtgtgggattgtgggcaaggtgtttgggttaaggataatctaagttaaaatattatataatgtaaataaaaaaggatgcttatgaaaattaaagaattaatatgtaagtttataaattttaaaactttacagaaaattataactatagatagacagtttataattgaaggacaaaacggaatgaaatatagtggtgattttttctttgtagatgaaggtggatatatttgcaaaataagtgatagcagttgtgttggtacaatggtaaagagtagcaaatgaaattattagtagctggtagcagagattttaatgattataatctattgaaaaataaaatacttgaattaaacatacaaccatcaacaattgtatgtggtatggcccgtggtgctgatatgttaggttatcaatatggtattgataactctcttaagatagaaaaatataaaccaaactggaatctatatggaaaatcagcaggacctataagaaataaattgatggccgatagtttaaacaaagaaacagatatggctattattttttgggatggaatttcaaaaggttcaaagaatatgatttctattttagatgacaaaaaaataaattataaaatagtttattataaggagaaagaaaatgaataaacagttaggaatttatgcaattatatgttattgtgtaatttcaattattatcaattttgttagtttgcctgttgcttttgaagtgtttgatagaattggaatacatcttgaaaacccaaaagaatatgctacaatggtatttgaaacatatacaaatatacttatatggtcatttatagtaatttgttgtattttattacttgttaccaacaaatatacaactatattatataatatagttgtaagtctttcaattacatatattgtgtatgacttcatttcaaattgtattgagttatatagcatgtataatttaatatatgttgaacagttttttgatgttaatgagtaaggatattacaatatgttattgagtaaaaccaatttagtgacagatagatccaaggaaaaatttttctttggagaatactcaggttttcaaagatatgactggtattcacacaataaattagaaagtttagatagaaaacaacaagcacaattatggtttccagaagaaattagtatgattcatgaaccaaagtcatttatagaattgcctgagcataatcaaagacaaataaaagcaaatttaacttttcaaacattaatggattctggccaaaatagaggtttggacaatatattaataccactagtaacatcatcaggattagaaggttgtttaaaaacacaggcttattttgaatatattcattcaagatcttattcacatatgataaaaagcgtatttccaaaccctactgatatttttgatgaatattgtgaatatcctgaaataaaaactagaattaatgatgaaatagacacttatgaattactagaaggcaatttagaagaaaatgatgaaaataaattaaaaatattagaagcttgtttaagaattcagtttttagaaggtgttaagttttatgtaagttttttaacaacttatatgattaataaatattcagctggtggtaacaaaataccaaatttaactaaaattataaaattaataaataacgatgaagatattcaccttgtaatttttagttttattattaaaactcttagaagtgagcaacatcaaggattttcacacctttttgatgatagtttgtcacgaaaagctagaaaaatagcaaaaaaagtttaccaagatgaattagaatgggctaaatatttactatctatgggtcctattccaggattgactattgaaaatattgatggttttctaaagttttttgttgatgatagactaaaaaaatgtggctttcaacctatatggaatgcaccaaaaacagacttagtcaaagaattccaagaaataaaaaatataagcagtgaaaatcaaatgcttcaagaagttgatagtatcacttattcaaaaggtgttatgaaaaaagatacaaagttagaagtgtataatgatgaaatattagaaaatgagttagaaaaaatattgaatggagatggaaatgttgccagttaaatcacttacagaattagatgatattaacataaatgttgttaaaaggaatgggactgttgaaaaatacagtccagataaaatgtataaatttttattaaaagtgtgtgataataaagaatcatatgcaatgaatattttgtcaaaatcaaaaataaaattaagagataacattaaaatacaagatctttatgatgaaatattatctactactgtgaatgaaataagtatgttatatccaatgtatgaaaagtttgcagcaaaactatatatcattaaatatcgaaaaaacatgggagatgaaatatctcttggtaatgttttaagacttggtctttcatcagggatatattctagtgactttgttaataatttttcagaaaatgaaatacaagaattagataaatatattgataataatagagattatttgtttcaaaactataaagctattagtatgttttatacaaagtattgtttaaatagaacaaaaacaataaaattagaaacacctcaaataacttatatgagagttgctatgtttatttgtatgaatgaaaataacagagttgaaaaaattaaaaggatatacgatttaatttcaactcacaaatttacatacgctacacctataatgttaaactctggtattaataaaggtcagttgtcatcttgtgtattggctaagatgggtgatgattcacattcaatattagctacaaatgataaccttgcaatatatagtaagaataaaggtggtactgcttgtgatatttcagctttaagagccactggttctattatagatggtgttggtgtttcatcaggacctattccatttataaaattattagattctacaatatctgcatggaatcaaggttctacaagaaaaggtagttgctgtgtttattatccaacatggcatatggatgttcaaaacttgataatgttaaaagataatggtggaactgaatctactagagcaagaaatttacagtatgctattaaaatagatgatgtatttgtaaaaagatggtataataatgaaaactatacattatttgatccaaaagatactcaaaaattgttggatagttttggtgatgattttgaaaaatattatttagaatatgagcagaaatcaaacattaggaaaaaatcaataaatgctagagagttatttgatgaaattttaaagtatagagttgaaacaggaaatatttacattttctttatagataatgtaaataaacaaggtatgctaaatagaactgttacacaaagtaatttatgttgtgagatagttttaccaacatcagcaccttataaaaaagatgaaaaaatagtacattatatgtgattaagtcatatttaaggggattaatggtataattcccttatttgaaaggaatagtagaatgataaacaaaaaagaattaataaatcatatgtattcagaaatgttacataaatgtttaaatggaactgaaactgttgataacccatatcatttagaaaaaactgtattagatcacacaataatggtattaaataaggttgaagatttatttaaaaatgataaagattataaagttttaatgtttggtgcagccttacatgatttaggtaagatatttacaagagaagtagtaacaaaagatgatggaacagtaaaagtaagattccttaatcatgaaaatgttggagtatattatgcttgtgatgttttatctaagtttaatttaagtgaagaagaaataataaaaataataaaaatagttgcttatcatgatatttataaatatgatatagataaattaaaaataaaattcacttatgatgatttgcaattattatgtaagttttcaatatgtgattcattaggcagaatcacacatacaccaaaaccaactgacatatataaacagataagattattaaaaccttatgaaacaaaacctattgatataacaaaaccaactataacaatgttaataggtgttcctggagttggaaaatcaactttgtgtaatcaatatgaaaatgtaatttcaagagatgatatattgatgagttatggtaaaacaaaatttaatttaaatacatactcagaaatatggagtaaattatctcaagatgaccaaaaagaaatagataacatctttaaatttaagttaaatagactactacaacaaggtaaagatattgtagttgataaaacaaatacttcaatgaagtcaagaaagtctttgttaaattcatcaagtttgattaaaaattacaacaaagttgcaataattatgttatgcccctataacacaatactagaaagaattggaaaaagatcactagaaacaggtaaagagatatcaaaagatattgtggataatttcataaaatctatgtgtttacctacattagaagagtttgataaaattgcttttaaatggtcaatataaatattatttaccaaatgatatgaaggaacataatgatacagcttaatttattttgcagttatgtaatattttctgttgttacttgtgttatatttaatgacattaataatagggaatataaaaatatgatagtagagtttatatcaatatttatattttttatatgtttttgttatcagttaattatttatagaaattttaacagggataaagttgaagataatttgtgttaaggtacatttaaggggattaataacagaaaaacaactattgtaatgcttactctaaattataggaggtttgtgaaatgacacctggaaaaataaaagaaatctttgaaatagttttaaaagaaaaagaaaaagaatatactgatgaaagattagaagaaataagaaaagaaagagaatatgttgaatctattgtaaatgagggtattcaaaaataaaaaattatttggaagaaaaacaatttctttgataaatttgaaatgttagaaactccagaaaaaatatgatacaattgaatattttcatgatttagctaataacaaactatgggccttaaaaagacaagaagaaatattagataaagtttccaaatttgatcttaagtttaatttaaggatattttgatacaatacccttaaaagctttaaaaggaaaataaaattgatataaagagcgtaaatgaaaatgaaaatgatgatgcttttacaaggagaaaaaggtgatgaatgaaaaaagtgcaaaatatatcaagatgacaaaggaaaaacaatgaaactaaaagattttgattttaggatttttgataataatgatattatcaaaaacatattaaaagagataatacttataaaatgtttaaaatagaaatttttagtaaaaactttaataaaaaatttataaaaggaaagctgaacctgatatatcttttttaaaagtatttaagtcagaaaaaaatatgaaagttatcggtaatatccaaattatatcacacaacgaagagaaaaaacaatggaactttactggtttttatgataaaaatggtaaaaagatttatgaaggtgatgtcataatctttgatgatattgttcatgatactaacagaattggtgtaataattaaaagacatagcggtgaattcagattagaatttagcaaaaatgatactttaggtttaaaaatattaaatgagtcagaacttttagttattggtaatattcacgaaaatatgaatttgttagctagaaatagataaagatataaatttaaaaatgctaccaaaatgggataaatagttttatgctaaaaataacaaagattaaaagaaaaataatgaatatttacagtatttttttaaatgaggaagtggaacctcaaaaggatctagccaaaaaatcacttgattttttaggtaaaaagttaaatgctacacatagtgtttctgagaaaggaaatactttaatagctacatataaggacaaaaatggtaataaattatgtgatgttaatatcacagtaaatgataatattaaagtaacaaaggttacagataataaagggaaacctaaacaaattgacttagttattcacaaaataaatgatataattggcaacaaaattataggttatattaataaagctgggaaaattaatgaatcatctttagctgactatggacttgatgtaaatggattttacaagtatataaatggtaaagaaagtatagtagaaactgatgattttaaaataaaaataacatatgattctgcaaatccagagtttgatggtgataatgaagagttgttattaaaaatgcattgtaatattattgaattaaaatatgaaattgaaaatattgttaaagatactatgagaatctctgatgaaataaatgataaaatagttggaattataaaaaaagatcttaaaaaatatgatgatatttcaaaatatttaattttaatagatagtggagtgtatatagaccctgatgattatccatttgatggtcatgttcaagacgcttatataataatacaacctaaatactaatgccagaattcaaacaaggtttttataaacctattaacccagaaaaatatatagatgatgtaacaaacatcatctatcgtagctcatgggaatataaatttatgttatggtgcgataataatgctggtgttcttaaatgggctagtgaatcaataattataccttatgagttcctaggtaaaaaacatagatatttccctgatttttatattgaagtaaaagataaagacaataacataaaaaaatatcttattgaaattaaaccacaaaaagacgctatatttaaaaaaccaaaaataatcacagaaaaaaataaaaaaagagtagtagaacaagcaataatagtttcaaaaaaccaagcaaaatgggaagctgcaagggagttctgtagaataaataatatggaatttatggtattaactgaaaatgaattatttaagtaacctttaagattgtttgtggtataatactacaaatatttgaaaggaataattatgaataacgcaactgtgatatcttttaaatttgaaactgagcaattagcatttttaaataattgcatatgttattatgatgatgagttctacaatgttaaatatatgtgtaatctttcagatgatgaatttaaaagaattactaacttcataagctgtatgaaaaataatataaaatacttagaaataaatgataaaaatgtggatattgaaacattaattaacagactaggtagccatatattccgttatgcacatactgatactccgaaagaacataaagacgcagagtatatgttactaaaagactatttattactacacattaaagactatggtgataatgaattagtaaaacaaattctcaaaaaatcagaagaacttaacagcaaattatattataaatgaaaaatataaaacaagggattaaaatgttagaacatattaaaaacttttgtgctggagcacctatagtcggtggtataatattactatgcatattagttatatactttccttatattatgctaccattaattatggcaatactgcttataagttttagttatcatataggacaagagttaagagataaaagaagaggcttataatttaagtaatttgattaatttttagatgaatgtgatatcggagcaaaaaaatttagagaatactaattaaatattttataaaggagtataattatggcaatgattttaagtcaaaaagaaattgatgctttattagaatgtggtagtcgtcccacaaatcttggaattaaatcaattgtagatagaaaaatatcagagttgaaaaaagaaaagagcaaattaagtattaaaatgaaagcaatagaaggtttgaatttattaaaggatactgataattttacaattaaagattatatgagtattataaatgatttaatagactgtttagaatacaagataagtcattgtcaatcgtttggagataatattcctaataaaaaagctgaaaaggaatttttaaaagaacttgggtcatttaaatcaacattattcagttttgaacttgatgtgaatacaggagaggaaaatggagaaagatgagttattaagcattctagtacctacaattgaagatgaagagttaaagaaattttataaagaattaaaagataaagatagagataaaaactttaaaaaggcttcaaaagaaaaaattaaagagatgtctgaaaggttaggaatatgataaaatcaaaatttattattaaacgcaaattagattttaaaaacatgagatttggatatcaattatgggatatttcaggatactctgaatttgttgaaaaaccaatttatgatcatatattagaagaatttaaaaaattagatccaacgatgaaagatatagctattttgaataaaattagatatattgatagagttagacatgatttattatatgaatctacatttattttgggatattttagaaatgaattaaataaagctattaaaaatggaaaagatttagatgaatttattttttatgatcttcattcagattggttactgaaaatgataaatgatattataaataaagaaactttattagaagatttaccatctatattagaatgtatgggtaatataattaagtctataaatgataattttgatttatcaaataattcaatatttaaatggtttcaaaatactcataattatgtaaaattattattagacggtaaaattgattatgaaaactattgcattaatatggatttagttatagagagcaatatggaaaatgcgttattatttgaaaaagaagttattgaagaattaaataggtattaaaatggataaaaaatgtagagatagttatggtcaaattgattatttagatgattatggaaatattattaaaacaggatttgaagatcctgaattagatgaagctatgaaaaacttaagtgactccattgacaagacttatgaaaaatcaaatttttatgagtttattaagaaaaggtatagaacaaattacaaagagtgtgataatgaaacaaataaaatctaaaggtatagcattaattcctgatggaattgaatttgataaagaaactaatgaattttttgaacatgcgtataaagattttcttgagggtaaatatattcttgaaggtgaatcaaaatatcctagaagatatgaaaatattaaccaaatagaaattagtgatgaagagcgtaataattttttagaaaaatgtggtataaaagctgaggaataagactaactaattattgttttaagccaactttaaggctattataatataataattgtataataattgaaagtaaaaatgataggagcttaaagtatgaagagttacaataatgcttttgatttaaaagatgagtattacacaccattaattctaattgaatttttaataccttgtttgtatgaaaagaatattattaaaatactttgtccttttgatgatgaaagttctaactatgttaaagtttttaaacactatggttttgatataatttatggacatattaatcaaggtaaagacttttttagcaaacggtggcttaattatgactttgacattttaataagcaacccaccttttagtaagaaaaatgaaatcataagacttttaacccaagagaatattgattttatgttattaatgaacttaatgagcataaattatcaagattttagtgaaacattaagattagtaaacttacgaaaacctataaatttcataataccaaataaaaaagttagctttgatggaaatacgagtagctttagtagtggttatatatttgtaattgtatagaaagtaatttgtttgttgatctaccgcacaataattcaaataaacattataataaagatatttaagtttactataattgtgaaaattttgaaaggagtaagaaatgttacttgaagttgtatttgaaaactttaaattttgtaggcaagatagagttgaaatcaattttgataaactttatagtcctgattattttaagaaaacttttagaaaagtaaagtgtaaatgtaaccctttaaaatcattattttttgttgattgtgatttaccaaaatacattttaaaagcaattaaaagagacaaaagtctttgtaatgaaataactaaagattatggtgttatcacactcacttatagacaagatgattttttaattgattacattttgaaaattacggagtctgaaattatccaaacaaccgatttagtttacttagatttgtatctaaaggatgaaaactctgattgtgctaaaactataaatgaaaatacaaaattaaaaccttctgagaaaaaagcacttgaaaaagttaagcaatttgaaaaaaatacaatagagtttaattcttatgagtacaaagataaacttgattttctaacgcatattttcaagcattttgataataaaactaattgtataatgtttttggatgatttattaatgaaattatcatatatggcactttacaaattttcagttgagttatatgatgacaaatacgaaaacatccaaaagttttgtttaatagatggaaaacattggcatttattaaaagactttagaaattgcttaatttcaccagacaatgtttatttttatgataaaaaagatttaatttcaataagtgattatgaagatgctttaaaaatatttaatgaacctattcatcgtcgtatgtttattgaatatggaagtccttatcaggaacctgatgataaatttattactgaatattaatgaaacttaaaaactttatttttagaatatatgattgaaaaatatatgattttcatgaaactttatgtggtgaatttgacattgataaatgtgagtatttaaatacttttgaagtagttggtaacatttatgaaaaatttattaatgaagttgttaatgatatgctcagtaagatttatgtaaccaacagaaaaacaggtctggattttaaagaagattataaaaatatagaatcgcttgggaagaaagctttgaaagttctacacaagcttgtaaggggtggatatgattccaaacaatattataacatttatagtgacttgctgaacgaattatggaatataaatcaacatctagttatctataaaaacgaaataccttggtatatgtatgaactcaaatcaccaagattgaaaatataccaagaaaatatccacgattatatggatgatattaagcaagctatgagagagctaaaagccgattatgcttctgtttctcacattagtaataaaaatctagagaccaatatagaatctattatagacgaatataaaagattatataaaatagttgaaaaaatcgccctatcatagcgatgaagtgagaaaaatattaaaaaattaaaggaaaataaaggaaggtgataatgaataaaattaaacaatggactatagaattaatgtgtatattctatcctataaaaataaaaagcaccgcaaaagataattattatatatcatataaatttaaattcaataagtattatgttttcggtgatagaggcggagaagtatttgttgaaaattatgaggatgctttaagaatagcagactggatggatgataattaaaaattgaaaggaaaaggtaatggtaacaacattatttgaaaatgaatatgttgaagtattaaatagaaaacaagcagattatattgtaaaaaactttgtaaaaacttgtaattgtaattgggaagatgatgaagattgtgataagtttcaatatctgagtatattgaagaagagttagagagtgatattgaattagttaaaagtgaaatgggtggaaaatgaataaaaagcaatttaatgaaattaaagaaagattagaaaaatatagagaaagaaagaatttaacctatgaaaatcaacaagaaaagtttttaggtaatgtttttgaaaaagtaagcgagtattttagagcaaaagatgatttagaaaaaatagatgcactttgcgatatagtaatttattgtttcaaaactttcgatattaaatataagattttaaaaataaacttttaaattgtgttataattataaaagtaaagaaaattatttaattaaaaagggataaaatggaaaattacaaatatgtctataatgattgtttgtcactttttgtggaactacaaaaaagcgatgataacaaaaaactacaaatatatgatttaatgttaaaatgtattgaactaaaatttcctgaaataacaactaaaaagaatattaaaaaagttgaggaaatattaaaaaattataaagaaatagaaactcttgataaagacgaagattatggaacaatttcttggcattatattctttgtaatatcggggatgtttataatgttggatataaagttgtatatgctggtacaaatggaagatattcatatgatgacgattattttgaaaatattattaatttatactcaaccataacttttttaaatgaaaaactacaaaaaggttgcccagataatgtttcattagctgtatttaataaggaaggaaactaaaatgaattatttgtggaaatataggttactcaatttatgatgatattttggagttaacaaaacttagtttatacaataactacagaggattaagatgacaaatagatgttttataggtatattagaaaacaataataatgtgaaatactcgttttgtatgtatgatggtaatatagaattagctggtagaatacttttacaaaattataattataataaattgtgtgaattattaaatataggtaaagatattcgctttttatcaaactgtattgattcatgcaatttctttgaatatgaacataattataattatgatgtaagaatgaatttggaaacatttaagaatgtagtatttgatgactattattgtgatataaaatacatttatttgtttaaagatggtaaatattattttgctgatagaaataattataaaaatctacttgaaaatgcacttgaagactttatatattaggaaatttttacatatttttaatacaaaataagtttaatttaagactattatattagaatatgaataatgaagataatttactagaggaaataaaatgctagaatattttaattgctacacaagtaaaaaagaactttacagttatgaaaaacttaagcaagaattaaatggacatgggttaaacatcaaagaggatgaaaacagcataaaagaagataaaaataaaaatatgtcaaaaaggaaaaacaatgaaactaagtaattttattaaaatgtgtaagattggtaataactatcacaaaatcacaatttgatactgtaaaaaaatatataagtttaaactataatatacatattgaaaaaatagataaggaaactgaattatttttcttttcaataaaattattatgtgatattatagaattatgtccaaaccacaaaaaagaaatagaagataaagtaggagagctttgtgattttagagaatatcaattggaatcttgataaataattaaaaaggagataaaatgtttaaaaaagtattaaattggtttatgcataatttttgtgcttgtattttgttgttatatctaatagttatattagtagaaatagatgaagttaatttaaataaggttataactgttattgtacttactggttgttatatttcagaaagaattgaaaatatactattaaaggttaataaaaatgtctgagggatattaacacaaatgatttttaatgcaatagaattaaacaaagcctaattttggctttgttgattcttgctaatcatttttgttatttgagcaatagtcattatttcttgcttaccactacctttttcagcttcttttggagctatcttaatttgaatatcaactatatttttgtagatatcagtaagtagttttgtactattgtttatagtatcaactaatgttgaataagccataacagcttgattagaagataaaggatcagctaatatattattcgaaataacttctaatatatcttgtcctcttttaatagtattaactaaagattctctcattaagttaaaatcttcttttaaatatgtgaattttagattttcttctggattagattttattaaatctgatttttcaacttcaactattgttttttctgtcacattaaaaatatcatttattttatctaatttttttcctaatgcttctgctttttctttcatgagaattctaactccatttcataaatattactttgtaaatcaaatgaatttactgcttgaatacttaactttaaggtacctttatttttagcaaacacagtaaaataatttaattgttttgatataataggattaacaccattatcttctaatacatttataataaacttaatattatcatcagtatcatctgtgtataatattctatattttacattttcttgaataggtaaatttttaacttcaccttttacaccatctataactggctttactttattccattcttcaccataatctattctaacaaatgaatctatatccatcatatgtgtattttcatcaacattaaatttatgcactatttctttactatcttcagagaaatctacaactggtgataagtataatttaacttgttgaataacagcaccatttttaatagggggatatatattcccgtgaagtctcattgtaacattagcactacaaactcttatatcagctccatcattttcatcaggtaattcataatctacactaattaattcaacttgtatagttgtaggttctgttaaccattctaactctctaacccttaaattaatgtttgggttaaagaaaggtaaaatttgctctaatatagaagttaagtccgttaaagaccttgtagctatacttaatacaaaatcaaaagaataaggaacacagttatgttgaaaagttatattttttccgtcaatatcttttataggtatttgaaatctacttgtagctctttgatcatctctttccatactcattaaagctaaagacattctaggtaatatattaaaattaccatttaataattgatctaactctgtatcactaaagactgaagcagcatctttacttccaaaactaataggtactgtgacatacttatctgttttttcatctattttctttttaacttgtatactgttgaatagactgagtagtgattttgtgtattttttagttgttttgaaaaagaaaaactccatttaattttaccgaaaaaacacaatttttaaataaattaggttatgaggttatttcagaaaatttatcaaataacttagaagtaaaatgtaaaaatggacatgtttttaaacgaactttaaacaattttaaaaaaggttgtataataagtgaaaatatttgtgatgaatgtgctatatactaactttaaagaatgataaagaactagacttctacttaccaggacataacttagccatagaatgtaatggagactactggcattcagaaagtaatggtaaagataagaattaccatttagataagactaataaatgtttggaaaaaggaatacaattactccatatttttgaacactcttggattgaaaagaaagaaatatggactagtattattaataataaactaggaaaatcagacaaaataatggctaggaaatgtgttattaaagaagtacctaagacagaagagaaagagtttctaaacaaaaatcatctccaaggatttgctggtagttctgtctgttatggactctactaccaagatgagctagtttgtcttatgagttttggaaaacctaggtttactaacaaatataattgggaattaatcaggttatgcacaaaaatgggtataaatgtaataggtggtgctagtaaattattgaaacatttgggtcattgataagttattcagataggctatattctgatggttgtgtttataaacaattaggattcgaatttagtcatctagacaacaatttatgaaacataaattaaaagataaactagagaaatttgatccaaacttaactgaatcagagaatatgaaattaaatgggtataatagagtgtgggattgtggtcagggtgtttggataaaagattaactatctaaataaccaaacacactatcagttcctttaactaaaggactttctttatcttgctcttcttttattttatcttttgagttttctgcactaccaactaaattaaaaatttcatctaaagattcattaacttcttcattattaacttcttctaaagttggtatattatcatgattataattaaatgatttacatcttagcatataaacattttttgaatttgaataagtaaattggttattagcaccaggcacttgatgttcaatacttgttatttcaatatatttcccacttggaagcaataatatatcaccaacagcagatggtattttagactcatcttgaaatatccttttcattgtattagcactaataaaaagattcatagaatccattgtaaatataccaaatttatttaatatatcccctctttcatcaaacatttctgcattttctggtaatgcaaatatctgatatgttgcttcggtcccataatttattatatcatctagaactttatcgtgtcctaatcttgttgtttttatatatgttagttgaaacccatacatatctattatttctgctgatagagtaccaaataattgatactcattttgtctattatttaagttccaagccatattttacctattgtatttcaatacaatgtaagaaaatagattgcccatcattagtattatctagtggatgttgaactacatcataccttaaaaaatgaaaatatgattcagcaccacttgtagcgtcaaaagcttttgttatgttataactataaaatgcaaagcaagtagaaccatcagctatttcgacttctttatttctatgcttataagaaattagcatatattctttatttaaagcattataataatcacaatatatttctgttgcacctatggatcccatgaaatatgagtttgtgaaatcttcatttgctttaaaattaggatgtgacatcaatttagcgcaagtttcatatggtgctgtaatacacatagttatagctcttttggttgaagcagccatttccaatatttttttctgagctgcattaaataattctataccaactaatggatcattaggtgcttttaatgttaattgtgtttttgttgccttagttgtcatcatttttaaagctgaaaaatcaatttcttgaataatttctgttaaaagttctttttctaatatatcttcaacagttgttttaccagtaagagcaactaaatcggtaatagcttctattgaccattttgatcttatttttttagtttgacagtttattgctctttttacaatttcataattcatttcagcttttacatcagtttcctgattattagctctatttccagcaaaatcaggtaaaacagtagcataaggggtgcttcttttatcagttccagtataatctgttaaatattttcccttaaaagcaaaaatactgccattaggaactgctacatttattcttgctcctattctatttaacaaagattcggtgtatatacgatatattaattttgcaagttttaattcaacaccagcaatatcaactgttgtggttgattcatttataaccttactcatatctttcctttatttaagtatattatattatttatatttattaagatgactttaagttattatatgttataataaaataaaaaggaattatatggattacttaaaggaagaagatttaagagatgaaattgtaaaattacaaaaggttgaaaagctaaaagaattactaaaaatagaaaataaaacagatgatgatattcaacaaataaagaaattaagagaagaagggatatctgaacattataaaaaaacaaaatttggtgaaatgtgtttgcttctaataaagcacatattaaccatgcctaaattcagtggatatacatataaagatgatttttattcaaatgctactgaaaagctaatgttgtatgtaatccctaattttgatgctaataaagtttcaaaaatatccaaagaaccagttaaagcttttgcatattgtactcaaataatagttaatagtatattacaagtaataaatgaaagaaaagctgagcaggaactattaaaaaactattatactgattacacagaattagaattacgattggaacagaaagaatatacatgctgttataaaactgatgatgaaaatataaaatatgatgtagaaatatatcctattgttattataaatgataaactgtatattgtagaagatattaataaaaaagttgaaactgatttaaatcttgacacttcaaaaagatattttattgtaaatgaaaatattattcaatctaatacactatgggatattttgaaagatattgataataataaaacagtaaaaatgatatatcatcatgactatttattaaaaactgatgagtataacaaaattactgggaaaaactttaaaacattagatatcatgaagtttagaaatatatatgttcctagttttcctaaaaaagagaaaaagacagtagaaagtgagttagatatatgggaaaattgatagctttaatgggggacttacattttgggtgtaaaaattttgatcatgatattcttgaagtacaattaaattctctagaaaaatatagagacattttaaaagaaaaaggttgtagtacaatatatcaattaggtgatatgtttgataatagaaaattaattgatttaaaattattacatactttatcaactagatttaaaactatatttgaagggtttgatttttatacatttgctggaaatcatgatatgtataacagagataatagagatattgtttcaagtgagttatttgctgatttacttggaataaaatatattaaagaaccatcatatcatgtttttggcaaacacaaaataggaatatctccatggttatgtggtgatgaagagttactaaaagaatgtgatatattactaggtcatgctgaactaaaaggatttaaatataatcatacaagtattgctgaagaagggttaaacattgataattcaaaatataaaaaagtttatatgggacattatcattttaaccaaaataatgtttatataggaacaccttatcagatgacttttaatgaggttaattctatacctggtataattttgttaaatgaaaacttagaagaagagtttgtagaaaatacttgggataggcgacattttactgttactgttttaaaagataaagtaatcttgcagtataaagatgaacctgagttatttactggcaactttcctgatttttgtaaagtaggaaaaataatacttgaagaaaaaaatgaaaaagaagataaaatattagaatattttggtgctagggcaagaataagcaaggtattctacaaatatgaagaagaaaagttatatgaatctgttagtttaaataactctgttgccgagtcattagattttataaaagaatatattttgaaagaacataggcatttagagtcagtattaaatgatgttataaataattaagcttaaattaagaaaactgtgatataatttttataaatcaaaattaaaggagaaacaatgattattaatgttgataaaaatatgttccaagaaagaatgcaaaaacaagggctaagttatggtgcttcagatgttcttttcgactatataacacaactagaagatgatattggtgaacagattgaatttgatccaattgctattatgtctgatttttcagttgcagaaggtgaagatgagttaaaaaatgaattggaaaatcttggatattttgatatggaagatgatgattcagatctagatgatgcaaaacaaaaagctataaatgatggtgtcttagtctatgaagatgatgattgttatgtatttaaaagctaaatgagtgattaatcactcattttatttttgaaaggaaagaattgaataacattaattttaaatctataacactgcaaaattttatgaaatatggaaacaaaaaaacaaaatttgaatttactaatggtattcatttggtaacaggtaaaaatggtgctggaaaatcaagcttatttttagcattacattattgtctttttggtaaaacatataatggtaagacaataggatcacttgttaataatatcaataaaaaaggaatgtatgttgaagctgaaatgaatattaatggagatgagttcacaattaaaagagggactaatcctagcatttttgaaatatacaaaaataatgaattaataccattattaagcacaaattcagcgtatcaagaatttttagaaaataatatattaaaatttacagaacaagcttttagaaatcttatatatttaggtggagatttgttaagtcaatcatttgtaaggttatctaaaaaagaaaaagaagatgtatttgctatactttctgatactgctacatttttagaacttactgaaaaaataaaacttttaaaaaaagaaaaaactactatacaaacaaatacattatttaaaataaacactttgcaagatgttatatcaaaagcaaaaataaaatacgaatatgatttaaaagcttataatgactatatagaaaataaaaataataatattaatgaaattgaaaataaaattaaagaagaatctggaaaggttgaaaaactaaaagaattaaaaacacaatatgatagtatattaacacaggacccttctaataaaataaatgatttgttaaaaattataaatgagcaaaaatcagctttacaattaatggaaaaatataaaatgtgtaaaggttgtgagaaattaaaacaaattattccaagcaacattgatgtttctaatcatgatgatttattaaaacaattagaagtattacaaaatgaaaatgaagtatatattaaaaacaaagatgatatatatacaaaaatgttagaattaaaaccatcaatagaaaataaaaaagtatatgaagatttattagaaaaaagcaaagtagaacacatagaaaaaccatctaatgatgatattatttcaaatgaaaaagaattacaagaaattgtaaatgagtataatgagatcaatacatatatttctaatttaaatcaacttgaaattctattgaataataacaatttaaaaggtgcatttttaaatatgcacttaccatttataaacaaaaccataaacaaatatataaatatgtttgatgagtttaattttacatttttgttagattcaaacttaaaagaaacaattactaaagataataaaccatttgaatataaatctatgagtaatggtgaagctttaagactaacattttctataatgttggcttttttagatatttgtagaaataagtttgatgtaaaatgtaatttacttatacttgatgaagttttagatagttctttagatagtgtaggtaaaaatgagttattaaaaatattaacaaagaatactgacttaatgagcatgtatgttataagtcataatagtgaaattaaaaatcaattagattattttacatctactgttaatattattaatgatggtaagttttctgaaatagaatataaataatgttaaaaagggagatcagttaaatggcatatggtatagataatgtatggtcatttgtaaatgattcacaaactggcatagacaaggttccagtcaataaaataatattgctaaaaagtgaaaataaattatatttaaaaaaacaagaaggtggattgacagctacatcaactgtaaatgaagcaattcttaataatagtattgtatcattatcaagtgatggcaatttaggtgtagttgatagtaatatcaaagtaataaatgatccagaatttaccacaactgataatatcagtaaaggtaaaaaaatgttcaaaatagcaattgaacctgatacaataattcaagttctgggattatatatagaaaatactgcaaactcatcaatagatgcagtaccttttgactacattattaaaaataataatgtagtaatatatactgataatgatacaattcctataaaaaagataatttattcaaaaacaaaaagcagtcaattaagtttaagtagtttacctaaactattaacagagaatcttgaatggactgttggtacaaatggaacattttcaaatttagtagatgcattacaagaagcttcaaaatatatatctgtgacaaattataaaattactataacaatgaagtcatcgtataaattaactgaaagtcttcatatcaataatgcaaatttaggacatgttgttttaacatcagaagatgattatgttgattttgatggaactatgacacctaatcccgcttttataaatcaatacgcagcaaatcctattgcagtttcatttacatttggaatatctccaataatatcgtttaaacttagatttagttcagtacctactatgttttcgatggcatttggattcttacaaactaattttaagcttaataattctggtgtatataatgcaagatggggtgttggtagtgttggatgtataggattagtacaaaacagtatatttgaaaattgtactgaatcgggtgtagtagcagacaatggtagtatattaaatgtgtggcaaaataatacatttaaaacttgcagtggaaatatactatggagtgctgattcaagtaaaatatatgctggaaatgttacatttgatggaacatataataatgtagctgctaattgtggtgtttcgcatattgcatctgaattaggatttaatacccctatatttaaaaatatttcaaacagtaattcatatgctttatttgttggttggggtgggagtatttcatgtggtagtaatatagttgtatctggttttaataaaactaatgttgctgcaaatgttttttcatctagtggttatatacacttatattagaaaggaatcataaaaatatgataaattatggaaattcaaatataaaagaaataattaatggtagtgttaaaatattaacagagagcaaaaattataaagaaggaggaggggggggaggtctccaaattatcagatgctttagcaaaagcactcgaatatatttcagttaaaaataattgcaacataaatattatattaaaatcaggatataaattaaacgaacaaattatcttaagaaatgcattagcaaatcatataaatatattatcagaagatgatgaaatattgcttgataattttgataccgaaaagtatatctttatgttaaaattaaggttaatgctataggaactaaagcaaaaggatgggactttagagaaagttctgttactatggttccttcaacatctaatgcatacaaatatggtattaaaaattgttataaaaatgcagttttatcattatcttctaaaattgttatatccaaatatagctttaccaacaatggtaacaatttagatggaacacaagagcaatcattattatattgtaatgatcaaggtgaattaacgggatttgatttaaaattagataataatggtagtgaaaactgtaatggatggttatattattgtggatatggttctaaaatgacattaactaattcatcaattacaaataataaatctgctgctaatatattaaataataacaattcttatatgaatctacaatatcctaattttacaggttcaaaagcagcaaatttattattatgttataatggtgctcatacaaatataacaggtagaaatgtaactaattgtacatggagtaaatatgaattaccatttgctaccaatactgttacagccaatggaataattcatgcttaaattttgatagtatttataaatactatcaaaatttataaaggatttataatgctagaatatggtagttccagtataaaagatattatagataatactcctgaacttgcttataacttggagttcactataggtaatggtggaaattttacaaacatactagacgcacttaattactgtaaaagatatattaattatcctaattatgcaataactttaaaattattaaataatcttactattaattatactattaacattgcaaagacagattttagaaatttaataattgatgggaatggatttacaatatcaaaatattgcaattcacaacttgatactgtattttatggtgatatgtctatttaccctgtaattaaaaatctaactgttgaaaatacaaataacaggagttttggtgtagcatttgctaattatcatggatccatatttgcatcacatgcaattgtagaaaataacttaactataaagaatttttataatggtattagacatgcatgttcatatttatttaccccaggattaactttagataattgtgaatatggattatatgcatttaggaaatcagatacttgtttagatgcctatgtaaatattaaaaattgtggaactggcatagctgtttataatggttcagaagttgtagcacaaggtgttacttttgctggcaatactacagattgtaatataagttataatacaccaactacaaatggaactatttggaaataacttataaataatataaaaataaggagaactataaaacatgataatatctaaaaaaactctagctgatcaaggtcaattgaacaaaaatgttatattatgggcaattgatataggatcagagttagcattactaaataggcctatgacagttagacaaaattcagagaacatgatggttgaatatattgatgacattacacctgaagaaattgaggctggaaaacaagcaattaaagaatattgtatatcaaataatattatggatatatattatgattttttaatagcaactactcaggaaagtaataaattagatatcttaaaagagaagaaaaggtatgagatccaatcaaatagagataaagctctagaaaatggaattgtatataatggtcatacttttcaaacaagggaaaaagataaactaaatattaatggagctgtaactaatttaatgcttgatatacaaagtggaactaattcagtttctgaaatcatttggattgacataaatgatgaaaaagtaacttttaacccacaggaatttttaaagtttgtctcaatggttgcatataacacacaagagattacttttaaagccaatgttttaaaagcaaaaatagaagcagttaaaacaattgaggaactggaaaaaatacaatgggatgattcagttaaaacaacacaaaagaaaagataatacatgaaaagtttttcagataaaataaaatactatttttttatatttagatggtttttaattggcaaatatcactgtgatattccacagagatacaaaaagtattataaaatatcacacagaatattatggttaaacattctattctgtgtgatttatacatggtgtgagctgataggacttaaatgaattacctcctagagttaagtcctatttttattgttggactaatttgtggtttatctaattatttgtctgatgaagaagatacttgtactggaaaacatataaaatgcatcttgaaatacatttttaacagtgctgttttatgtactataatttattgtattttaacttcactagaattgccatatcttacaaaaataggtgtagcaggtgcaattacatacttaggtatagataaagcaatgtcacttattaaagaatttatacatttaaaaaaatgattatatgattttcatataatcaaaattaagtgttatatctaaggttatgatattattatcagttgtagaatattccaattcacttacctcatctaatttacttttataaaattcaactttaaacaaaaacttatttttagaatcatatatttctaaccatgatgtagcttcaatgccacatccagtatttgtagaaactttattatacttattaattaaattgacaaagtttttccacacttctaaattttcatctactaacagcgtcaatgttattgaatcaaattttgctacttcaccacctaatgttaaagtaccagttgaatgccctactttttgtccttctaaagatattctaggtaatttaactttttgacaataatattgagtatcatcagaaaataataatgtcctaaaaactatatttgagtttaaagcaatatttctaaagttcatattacacctttttacattatttatttaagtattaattaagataaatatggtataatatttcaaattaaacttttaaaggaaaattatgtattttagtctcaaagaaacattagagtttctatcaattaattcaaaaaatggtgtttgggaatatgatgatatttcagaagctgacacaactgtgttttgctcatatttttcaaacaatagtgatgagaatgacatatatattgtgttaagcaatcctactggtaaatcagatatagatttacaaggtaatgtaacagatacagataatgaagacggaatacctgataaattttcaacttgtattatgaaggttaatcttgcaaaactaaacattagtaattttgatgaattgggcaatgcaataaaaagatatagattataattaagtttaatttaaggtttttctggtaccattacggtatcagaaaattaaggtttatataaaaccacaaaatgaaaggaaagaaaatgaaaaaagttctatgtagtgcggttatggttgcaggtttaatgtttgtaggttgttcaacaactactccacaacaacaatttgctaaacctatgttagaaaaacatgatgatttacctagttgggttaaagagtatggagatattaatacagctgttggttcagcaatgtatataggtcaaaattatattcaacaacaaacagaagctattgcagtagctaaaatgaacttaacccaaaaactatcttcaaaagttgatagtatgatcaaacaatattaccaaaataaagggattgttaaaactaataatagccaagtttcagtacaagttagttcgtcattagtaaaaaatgtaaaagtagttgatacttatgttgcagatgatggtgagctatttgtaaaaattgaagcatatagtactaatttattaaaaattataaaaaatgatgatagtgagtcattatttgatgaactagatagaagagttggtaatgttaaatccaattaatgtaaaatattgggaaattattcataataaagaagatttaggaatacataaatctgatgattataactgcaaatgtgatgtttgcggtgattcaaaatataaaaataagaaaagattacatctgtatagaaaagattcctatacagatgattctataaaatgttttaattgtggttatacagctactatgtattcttacattaaaacttttcatccaatgtaccttaataattatttaaatgaaataggtgaaaaatacatagatgatttaaatattcaaaatatagcactgactaaaaaagaatcacaaaaacctgaagagttttttaatttaaacttacctaaagctagttgtataaaagaggcaaaagaatacattttaaaaagaggtggaaaccctgatgacttttattattgtaaagagtcatttgtaataaatgataaaaaatttaaattaccaaattttataatatatttaaatactgtaaatgataatgcttttagtttttatagtcgtagtataaatgataaaatattctatatatttaattcagatgatggttttaaagttatgaactattttaatattgatccatcaaaagaagtatatgtgtttgaaggtttatttgatatgttatgtacctcatttaaaaataaaatagctatgttgggtgcgactttaccaaagaaaatgaaaactatgccatacataatatggtgttgtgataatgatgaaactggtagaaaggaaatgctaaaacatacaaataatccaaatcataaatttgttgtatggtgtgatgatgaaaaattcaaaaaatataaagatataaacgaaatttatcaaagtggtgttaatattgaaaattttataaaagagcatacttttgatggattaatagctgaatgcaaattgaggatgtggtgaatggatacatttaaaagcatattaatattgttgatatcagcaataatgttaaaagtttatatcatattatttttgataatatcattaggggttttatattatgatttaataataggtataccagtaacagttatattaatgtttataagcatatgtttagcaaataaatttgaaaagtttatatcatgataaaacttataattggtcctatgagatcagggaaaagtttggagttattgagagaagctgaaaaacttcattttggtagaaaaaaatacattttaattagaccagaaattgatgatagagaatttatatcaagaagttataaaacattacataatttaaatgtaataaaaacaaataacataaatgcaattgtaaatgagtatgattatatattactggatgaatttcaattttttgataactcaattactaatattataactgataacatcagtaaaaactgggtattatgtggattaaacataaattatgaatcaaaattatttgaaaacattataaatattttaccatatgcagatagaatttataagttaagctcaatttgtgaaaaatgcggatctgaatatggcaatcataacatttcaaatacaggtgaaatatgtgttggagatgattatacaatattatgttctacttgcaaattacaattaaagggttaatatggaaaatataaacaaagatcttataacaatttacagatatggtaacaactttgaattatacaatgattttcattttatttttgactttgatgtaacttctaaaggatttacattagaaaaatatttggttggaaataatattataagaataccaaaaggatttagaactgattttggtagtattccacaattatttcaatcaataatatcaccagttggaaaacctactaaagcttatgtattacatgattttttatgtggaaaatcaaataaaggtgatattcctagagctcttgctgatgaactatttttggatgctatgaaattacttggtgtaaatgttataaaaagatatgttgtatgggcttgggttagagtttatggtatagtttataaaccacttgcaaagttctttaaagacatatgggataaactatgaaatttattgaatgtatgcaaatattattaggaaaaaataattcaataggttctttatctttagaaaatgattatattaaaatatataaagataatggtaaattaaaaattgttgattcaaaaaataacaatgttttacttaactctgaagatattaacaatgaaaattgggaaatagataataagttatttgagctaataccgggatcaatgtggataactgatgatgatattgtaacaaaggttgaaaacaactctttttatgataacattcaatatacaactttcaggaatatgctaactaatgaaataaatattttgaaatctaataattattatactaattattgcaaaaataaatggatccaaccagaaccattaaaaggtaaaggagttatatgaaagtatatgattgttatccaacttatcttgggtgtaaaagatccctagctgttgatattgtaagcaaaataaaagaaatgtatccaaatactaaaaccatagtagatgcatttggcgggtcaggtgcaatatctatcactgctattcaaatgggattgaatgcattatataatgaaaagacagaaagagttgctagagcaataaaatatttagctaatggaaattttgatgacataacaacctttatgagctatgatgagtattgggataatataatatctaataatactttaaatgactctgattgttttaaagtctcatttatgtataattttactggtagaggtaactgctatattataccagatgatgaatttaaaaattttagaatacttttacagaaatttgtgtgtaaggatagtgatccacaattattatacccatttcttaatgataattttcatagtattataaatgaactatattctatagaaaaaccaataatagaaagatataatgatattatgccaataattaaaaaattagttttaatttcaaaacataatttgtatcaatattttaatgcttctatagacgagttaaagaaaatatcttttaaaatgttgcagaatattgttggtgatgctgaagcagcatacatacttaaaatgtgtagaatataccctattgaaaaaataacatttttaagaaatcataaacatattgatttttcaaaaatggaaataagcaataaagatgcgtttgatcttgatttatccaagtatgatcctgagactactgtattatattttgatccaccatataaaaatacagctaaatctggtaattatactgattttgatagtaatacattacctcttttgtttgacaaatttaagcagtttccaatatttctaagtgaatattcttcaaatatagaaggacttcaagaaatatacaccaaaagtatacctcattttaatggtaaagagtatgctaaagaggtcctatactttaagtcacctttaagataacttttggtataataccccaaaaagatataaggggtattgtattgatgtttaaatatgaatatgtttttgaacataattttaagctatatgctagactttatgatgaagttacaaaaaactcaattataaaagaatacaaatcaactgaatatgtcccagaattgtttattagaactaatgaaaaaacagaatataaggacttctatacacatgggtatttaaaaaagaaaacatttaaagcaacatatgagatatatcagtatttaaaaaatgtatcaccttctacaccattgtatggtaatataaacagacctcaaaaatatattcgtgaaaacttcaaagatatagattgtaatcatgaattcagaacacaatatctagatatagaaactagggcaataaatggttatgcaaaaccatcaaacccaacagaagaaatatctttaatacaagtttatgataattatttaaataaatttataatttttggtactaaagatttagatattaatttggaatcagatataggggaagtaatttacaaaaaatgtgataatgaaatacaaatgttaaaaaaatacttaacatttgtagttaaaacaaatcctactattatagctggtttcaactctaatttatttgatatcccttatattgtaaatagaatgatccatcttggcatagatgactatgttgagttatcacctataaaagctataacacataaaaaaatgaaaactaatgatgatatagagtatgatggtgttaagatagaaggtataattcaattagatttgagagatttatatataaaatacacaactcaaaaaccaagtagattttcattggatgaaatatccaaacttgaattaggtgatactaaagtaaattacgatggttcaatagaagacttgtataaagattttaataagtttgtttcttatggtttaaaggatgttgagttacttataaaattagaacgaaaattaaaattattaaaagtatgtcaattagtagcatataagtgtggtgtaaatgctgatgaagtttcaggcacccttatgcaatgggcatcattaatgtataattatgctttatcaaaaaatgttatattacctttaaggcaattaaaaataataaactatgatccaccataccctggaggatgggttagagttattgaaggactacacaaaaatgtatgttcatatgactttacatctctatatccaaatattattatcgagtttaaaataggtttggataattatattccagttagcaatatcccatatgagaaagctaaaatacttgaagaaaatagagcaaggtttatgaatgaggcaccaaatgaagttatttctacatcactaccagaagaccttaaagatatgttaaacaaatatttttatttctattcagaaacctataataaaactaacaatgatagtatggaggagttttattattttaaaaatattattgacaataaggatgaaataaaacagatatgtaaaaaatatggtgttaatgttactccaaatggatgtttatacttttcaaatggtacttcattatttgctgaattaatagaaaattttttcaaagatagattaaatcataagaattttttaaaaaatgataatttaactgcttctgaaatagattaccatgatcttatgcaatatatgtttaaaattcttatgaattctgcttatggctcaacatcactagcaataaatccttttagttttggtaaaaaaatgagtgaatcaatcacaacaactggtaggtttttaaatatgtgggtttcatataaagttaataagttttgtaatgaaacatataatttaaatattgatgttaataataggcctttaagtattcaatgtgatacagactctaactattttgagtttaagtttctagaaacacctaaagatttacaagaaaatgccaaatttttgaaaagttattgtgaaactacaatatcacctgttatagatgatgctataagtgaagctgtaacagctatcaatggtttagataaaaatagtaatcttggaatggaacaggaaacaatatgtgatagattaattagttgtgctcgtaaaagatatgttgggagatattttaataaaaagaaattaaataaagggtttaaaataactggccttcctatgattgataaaacaactccaaaatggacaaaactaaaattaaatgagtgcttagatttaatacttgacagtgatctacatgggttaaggcaatttattaataacataaaggatgagtttaaacaacagcttctaagtgatatttgtatgaataaaagtgtaagtagcttatcatatattgtatcaaatggtaaatgggtttcatcaataaatggtaatccttgtcctattcaatctagaggttcaatccattataataatcttacaaacaagtataaacttaaaaaaataatggaaggtgaaaaagtatatattgtctatctgaaaacaccaaatgccattactggtgataatgttatatgtattcctgatgatgaaattgtaagagaaataccaagtatcagtgaattcgttgattatgaaactatgtttgaaaaatattttatacaaaaattagatattatgagtaaacatataggatttgattataaaaatatttttgtaaatacattagatgaatggttataatttaattatagaaaggaaataaaatggagacaaatacatctgttgtgggaacacttatagcaattgtggcagtattagttatagtatcagttaatattacaacatttttatatagtaaaaggaaaaaatgatgatttaactataaaaaataaaaattgtcaatttctttttgtttcagatttttttgaaaatttgagaaatacacgaaattatgaaacattaaattgtaaagactatgaaaacgacattaaaactataaatgaaaggttaaaattatgaaactatttgagaaattagaaaaatggttgaaagaaagacatttagataaaaaagaatatgatcatttaactttgttaggttatctacatgaagagatagatgaaggtattaaaaaaagggatagtgaacatgaaagtatagattggagatgtgattgtattgtattcttaattaacagtttatatcaagatggatacaacccaaaaaatatgtatggatgagtgtttaaaagaaattgaagaaagaacaggtgagtattcagaaagtgaaagaaagtttaaaaaacatatgggtgcttatacttatgaagaagcactagatgaagtagtaaaaaattacaattgtagaaaagaagatattactcttcatggagatcatagggaattctggtattttttggttaatggtaaacaaataaaaataaagaaatggtataaagctgattattcaaaatctataagggatgatataagtaatgaaagacatatcactaaagcatataaattaggtaaaaagattatgttcaaacagttagatacaaataatgaatggcagcttttaaaagatggaaaccttaatttcaaagaatttgactataaaattgtagattaagtttaaattaagtatattttgataccgtaacggtatcaaaattgaaaggactgaaaatggaaaatattaatgagtttgtagaattaaaaagtcagaaactaaatgttactgattttattgaaaaaaatagtattaatgaagatgagctagtcaaaaatgccatgaaacaaatttttgatttagagaaacaaaaaagagaaattgatgttgaaataagagatattaaagcaaaattatccaaagatggtataaatataacagaatttaacagggttctatctacattaaaaaatgaacttaaaatgagtatcgatagtttaagtgctaatataagcatgtataactcgatagtatccgataaagaactattacaaaacttaaaagatcaaattaacgattaaaggtgaattatgaagtatagatattcttattcaagattagagtgttttagacaatgtaaattaaagtttaaatattcttatattgataaaatatctgtacctaaagatcaaactgcacttattaaaggaagttatatacattggctaatagagcaaagttttaaagaagaacctatcgaagtaagtaaatcatataataatcctttaataaatgcagatcaatataaagaatataatgagatatttgaaaagtttaaagaaacagaaaaatacaaaaatataaaagacttaccagctttaggaaatgaagtaaattgggctttagataataagctaaacccaactaattattatggtaatgactatgtcataagaggcactattgattacattgctatcaaaaatagatgtgcaataataatagattggaaaacaggcaaaacaaaagataaaaaatatataccagatgcaaatcaactagcattatatgcaatatgggctgaaaaagtcttaaatgtagataaaataatatgccagtttgtgtatgttgaaactaatgattttcacacttacacttatacaagtgatgatttgatacctataaaaaagcaatttgctcaagatataatgagtattgaaaatgaaaaagcatttatagctaagccaagtatattatgtaattggtgtgaatttaaatcaatgtgtgataattttaaaaatagtagttataataaggagtaaattatatgaatattgataaaaactatttaattaaaggtgacaacttagaagtaatgaatagtattttacctttttataaaggtaaagtgaaattaatttatattgatcctccttataatactggaaataaaaatttccagtataatgataattttgaatctatagatttaattataaaatattttaatgtagatgaagaagaagctaaaaaaataaaatcacaagataaattcataggttctaaagtttggttaaaatttatgaaagaaagattagaagtagctagagaatttttaaaagatgatggtgttatattcgttcaatgtgacgataacgagcaagcgtatttaaaagtacttatggatgagatatttggtagagagaattttgttaattgtattgtagtcaagatgaacgaatctaaaggattaaaaaatgctaattgtcataaaaaattaccgaaaaataaagaatacatactactttataaaaaacaagataataaatctatattaaaacaaattagattaaaaaagacacaaaatgaattatcatcatatattaaatattataacaaatacattccaaacattggaaacgattataaagaatgggaaataaaatattttgatccaaaattaaataaacaagattattttaaaaacttgatatatttagtaaaacctgataataacattaataacattaatatggaagaagggacttttgaaaaaataataaatccaaaaggtaaaacaaattattattatatgaataatggtgtaattatgaaagttttgtttttaaatgaaaatcttgattattctttaggtgatttatggacaaacatatctacaattggcatatgtagagaaggactgaaaacaacttttaaaaatgggcaaaaacctgaatacttattaaaaataatattggatctttctacaaatgaaaatgatcttgtaatggacttttttgcaggaagtggaactactttagcagtagcacataaaatgaaacgcaaatggataggtatagaacaaatggattatatagaaactatcacaaaagaaagacttaaaaaagttatagaaggtgagcaaggtggtattagtaaagaagtacaatggcaaggtggtggagattttgaatacctaaataaggaacatgatgatactaacatttgatccttactatgatataaaagaaagtaatgagtttataaaaaacttaaaagaaaataaaataaactttaacacatatattttatcgaaatcaccttattattggttttatgaagttgcagacaaatataaacctgttttcttaaagtttaatgaggctaactcaacagatttaagatttatgcttcctaaaattaaagaattaactccgagcgatgaaaattatttaagaagaataccaaaaacacctagtgattttgaaagatatgtaagtccaaatatatttaaaaaagcaaaagatgctgaatatttttgtgtatttaggtataaaagtatctctgagataaataagatcactgaaacattaggtataaaagtttatattttaccaaaaaaagtaagagaatggaatatagctttcacttttaacaaaatgataagaaactttgtatttggacattatattttacttgaaaagactaaaaaaacacaatttaacaaagttggtgaaatagaattatacttaaataataaagtatttgttacagataaaatgaagtttaaaacaagagatttaccatttagtgaagatggtacatattatcctcttaaatttcaaataaaacaataattaaggaagtcttaaggttattgtgatacgattacgaatataaaaattaagtaagggcgagtagctcaatggagcaaccggctcataaccggttggttataggttcgattcctatttcgcccaccatttttaaacacaattaagattttttaaggaagttttaattgtgtttattcgattatattgtgagagtatcggtttaattccgatcccaaatggcagtttgggaagtttttgagtaaaaacacacaatataagattagataccacaacttcaataactctaatctattgaagttgtagtgaataaacacaataattattgcagattagcacagcggtagtgcaatcgactgttaatcgatgggtcagaggttcgaatcctctatctgcagccatttataattataataaatgtagaagtaggataattggtaatccaccagactgtaaatctggcgtcttttggcattgatggttcaaatccatccttctacaccattttaaacacaattaagttttcaatgaagatttaattgtgtttaaaataaacacaagtaaatggtactaacagcaaagttttaaggacattactgataatgatgaattctctaaaaagtaccatgattaaaaagggtatttacagcaaattaatattttatgattttatgtgcttagtgattttcagtatatctgaatttttaaataccctgatttttataaaggaaagaaaatgaaatttgttaattctctatcaaacttatcttatacagaaaatggtgctttaacattaagctcttcattaaatatagccctagatttattttttattataggaacaactaatgaaaataatattgacaatgtttttgaaaaagtaaaagaatcatttaatattgataaggaattaacttctagaatattgttatggacaagagatgcaagagaaggtgcaggaagaagagaaatatttaaaagatttttagattttattgcagaaaatgataaggaaatttataaaagaataattagaaaagttcctgaattaggcaggtttgatgatttaataactgataaacaattagacttagtaggaaatgaattaattaaaatactagattttaataatcaattatgtgctaagtggatgcctagagaaaaatcaagtaaatctaaattagccaaaaaattgatgaaattattaaaattaaatgctaaagattatagaaagttattgtcttctaatacttgtgttgttgaaaataaaatgtgttctaaagaatggaacttaatagaatatgaaaaaattccttcaaaagcaatggctaagtataatgatgcctttgaaagaaatgataaagaaagatttgaaaattatcaagaatcattgataaaaggtgaatcaaaagtaaatacttccgcaatatatccttatgaaataattaaattaatgtttaaaaatgatattttagcaaatgaaatgtggaaaaatcaaaagaattggatggaaggttctaagaaaactctattccctataattgatgtttctggaagtatgtatacaggagttcaaggaagtataactgctttaaatatagcaatttctttaggtatgtatttaagtgaaagaaatggtaaaggttttaaagattattttataactttttccgcaaatcctgaaatggtaaagatagaaggaaataatttaagagaaaaatataaatccataaaaaaatctaattggggtatgaatactaatttcgctaaaacttttgatttaattctaaatagagcaaaagctgataatttgtcacaagaagatttacctgatgctctagttattttaagtgatatggaatttgacgaagctcaacaaggtaaaacaaattttgaatatataagagattcttttaaaaatagtggttataaaatgcctgaattaattttttggaatatttatgggagaagtggaaatatacctgtaagaaaagatgaaaatggaacttgtttaatatcagggtttagtccttcaatagtaaaaggtttattaactaatgatttaaaccctgaaaaaataatgtttgaaactataaacaaagaacgatatgacttttaataatattgcctatttttgaggggattgatagttaagacaacggtaaatgtaatcgagaatgagattatagacctaagagcttcctcgtagctcaaacctcaaagatgggttatagttaagtttatcttaagatacattatgatataattcctctaataaattaaaggattaaaaatgctaaaaaaattatgttttataataactctagcttcaagtttatttgcatataattatatggattcaactgtaattgaagataaaggtaatattgttatagagctatcattctgtactaaggatcttgattcagaaaaagagtatattatcgaccattttaataatcaaattgatggtctagaacagcaacaagttaaatctgaagtttatcaatacagaggaaaacaatatgttttcaataaaggtaaaaatgtaaaatataacaaaccaattgttacatttgtgccaacttctactaatggatgctatatagcaacagctttatataaaataaaacatgatgatattaaaacatctgtaaataataaatatgaatcatattttaatggctttataactaaaaacacatctacaaaaaatgaagttgaaaatgaaattagacaaaatcttgaaaacgaaataaaagaaaatattattataaaacctgaacagattaaaaatagtcacgaaacatttgtggaagtaccaaaatatttgtatgcacaaacaaaagaaaactattatattaatattatatgtgaagtaacaaattctgataatgaatttatatataattttgaaataaaagattataaaaaacctttaatagttaaaggaaaaatatggggtgatttaacaccatattttaacacaaactgtaaagttgaactagtaggtaaatgatatgacaatagatgatttgaaaagtttccataaaaaaataatagaagaatatgacatggattcaaactggaatccatcaactataaagcatcatttaacaacattatcaggtacaattgctaaatatctaaattattggagtagattaaaacatattataatacaaatagatgaagaatacaatgaaaaatatatgatgctttattcacattatagagaaaactctaatattaattacacagttacagaaattaaagatttaatttctaaagacaatgaattatgtaatattcgtgtaaaaaaatcaacagctatattaataatggagtatattgaaaaatgtgtagataatttaaacaaaacaagatatgatttatcaaattatattgaaatagaaaaatttttaaatggtaaagggtaaattaaagaatataattatttaaaattgaaaggatttgaattgataaaaatagaaaaactaaacgaatcagcttacaaaataatttctgaaacacaattatatttagatgaaataaaacaactatgctcagctaaaataccaaatgcccaattcttaccagctgtaaggatgggatattctgatggtattaaatatttttataaagattgtggagattatctaattgtccctaaaggttttataaagggtattataaaacgattaaatgaaaaatataaacttgagttatcttttgatgatgaaatagaaaaaattactgaagaagaatttaataagtttgtaaaatcacttaaactaccttttgaaccttatgactttcaattaaaagctgcttttgatagtattaatactggaaacaatatatgtgtaatggcaactggtagtggtaaatcattaactatttacgttttatgtagatggttcattgaaaaatataaaaatacagatgacaaaattttgataatagttccatcagtagtgttattaaaccaaatgtattctgatttcaaagagtatggttttacagatatagacaaatatgttgatagattaggtggtgattttaaggtagtgtcttttgtaaaaaaattaaacatatcaacatggcaaagtttgtatagaaatgtttcattgtttaaagatatagctgttatagttgaagatgagtgtcatacagctgccagtgatgttcatgaaagtataatatttccatccgctacaaacgcaaagtacagatttggatttacggggacattgcctcaaaattattgtgataaattatctttaatggctgttttaggtactgctaaaacatatgttacaccaagagagttaattgatatggggttagctactgaaatggagattaaacctataatactaaaatataatgatgctacaagttctattgttaggaccattaaaaattaccagcaagaagtatcattttttcttggaatacctgaaagagatgacattatagctaaaataatatgcaaagtttcacaaaaaggaaatagtatagtgttatttacaagagtttctaatggtgaaaacttagctagaaaagtgtgtaaattaaaacatggtgttgatgttgaaattagtgaattacgaaaattaaacaaatataacatattttttgtaagtggtgaaacaaaagctagtgatagagaatctataagacagattatggaaagttgtgatgatgctattatttttggtactacttctattatgagtactggggttaatattagaaaattaaaaaatcttgtatccacaatgcctggtaaaagttatattaaaattaatcaaagtatagggagaatgctacgaaaacatgaaaccaaaaataatattgtatatttgtatgatatagttgatgacgctagaggaagatatgcaaagaaaaactatatgtttaaacattatgaagagagattaaaatattataatgaaaatcaatatgttatagacgaggtagttgttaatatataattaagttaaatctaagctacaatattgtacaataacaatttatagaaggggcatttatgaagtatatatttacaataattgacaacacatcaaaaactaaagtattaaaaactaatatcgataataaagttaattttagaaatgttatatgcccttctataaactcatttgcacaacttattgagtcaaattttattctaagtcgccctattcattcaaatggattgtttgaaagaaaacgagaaaacatggattacttgcacgactgtgggtatattatactcgatcttgataaagttactaaagataattttcaaaaaataattgattattttaagaatacaaaatgggagtgtttaatttgtaattcaaggtcatataattttgttgataatttcaatttaaaagttatatgcaagatagactacaaatctactgacgaaaacatcagaaacactttattattctttaaagaacagttaaaaggattatgttcaatagatgaatcagccacaagacattctagttatcaagcaccatctttaaaagtatcagtattttacaagaatgaaaacgatataggtatcccattttcaattctaccaaaatcacaatctaaaacaacatcaataaactgttctaataaacaagtagaatggtgtttaaattatataaaaactaagttaaaaggaaatataaaagagtatgttggttattattcaataaatttgccttcagaaaaaaagtcaaaatattcatattgtttgtatgaaacaaacccttttgttatatttcatccaaacccatcaaaaaatataaacatattacaagagtatttgaaaacaaaagatggtaaagcatttctacaagaaaaacaaagtaaaataatattgtcatcacttaaatacacacctgatatacacataaaccaaaaatttctgaaaaatattgatattcctgatactagagtagtttgtattaaatcacctatgggtagtggtaaatcaaatatcataaatcaatatattaaagataaatcaaaaatattattcattagtgttaggcaaactcttgcaaaagatatatcattaaaatatggatgtaaatattatctagaagataaaaaaatattatatggtgaaaattatgtatgccaaataaactcgttacacaaaataaatctagactactttgattatgtaatattagatgagtttgaaacattattaatgtatattgtaactagtatagaggattcaccatatgcgttaaatatacttagaaaattctacaatatattaaactcaaaataccttttaatattagatgcatttttaagtgatcattctaatattttaagtgatgtatgcagaataaaaaaccattataaagaccaaacaaatgttagcctttatacaaaaaagaatacattcttttcagtattagaatatgtttgtaaaaacaaaaatagaaatgaagttgttacaatgtcattttctacattatctgagtttaaaacggttgagagtcttttaattaaaagtaatttaaaagtaatatctataaacagtaatacaaacagattcattagagataatatatttacagaatattttaaaaagaaatatgttaattatgattgtattttattttcgcctagcattacagtaggtgtttctattatgaataacataagtcatcattttcactttgataatagtgctagtatagatgctatcacatctattcaaatggtaaaaagatcaagattagcatcgaatattcatatttttgttgaaggttctacaaatatgattactccacttgaagttgaaaagaatattattgattcttttgaaatcgatgacttagaatatttaagtgagttttataacaaattatgttattattatgaaactattgaattaaaccataagatgtcattttgtttattattacaagatcagtttagtaatataaacatagttgatagtattgtaaattataatatagttcaagctgatatatctaaggaaatagagttaaatgaatttgaaaacagtaaaattaaagatgaattgatttgtgctatcaaaaaggataaaaattatttaaattatattcgcaattttaaattttatacgctaaataaaaataaaaatgaattcctggaaaactatttgctgaataatccatctaatttgcttgaattatctcatagagctaagtttctaaaatattgtgtaacatatccagatattagattaaaagatatttttacatataatgacatacaaaatataaaatatacaacagattacttttcatttacaaattttctaaaagaactaggatataaaaaaatgaatggtaattattatctgccattacaatatattaaacatttaagtaagatataaatatttcgcataaaacattaaggagaaaatatggtagaaattatgatttcattttttgcaggcggattaataggttttgttgctggatattttgtttatcataacaataaggaaaaagcttctgaaattggtgataaaatagaatcagtaaaagatgaaataattaaaaaatagctaggaataatatcctagcttacaaggatattaatgtattatagtaatgttgtatttccactaaatgaagttattcctggttttacatataatgtaaaaaagtctaaatcaaatgtctatattagatttgttgcttatggttactcaatagatgatcttgaaatagtttataataatagcatcataacaatttcgactattaaagattatcatgaagtaaaaacagacccaaaattttcaaataattttccacagcaggataaattttatattcaattttggtgtccaaaaataagcggaatcaacgcagaatatagtggtaattttataaaattaaactgttcactaggtgatattagtgttaatttaggagtagttcctattaaatttataaatgaagataatgatgttgatatattagaaaatacttctgatgataccatgaatataatccaattaaatggatttatggatgaattagaaggcataaaagatgatttttatagtgaaataacaaacaataaggattaaatatggcaaaattaatattacaaagaaataaagaatatacaggtataaagtggcaaaatagtgataaaatagaaggttctaccattggtgaattatcattattagatgataacgataatgttatctttaagtgtgctagttgtgaaaatataggtcctagtactgatgagtctggaactgataagagaatagtagctagagagtataaattaaaatggtgcaattcaagtaaaaatggattattagctaaaaaatatccagaatggaaagcagataatggatcaaatattgcaatatgggttgtttctgatgaggtagaaggatttaataatagacttattcgtatccatacaggaaatgcaccacagcatactgaaggttgtatattaccaggttctgatttaaataatggcacagttggtagtagtgtagacataacaaatgagttatttacaaaaataaaagagttaggaattgaaaatatagtttttgaaataaaagaaatagattaaggtgtttttaagcgtaagtgttatacacttacgcaaaattaatgaaaggaagattatggataactttgatgtaaattcatttaaaattgttcatccacatgatgttttgttagaagttacatatccatctgagataaaatcagaaagtggcattgttgtaactgtgcacccatcacttattgatgatagacaaacacaaggaaaagtattacaaataggatcagaagttaaagatattgaaataggtgatacagttgtttttggaaaacaacatggtattgatttatgcaaaagcgataaagtaaaatatatgcttattcgtgatgagtctttaatgggaatattaaaataaaggagtgataatggctaaatcgttaagagaatggtgcagaacacatgtaaaaaacatggctgatagttttgaagactttgaaatttttagaactcagttttataggaatccacatagagcaattataaaggattcaagttcctttaaaagcccagctgatggtgttataattaatcaaacccaagtaaatgatattgatgatgaagtccttaaaataaaagggaaaaaatataccttacgaaatgcgttaggaaataacgaagaaatgcttaatttaataaaagagcgtggtggtgcgttagttattgatgtgtttatgacttattatgatgttcattataaccgtattccaacagatggttttttaacatacgaaaaattattaccaacagaaagctataataatgagagtatgttagctgttgaagaaggtttatttgcaaataactttaaaaaagcactaacagagttaggctatatgttttgtaacgaaaggttattaaatattatatattcacctgtattgcaagaaaaatatgctgtagtccaaatagctgacgagcaaattaattgtattcaaacagcatgggttccagcaagaggggaaccaaatacccatttatatcaacaaggggatatttttgggaatattagaaaaggtagccaatgcacaatagtaataccatttagtaataaatggaattatgttcctattttagaacctagtttccatgtagaggctggtattgatgaacttgttagagttgaaccaaaataaaattaatatgttaaaagaatggggattcacccccatttcttctaatttaaattatgggttagaagtaaaatgtgataaatgtggttctaatataaaaagaagttggaaccaaatgcttaagtacaataaatgtttatcatgtgatgataataaattattattagagttaaataatttaggttatgttgtaacggatatacgattatctaaattagagatacaatgtaaaaataaccatatatttaatagaaataaagcagactttaaaaggggtataatatcatgcccagaatgtgacgaattagaaaaactagaatttattaaatcatgtggttttacaaaaattgatgtaaatcatatgagatgtaacaaatgcaataatatagttaaaaagagttatccaactctaaaaagtgggataacattttgtaaattttgtgatgaaaatgataagaaatcgctattgaataatataagtttagagatggttgataaaaatatttttaaatgtaacaaaggacatacattttatagaacttatgataatttaataaaatcaaataatttatgtcctgagtgttatccaaataatacaatgtttgaaaaagaattaaaagaaatactcccaaaatgtatagaaaatgactactcgattctaggtgataaagaactagacttctacttaccagactataacttagccatagaatgtaatggtgtttattggcactcagataaatttaaagataaaaactatcatttaaataaaacagaaaagtgtaaagagaaaggtattcagcttttacatatattcgaatcatcttggatagagaaaaaagatatatggaagtcaattataaacaataaattaggaaagtcagagagaataatggctagaaaatgtatcctaaaacaagtatctaaagcagaagagaaagagtttttggatgaaaatcatctccaaggatttactgtttaataatgaactagtttgtttaatgtcatttggaaaaccaaggtttactaacaaatataattgggagctaattagattatgtactaaaatgggtgtgaatgttataggtggtgcatctaaattactttgttatttccataaaaataatcctggatcattaataagttactctgataggttatattctaatggtgaaatctataaacaattaggattcgaatttagtcatttttctaaacctggctacatgtatacaaaaaatggtagaacgctcaatagacaacaatttatgaaacacaaacttaaagataagttagaaaaatttgatccaaacttaactgaatcagagaatatgagtattaatggatattataaaatatgggattgtggacaaggggtatgggttaaatcataaccccactattcctgtaacagcatctataatagattctgtttcttttttgtatacataatgtgtatatccaaatgttacgctaaattcattaattgtttctgtttgatcatcttgcatatcacttccggtcacatcaataggaaagatatttttatatgtataacttccaacagcattaccactataatttaataaggttaatttcaattcaccagtcatattaatatcagtattaccacttacacctttatttatacctaggaaactattaacagcattaccaacaattggtatatcacttgtaatatcagatataaaacctgctccaatgttagcaactgatcctataatattagcaacaccagcaccaggaactgatggtgtttcttcatttgcggttatacctgaatcaatacaaaaagtccagtactctaatatacgccttacacttgatttttcatctataaaaaatgtcatatttgtagtgttatcaagtttcattaatgttggtatatttatagttctaccatctaaaccaacaggtgtagttaatatagaaggtgctggtaaagtagcacccttgcataatatattaactgcattgtcatataacgcacctgatatttttgttattttagcaggtaaatttaatgacactttatatctaaaaggtctttgtccagaacttaaaacataatcaacagaatcaaacttgtttaaacccattattatgactttcttcttaatttagctactaatttcatggttcttcttagttttggatcttttctaacatatcctctctttttagaagaccatgacatattttcagaaggagcttttgcgttttttttagctcttatttttagttttcttttaacttttggttgttttctatatcttttttgtgctattctatcagctacactcatatgtttaataggtggcatcttaataatccttttttaagatatttatattaatcatcaaaaataccgtaaaatgatgaagtaccatcatcaaaaaatcccatttgtaaatattttacatcaccatcagttgtttcagaatcaccgtttattttatttaaaaatacattataatcaactatattatttaaatctaacaaaggtacaaacaaaagacttaatgccataacataatcatcatgggcctttgagttttgtgcttggtattttccattaacattacaaaatgtcagcaactctttaacagttggttcatcttgtaatattagtttgttattttcaataaaaagtttcatgttactaagatttttacttctattgcttttagttgtcctgactcctaaccattttttatctggctcttgatatatattttcatattcatacatttggaatagtaaatcaaccacgcttgtaccagcaccctcattattttcacatacaaacatagcctcattatatgttcttaaaatattataaaaaataggtggtgccatcaaataagattctggtatttttcctgacgctacttgtttaaaaggaatatttgttacatctattacatgaaatacaaaaccatctattgcaccttttgcagcatcagctagaaccatatatttgtgatttatttgtggggcttcatatactcttattgtttcaccaaaatttggttctcttaaaatatttccaaatttaatattagataaaacggtcatatcaacaagagtatcagaacttcctataaattcacatgcatactcttggttccaggttctaatacctccctcgagagtttttatcataagttctttataattttcatctctgcctggtactttccaccattcaactttaaaaggtttatatgagctcttgccttcaacagcatctgaccacattttataccaatgatttaaccctactggtgtagaagctgctattatttgtgattttttagatgcggatattgtaggtattacagagttactaaattctgaccatttatctataaacgcacaattgtgtgaaacaaaatgatttgtataatactcgttatttttatgtacattaattaagtcatatacatattctactccaacataatctattgaaacaatttttgaaaacttatttttatattttatcaaatcattaattttaagatgttttaattgtttaaaaccattaggtgtttcaaatttatgaccttttgttacttttataaaatcatcttctgttattactttatatacatcttttttttctcttgatatatcatcaaaatcactaaatccatttggtgttagcacttcatacatgtttctcctttatcatattaagaggattaacctcttaataatggaagtggttcacaatagttttctagtaatactgtttctaatctttctaattcagtatttgcttcttgtataattctttcataattagctttaataccacctattaacggtgcatcatattttcctatatttgaaccccaagttcttttgcataagtttaaagcatattctttaacccatggttgctcgtatatcccatcttcttcttctggtatatacttatatctgacttctaacaaaaccttttcagagtttatgtcttcaaaaaactctaacatatttgtaaatggattaaaagcataatttggtattattgtaaaatatgtatcaagtatagacatatttgctaatacagaatatatgttttgcatactaaagttaccttgtactgttccaccaaatagcattgcttgcatttcagttggtgttattactaaaccacctggaatacttaaccctaaaaaacctccgccacttggatatattcgtaatgttataacctcagaaattttagggtctaatttaatttttctcacacctttaggtaggtcaattaatagtgtgccttttaacttaccatacatagcaaactcagaaaacttttgtatagtaaagttaatattctcatctatttggaaatcagtaagttccacagtaataactggggaacctaacattccaaaaatataatctttgagactttgcctagtagccattatcaaccacccatagtgttaacagttacattaagagtttttgatatttgatttccaccatcagcttgtgctttaactgtgattgtaaatgatccagttttacttgcttttggtgttacttgaatcttattacctgatttaacagcttgtatattttgactattaaattctaatgtaaaatctgaagcattagttgtaactgttacttcttgcattggagcacttgcattagcgaaagttaaattatcaggtgaaagagttaaagttgttactactgttgcttttgtaacagttaaaggtaattctttcatagctgttctacctttatcatctgtaagttcaaatatagctttacctgaaccttcttcatttcctgtaaatgttttgtcaccttcattccatgtagctaaatcacttggttctactgttacaacagctgatgtaattgatgacccatcggtagctgtataagttattgcttgtgactttttaccgtcttcaaaagttaaactatcaggtgttaaagttacttgtaaatctggataaaaaacattatctttaccaccaaaaaattgtggaaatttaactgctacatctgatggatattcaaatccaggtaaaatatagttagttgtaccattaatatctatatatttaggtttatcttctgtataagcgaatttattttgttttggtatattagtcatgagtatcctttataaatatttgatattatttataaaggaaattgatggcaaatatgtttaatggtctagttgaatctgtcaaaaaaacctttctaaaagtagaaaataaggaaggttctattaaatcagatgacccacataaagaagccaaccttacaagagatgatattgtattaggttattttgatgaagggaattatagatataataattttgagacggatataattagtgatgtatcaaaacaagcaagcttaataaaagaatacagaagaatagcagcatatcctgaagtcgcagatgctattgatgaaataacgaatgaaatgtcatttgtacccaacaatattgattgttgctatttagggttcaaagataatatattatctgataatttgaaagaagcattccaatcgttatttgatatgtcatgtgaaatattgcagttaaatgaaaacatagatgttttgtgtagaagattctatatagatgggcaattaataataggtttatcttacgatgataacaataatatacttgatgcagttataatgaacccatcagggttatattttaataaatcaacaaacaaatggcagtattttaataatagcaataattatggagtaacagatgacacttctaaagtatatgacccagaagaaattataagaattgattcaggattatactctgataatttaatattatctcatttgcatagtgttataaaaatcgtaaatcaactacaaacattagaagaccttatgataccgttaagatattcaagatctgtgtctcgtagagtatttaatattgatgtcggtaatcttgggtacgaaaaagcaattgcagccgttgaagatattaaaaataaatttaaatataaaaaatattataatacagaaaccggtagtatatcaaatggtgcatcaatccagtctatggtagaggattattattttccaaatagaggtggtacaaaaggaactcaagtagatgttttagatgaaactggaaatttaggtgaaactggagatttagattactttaaaaataaactatataatgctttaaaagttccaacatcacgattaatgggtgaaaataaaactgtatttgactttagctcaacatcaatagaatcaaccgagattaagttttttgcttttattaacagattaagacaaagatttaatgttttattaattgaaattatgaaacgatatgccataacaaataatattcttacagaagatgaatttgataattattcaaaatatatttttataggttgggaaaaagaatccaatttcttagaaagacaaaacttagatatattaaaacagaggctagatctttatactgaatttaaagaatatgaaggtgatatatttagcaaatcatatttactaaaaaatgttttaaaaatgactgatgaagaaatagaccaaatgagagaggaaattcttcaagaaggtagtcaaacaactccaggtgaagatgaatttggtaatgaaatcacagatgatgaagataattttaagaatgatattgaagatgaacctgaagatgaactctctagataatatagaaagtaaaaacttaaaaattaaagatgatatatctgataataaaagaaatataattaaaaaagctacaaaattaggtatacctaaaaatattataaatcaaaaaattaaaaaagctacaaaattaataaaaggagaataaatgtataattatgtaaaatatgttgaaagaaaagacatggatggactttctaatgtaattcaaaaaaagcttcaacaagaatataataatcatccaaaagttgtaaatcacattgaaactattaagaaaaatgaagctttaattaaagtattaaaggagtataaatgaaactaattatagaagaaccggtaaaaataaaaggttcagtagaactaaacgagtctagaggtgaaaaaaattattatatacaaggtatatttgcaactataaatcaacaaaatataaatggtagagtatatccaagacctatttgggaaagtgctgttaattcataccagcatcatataactacccctactacaagttctttaatggaatatcaacatccaaatagacaatatgttgatccacttgaagctgtagcaaaaatagtagatcttagaattgaaggtgattatgttatggggaaagcaaaattgcttgataatccaaaagcaaatcaactaaagaacctaattgatgaaggtatatctataggtgtttctagcaggggttgtggtgagctaatgaatggaacagttacagaatatgaattaattacatttgatatagtgccaaatccgtctgatagaaatgcacatactaaaggtctaaatgaatcttttgataatggtatattaaaagataaaaattatattaaagataaaaatggtatacttgtagaggcagatgaaagtaatataaataacaagagtataacttctcagtttgtcgatttattttcacaattataaaggaattatcatggaagaacttttaagtaaacttgataaaaatgtttttacacctgaagttgttggtgaaataaaagaattatttgaagcagctgttgataataaagttgaagctgctttaaaaatcgctgatattcacgcaattgaagttgataaacattatgaaaaacaagttaaaatgctaaaagaaagtgctgaaatgtataaacaacaggttaataaaaataaccaaaaagttatacataatgccattaatagagtaaaaaaacattacaataagctagttgaaaatattattaaggataaagttgatgaatttgttaaaaaaggatcaatgaaccttgaaatactagttgaaagtagtaacaaaaaagtagttgatgcatgtgctagaaccgctgacaaagtaggtggtcctataaacgcattgaaaagaattaatgaaagtgttaaaaaagaaaaaaacgttaaaaaattagaagaaaaaaataaaaaacttcagatgaaactagaagaggctcaaaaaaataatatatataacaatataagaaatacagtaagcattggaaatagagatatatttgatacacttgctgaaagtgtagcatatactggtgatatttcttatgaatcaaaccttaaatctattgccaataaaatagaattaaagtcaaaaactattagcagaaaaagtacaggtggaaagcaacaactttctgagtcacaaaataataccacttatggtaattttttataaataatacatattaaccaaaggagaaaatactatggctgacaaatatttgttagatgaatcaacaaaagaaaaatttattacaagcaacttatatcctaatctcaatgaatctgagaaaaatataatgagaactgtgcttgaaaaccaaggaaacgaagtaaaaatgcttatggaaagcactgtaactggtgatattgcaaaatttacaccaatcttagttccagtaattcgtagagcattacctagtttgattggtactgaaatagctggtgttcaagcacttaaaactccaactgcttatttgtatgcaatggttccacactatgtaggtgatggtaataatagtgttagtccaacaaaaaatgctattgttttaaaacttaaaacagaatctggaaataaaaatgactttaattatactggaactcctattgaagtttcatttaagacagctacaactgttaaaggtaaaatagtatatagtgagaaacaagcaggtacagatgatgtggtaaatgtattacttcgcttagaatctaactcaactggttctgttgctattggtgatgaaatggataaagcagcttcatttgctactaaaaaagcaactgttgaggctgtatatacaaatgaagctttatggttaaaagttcttaaaaactatactggtccttatgcaacagcagctggtgaagctcttggtaaagacatgaaagaaatgggtattagtgttcaaagagtgttagctgaagctaaaactagaaaagtaaaaggtacttatactattgaaatgttacaagacttaaaagcacaacacggaataaatgctgaaaaagaactagctgatattttaagtgcagaagttgctcttgaaattgacagaactatcattgaaaaagcaaatgaagttgctactgtatgtactgattttgatgttaatagtgcagatggtagatggtttattgaaaaagcaagaggtttaagtatgagaattagcaatgaagctagagaaatcggtcgccaaactagaaaaggtggtggtaataaattaatcgtttctccaaaagttgctacaattcttgacgaaattggatcatttgttttatctccagcaggaagtaagattgatgctattaacagtggtattaaaccaaatgttggtaaattcgataatcgttacgatgtaattgttgataactttgctgaatttgattattgtactgttgcttataaaggagcatcaaactttgatgctggtattttctttgcaccatataacattacattacaacaaaatttaacagatccagtaagtgggcaacctgctatgattttaaataacagatatgatgttgttgctactccattacacccagaagcattcatcagaacatttgctgttaatttaaataactacataatctcttagtagataactcggactttgtaagtccgagtcacattaattaagcccctcttaagctacattattatatactccccaaaaaatcataatggattattaatggatagaatagaatatcttaaatcacttggatatacacctgtatcatctaatttagcaaacaatcttgaggtattatgccataaatgtaataatacttttaaaagatcattttatacatttaaaaatggttcagtagattgtcctaattgtcaaaatatagaaagactaaactatcttaaaagtattgggtttgaagctgttgatttatataatgtaaaatgtctaaaaggacacatttttaaaagacgattcagtgaatttaaaaatggtgctactacttgtccaatatgtatagacaacgaaaaacaagagtttattaaaggtttaggatatattataaaagacattaaaggggataattttacagtagaatgtcaaaaaggtcatgtttttaatagagtatattctagcttcaggttaaaaaatataatattttgccctgagtgtaaaaataacgaaaaaacactattcttaaacagtgtgggattaaagaaaataaaatcagctggagatagaatgacattacagtgctccaaagggcatacttttgttagaagatattgtgatatcaaaagaggtagtgtaaattgtccagagtgtattattaatattaaagaggaatacttaaagtcaataggatttactctgattaaaacaaatgttgtaaaatgttccaaaggtcatattttcaatagaagttattccgattttgttaatggtagtattgcctgtcctacatgtcaaaaggaaaacatattaaattttatagaatcaaatggtttgcaactggtatcattaggtaagagtataaaactaaaatgtcaaaatgatcacatttttaccagggccttcaatacattaaaagttaatacaacatgtcctatttgtgacaaagagaaaagaaaattttttatagagtcctttggtattaaattattaaaagacgggaataggttacaattacaatgtagtaaagggcatgtttttgagcgtgaatattgtaattttaagaaatgcacattatgcccagtatgcaatccttctactagctcatttgaaaaagaaatatcagagttattaacaaactataacaaaaatgacagaaacatactagatggcaaagaacttgatttttatctgccagaatataatctagctattgaatgtaatggagattattggcattctgagagtaatggaaaagataaaaattatcacctcaataagactaacaaatgtctagaaagaggcatacaattactacatatatttgagtcatcttggatagagaaaaaagatatatggactagtattataaacaataaactagggaagtctaagaagataatggctaggaaatgtattttgaaaaaagttgataaagcagaagagaaagagttcctagatacaaatcacctccaaggatttactggatcaactgtatgttatggattatattataaagatgagttagtttgcttaatgtcatttggaaaacctagatttacagataagtatgactgggagttgatcagattatgtactaaaatgggattaaatataatgggtggtgcttctaaattgttgaaacatttccacaaacataaccctgggtcattaataagttactctgataggttatattctgatggaagtatatatttgaagcttggattcacatttagccattattctaagccaggttactattattttaagaatggaataaaatattcaagacaacaatttatgaaacacaaacttaaagacaaattagaaatatttgatccaaataagacagaatatgaaaatatgattgaaaatggatactatagaatatgggactgcggtcaaggggtatgggttaaggaaagtttaagtaaaaatattgtataatataaataatattaaaggaagtgagatgaatgaaataaatgtagtaaaaacctatacaaatggtgaaattgcattatgtaatcttgccagtataaacttgcacgagtatgatttattaagtgatacagaaaaatataatctaatatatgatatagtaagtacaatggataatacaattgatctggcttattatatggtcaaagatgcacaaacagctaacaaaaaatatcgctatttaggaataggtgtatctaacttagctgttttattagcaaaacataaaattattattgattcacaagaaagtttagaatttcaagcaaaactttttgatgaattattatataattgtgtaaaagctagtatgcagttagccattgaaaaaggaagagcagaaggttttaatgaaacaaaatgggccaaaggtttatatccttatttaataggaaataaaaaggcaaaaaaattgataaaatttaaacctgatgaaaacaagtggaataaactgatggaagatgttaagaagtatgggatgagaaattgcgcactaatggccatagctccaacagcaacatcaggaagatctattaatgcatcagaaagtatagaacctattcaaaagcttttatataaagaagatggaaatataaacattaaaacattagcacctatgtttaaagaatataatcaatattataagttagctcaggaatgtgatcctatgatgttaataaaagctgcagctgttcgtcaattatttttggatcagagtcaaagtgtaaatatgtattcttatacatttaatggtgaattaaattatattcaaaagagttctcacaaactatctctgctgcatatgtatgcacatcagttaggattaaagactttatattattttaagtctgaaaaagataatggtgtagaacacgaatgtgagtcatgttcataatatagatggataaagtattatttttaaatgacctgggatataaacctatatcccagagtatgtcaaaagatttagaagtagaatgtaaaaatggtcatatttttaaaagaccatttagtgattttaaaagaggtagagtaaattgtcctaaatgcgaagttcaagcaaaaatagaattattgaataatttaggatatgaaattatctcaaacaatttaggaaatgacttagaggtaagatgtaaaaatggtcatatattcaagaaaacatttagttatttcaaaacaggttgtgctaaatgacctgtatgtgaaaaaacagaaaaacacacttttttaaataatgtaggataaaaaagtatttctgaaaatttagcagaccatttaaaagtagaatgtcaaaatggtcatacttttaaaagaccatttagtgattttaaaaaaggtgttattagatgccttaaatgtgaagaacaaggaaaaataaactttttacacaatttaggatatgaaattataacagataatttaaataagagtatgatagttaaatgtaaaaataaacatacttttaaaagagactttgatacatttaaaaaaggttttacaaactgtccagaatgtgaaaaacaagaaaaaatattattcttagagaacttaaaatatacagtaatttcaaataatctttcaaaaaatctagttgtacaatgtaaacatggacacacatttaaaagagattttatcacatttaaacaaggttcaataaactgtccagaatgtgaaaagcaagaaaaaataaactttttacacaatttaggatatgaaatactctcagaaaacttatcagataagctaattgtaaaatgcaaaaaaggtcatacttttacaagaaattatggtagctttaaagaaggtatcactatttgccttgaatgtgaaaaagataataaaatatcatatttgagtacgctaggatatgaaatagtttctgataacatggctgataatttacaagtaaaatgcaataaagggcatgtttttaatagaacttatagtaattttaaaaagggacaaacgatatgtcctatttgtgacccttttaacagttcatttgagaatgaagtatcaaacattttgaataattatattaaaggaaatagaagtatattagatggcaaagaacttgacttctatttaccagaacataacttagctatagaatgtaatggagattactggcattctgagcaaatgggtaaaaataatagttatcatttgaataaaacagagaaatgtgaatctaaggggatccagttattacatgtattcgaatcatcatggaatgaaaagaaagacatatggactagtattattagtaataaattaggaaagtctaagaaaataatggctaggaaatgtattttaagagaggtatctaaaacagaagagaaagaatttctgaaagaaaatcatctccaaggatttactggtagttctatctgctatgggttgtattacaaagatgagttaatgtgcctaatgagctttggtaagccaagattcactaatagttatgattgggaattgataagattatgcacaaaaatgggtgtgaatgtaataggtggtgcatctaaattacttagttacttccataaacataataaaggaagtcttattagttactctgatagactttattcaaatggggagatatacaaaaagctaggattgacatttagtcactaatcaaaacaaggttacttttattttaagaatatattcaagacaacaatttatgaaacataagcttaaagataaattagagaagtttgatccaaacttgactgaatcagagaatatggtggaaaatggatatcataaagtatgggactgcggtcaaggtgtttgggtcaaaatgatttaacccaaacattatatccgcaattatatacttttagtgtgttctgaaatatttcaaaattaggttcaacattatcaataagcttgtaacctagttttgggaatattaattgattttcacaagaaatatcagatataactttattaggatatcttttaattgtaccattaatgtgattttttattaaatctatataaaattgtttgttagaacgccatttactttcaaatatatgaattagatatattcctttattaatacactttaaacttttttctaaatgataacttttatccttacccatttgcttagaatgccaataatctccattacactcaatagctagattatattctggcagataaaaatctagctctttaccatctaatacagttctgttatttacaattacatttttaggtagaatattctttacttccttttcaaatgagctactttttggataacatatagggcataatgtacttcctcttttgaatgaaccatatgttctattaaaaatatggtttttcttacatttagcagttatcttacctttatcaaaagttattaattctaaatttatgaatttaaaaaatgtttctctttgctcatgttcacaatatggacaagatataaatccattttttagtgagttatatgctctactgaaaatatgattatgattacattgtatctttatatatcctcttgactcaaaatcaacaacattatatcctagtgattgtatatattctattttattattagtttcacaataattacatgtaattttaccttgcttaaaattacagtattcttttgaaaatatagtattgcatgttttgcatttaacttctacttttctaccgtttatactaataagggaataatttatgctatctaaaaattgttttctattttctatttcacattctggacatggtgtatttctgattttaaatgatgcaaaagcccgtctaaacatgtgtttatttttacattcaacttttacataagagccttcaacagacaataaattataacctaatgatttcaaatactctatcttatccatataattatttataaatattttggttaagttaaatttaaaccaaaatgttgtataattttataaataatttggaaaatctaatcaaaaggaatataatggtaacatatgaagaaatccaacagcttatcaggaactgtttagatgttggtattaaggcaccagctagtgcgtattcaaaattattaagacatggttattgtgttatgtatggtggtgatgctaaatttaacaagttagaagagcttgaagacaacttcgatgtgaaacaatttgatcgcgatacttgggtaatcaaagaatataaaaaagaacttactcctgaagaatggaaagatgttaattcacaagcattatataacggtggaacacctgatcaaattgcaaaagatatagaagacggtgaaaagaatcctatagtagaaaatgcttttaataagttagatgaagccaaactaaagcaaatttctaaagatgatttaaaaaacatatggaatgagaatgatttagaaactaaaagggaaaagacacttaaacttattagtgaattaaaatataaatcaccatctctagaaaaaattatagatataataaaaacaactaaagataaaaataaaattgatcaaattatcacaaatataatgtttgttggtacaggcgacaaagtaatcaaaatataaaggatgttaaatgaaaaaaggtattacattaaatgaagcagttaaaagaagggctaaaaatatggataaaagcaaaggtattactttaaatgaagctgcagaaaaaggatattttaaatatatcaaaagaaaagtttctataaatgagtcagaaataaatggtttaaaagatgctttagaaaacatggaagaattctctgatgaaaatataatgggttctgttgttggaaaagattatgttatatcaatttttgaaaaagtatgcatcatattagtaaatggtactacacctttcttaatagaaagagaagatattaccgaagacgaacaaactcttatagatgatgtttttgaaactttaaatcttgagttagatgatgatatagatgatgatttggacaacatggatgacaattcagatgatggtgatttagataataatctagatgatgatttagatgataactcaataaatgaaagtagaaaaattgataagaaaataggattatatttttataatagtaaaccaatcaaagatgggaatactgttgtaagtgtagatgataaaggcaatacagaagtaagattacacgataatttaatagctgttaaaaataaaaatggtgatgaaaaatattcattagcaggttataattcacaaacaactagagctagattaaatggtcttgggtttaatgttgtccaacgaaaaggcaaattatttgttgatgataacgaaataaatgctaatgactggtatgatatttttggaaataaagtaaattggtaaaaaaggtgcgtttgcaccttttcccatgtacttttaaggttgtcttaagtctattttggtaccattacggtataaaaattagggattaaagaatcccagatgaaaggacagaaaatgaaagtacaatttataaattcaaaagagttatcagcaaatgttgtttctacgaaaaacctacacaaattaaatcgcaaaatattagttcctggtgttattgatatttcaggtactatatacttaacatcaccttctaaagagttaccaactattaaagtagagatggacgctgtttttaaatgtggtgaatgttcatcatttaaaatcaaacattatgtagtcaataagaaagtatatggcagtaattctgaaatatatgatgggatttcaaaattcttaagaaaatatgcaaaacttatattagtatcaaaagacgaaactatattttttaattatacatatactggttttgcaaaatattttaaaaataaataacctaaaaaggttatttatggctaataaaagcaagtctaaaggtaatacttttgaacgaacagttgcaaaaatgttatcagataattatgctgatgtatttaatgttgctcaatcatttcaaagaaatatatctagtggttctgtgtttggtggtagtaacagctatcgtggtatgaatgttttaaatgagcatactttctacgcaggtgatataatatgcccatccgagtttaaatatactattgaatgtaaacattatgcaactgcaccatcttttaactctttaattatccaggaatgtgcacaatgggataaatggatattacaagttgaagctgattgtgagatatcaaataaattacctatgctagttgtaaaatatgataatataaaaccatttgtttttataaaacacaattttgaaggttttatatttaaatataaagattattatgcgtataattttgagatatttataaaaaaacataaaaaggagctaattaataatgtacactaaatatttatatgaatcaagtttagatcttcaatttgaagtaacagatcagaattttgacaagtcttttttaaattttagtaaagaactaccagttagtttatctgaaacattaaaattaaaatatgatatcaaattatcacttaagtttcaatcaaaatatgatgatataggtataatagtgaagttaaatgatgatggtaaatatattgtgtattcaaattctatggaaaacatagacaaattcattatttttgttgatactttaaaccaaaataaaggtaatttatgacaacttcaggtgatatagctaccacaccttctagacttacattaaagagaggtaaaattaagccgaaaattataaaatataaacaaaccaaaactttaaccctaaaaaaattaagtaaaaattaaggggttttatgatacaataccttcaataaaattgaaaggtattgcatgttagtagatataattaacagcttaaaaaatgagaatacagatgcaggcaaaattacaataattaaaaataataaagataatcaaagttttatcaaacttttagatatagtatataatccaaaaactagattaggaataaccgattttgaattaccatctgaaacaggtaataatatattagatgatataatatcatcacttgaccatttacaaaacggtatatacagaggtaatgatgctgaaacttttgtaattaaacttgcaaaacaattagattacgaaaatcaattacttctacaaaaagtaataagaaagaatcttcaagctgacttaggtattaaaacaatcaatagtgctatccctaattttgtaaaaaaaccaccttatatgagatgtgcgttattaaatgaaaaaacatcatcaaaaataaaatatcctgcatatattcaagaaaaactagatggtcaattttgtaatgtaattgttactaaaaacaatattcagtttgtatctagagcaggaacagaatataaatttaaaagagatttttcaaacttacaacagctaatatattatactcttggtgaatgtgtaataatgggtgaattattatgtgctgaaaatggcaatatactcccaagagaaattggaaatggtattattaacaaaagtagtgaaacaaaccaaactataacagaagaagaatcaaataaagttatcttaaaagcatgggattgtattccttatagtgattatttggaaagaaaatgcaatataccttatgaaacacgatttaacaatgttcgtaaaattactgaaacacctaatgggtttatatatccaattgtatataatatggtaaacaatatggaagaaataatggaacattataaaaatcttgtttcacaagaccaagaaggtgttattattaaaaataaatttgcaacttggggtgacaaaacatcaaatgaccagcttaaattaaaaattaagtttcaagtagatttaagaataaagggttatcaatgtggtaaatctggtacatcttgtgaaaatacattaggagctttagtatgtgaaagcgatgaaggtttattagaagtatgtgttggaactggttttaaagagagtgatagagatttcttttggaataataatatgataggtaaaattgttacagtagaagcacatagagcaatggaaaaaaacggcaaatattctttaatattacctgtttttattgaattaagatacgataaagacgaagcagataatattgaaaaaatactagagcaagaaaaatcagcaaaatataaataaaataaacttgaaaggatgattatatgaatacatcaacattatataatgacaaaggtaaggttgttttacaatgggtaaaaaatgcaccaaaatcaataccatctgaagaggttattgaaagtataaaacttgcttctaaaaagtttaaaaaatattcacttaagaatgtatctaaattaaaatctttagatactaattcattaacgctttacaatatttctgatatgcattttggtatgttagctttaaaagaagaaactaatgacagtgattggaatttagatatagcatcaaaaacattagaccaattatcaacagagctaataaatggtgctgataagacagaagagtgtattatatgtaatttaggtgatttaattgatattaatgactttacacataaaacaccaagaagtgggaatgtacttgatgttgataaaaaattcccacaaatattatcagttgcttataattcaattataaacatgatctataaggcacttggaaaacataaatatgtgtactatatcaatattccaggtaatcacgatatattaccatctatggctgttcaatatattataaaagaacattttgctggtaataaaagagttatttgtgatgagtctttgatgaatatcaaatatcactcatttggaaatgtattaatggcttttactcatggtgataacataaagatgaaagatgtgggacaaattattgcatttgacaataaagagaactttgtacattctaaatatgtatatgcatattttgggcattatcatgttgataaagtaatagatacaccattatgtagatgtgagagttttagaaatttagcaccattaaataaatgggcttctaatagtggttttagaagaggaattggtacaattaattctataacaattcacaaatcatatggtgaaattaatagaagaacttataatatgggtatgataaatggaaactaaactattaaatatacttttaaatataggtaaaaaatatgggatttattttaaacagaatccaatagaagatgaacataatgtagaaatattattatggactaaagaatcttcagaatcatgggataaagttataaaagatataaaaacagaacttcttgttagctttacaagaaacataaaaatatcatcttggggtaaaaactctgtaaacattaagatgaaacttgatagactatatcaagtaaatatactatataacttagaagagcccaaactaaacataacaatattatattccaaaataattaatgaatctgcctatgataactttttataaatagatattagaaaacagtatttatttaaaataactatatattgctaactgtttcagaagatgatagttatactaagtaatatataggtttaattttatttcctttaataaacttaaaaattttaaatatactgttttgagatttatttaaaggaaagaaaatggctttactaagtccaggtgtagaagttaaagaaattgacttatctcttacggtttcaagtgcttcatctagttttggggcgttttgtggtatttttccaaaaggtccatgtgatggtgcagttttcataaatgatattccaacacttgaaagtgtatttggaaaacctacaaactcaaattataatgatttttttcaagcgtattgttttttaagaagagcaggtagtttatatgttgtaagagctattgataaacttggaaaatctacaagaaaagattcaggtttaacaataaatgctgtattaggtgaaaaagcaacagaaatagctttaacagatacaacaggtttatatgttggccaacaaattatgtttggtgaaaaaactgatgctaatgtttatactattgctagtattcaagctaatactaaaataactttcactccagaaatacaaacaggtgatggtactggtaactcttcaaaaatttatatttgtcacccatcaatgaatgcaataggtgaagttttaaaaactggtttaagtaatactataacagatgccaaactaaaagaaactcttaaaataattcctaataatgatgtttatgaaactttagagccttctattaaatttagtgatactgaaacaaaattaaagtttattgctaaatcagttggttcttggggaaataatatcaaagtagcagttgcaacaaaagctgattttggagcaaagaaaaatattattagtggtattccattagatgataactttgaatatattccagatacagatcaagttgctgtagttgtattagaaaacaacgaaataaaagaaacatatatggtttcaattaaagaaggcgctaaagattataataataaatctaattatattgaagatgttattaatagacaatcatcttatgtctattgtaaaaataacactacaataactgatttaccaaaatccgctttggattctgaaatcataacacttaaatttggtgaagatggagctccaacaaaagctgatattattagtggttatacagataattttagttcaaaagaagaaatagacattgatattgttattgcaaatgaaatggctaacaaagaatgtgctgatttttgtgtaactcgtggtgatgttataggttatggtggtgttccatttagtgaagttgttggtttaaaagctgaagattgtgttaaaaatcttttagagtatagaagcactggtgaaatgaatattgataataagtatttttcatttataggaaattatggttatatatatgataagtataatgacaaatatagatggatcaacttagccggtgcaacagcaggattaagagcttatacaaatcaagcaagacagccatggtttgctgcagctggtttaaatcaaggacaatatttagatattatcaagctggcatttaatcctaataatggacaaagagatcttttgtataagagtgctataaatcctgttgttagctttccaagtttaggaatttgtttatggggacaaaaaacttgtactcaaaaacctagtgcatttgatagagtaaatgttagaatgttgtttaattatcttgaaagaaacatagctaactcagctaggtatgttgtgtttgagcaaaatgacactcacactcaaaatatgtttgtaagtatgtgttctccgttattaactcaagttcaagcgggtcgcggtatagatgcatttaaaatagtatgtgatgatagcaataacacgcctttggttaaatccaacaatcagtttattgcatctttcatgatcaaaccgacttacgcaatagaatttatcacacttaatttcgtcgctgttggtgctacaattagttttgaagaagcaataggctcaatttaaatattaaaggtagctcaaatgccacctttaacccaaacaccctgcccacaatcccacactctattatatccattaatactcatattctctgcttcagtcaggtttggatcaaacttttctaatttactactaagtttatgcttcataaattgttgtctgtcataagtcataccattcttatagtaaaaataacctggactagatgtgtgactaaactcaaaccctaatgtattgtatattttaccattagaatataagttgttagaataagataataaggtctggtttggataattgttttcaaatatcttcaataacctagatgcaccacctattacattaacatttattttagtgcataatcttatcaattcccatgatatgtttttattaaatcttgatctaccaaatgacataagttcaacaagttcattttggtaatatagtccataacaaacagtagaaccagtaaatccttgcaaatggtttttattaagaaattctttttcctctattttattaacttctttaatttcacattttctagcatatattttaaagcttaaccctaatttatttttaataatagattcccaaatgtttctattctttatccagttactttcaaatatgtgtaataattgtattccttgtgaattacacttcagagttttatttaaatggtattttttatcactaataacactatccgaatgccagtaatctccattacattcaattgctagattataatctggtaaataaaaatctaattctaacccatctaacatatttctgtcattttggatatattttatacataattctgttaagaaatttttaacctctatctcaaagtttgaggttctagggtaacaaatagggcattttgtttggtttttgttttctacaacagtgaaaggtctttcaaaaacatgtcccttattacatttgaaagtatattttgaagtaatattttcatttatgatatccaatccatatgactttactaaacttattctactaagttgcttacagttatagcattcattatttcctcttgatgtgaaacttgaccaccctcttttaaatgttgcattacatttatcacatataaattctcttgtgtcattaccacattttgtgtcagtgagagtaaatccatgttttttagctaggtttttcttttctatttctatacaattaggacatgttgtatgttttctattataaaagccattccagtctctagtaaaaatatgattacatttattgcatttcacattaaatattttactattatgttcaataatagtaaaattaagattccttatatactcttttctgtattctacttcacactgataacatccaacttctttaataatttctgctatacattgtttaaaaatatgaccatttttacattgtaatgtataattaccttgtatatcagaaatgtatgacactttcatgttatttaaatgggaatttatgttattccatctttctgcttcaacacattcagggcactttgtgtttttacgagtattaaaagcataccaagttctattaaaaatgtgattacatttatcacattttacagtgcatttatcaccgtttattaataaaggtgtaaatccaagttccattagtgttttttctttagacataacaacacatttatcacaaattatatttgtgtttggtatgatattacttactttcttgttaaaaacatgcccataattacattgtaatgttatgctattagacttatgtgcaataatatcaaacccaacacttttaataaactccattttctcatctaatgtcattttttctccttcactctatttaacccaaacaccctgaccacaatcccatactttgtgatacccatttagtctcatattctccgattcagtcaagtttggatcaaatttttctaatttatccttaagcttatgtttcataaattgttgtcttgaatacttactaccacctttaacataaaagtatccaggtgctgaataatggctaaaagaaaatcctaattgtttataaattgatccattagaatataatctatctgaatagcttattaatgagcccatagtcttatcaattcccaatcataactattagtgaatcttggcttaccaaaactcattaggcacattaactcatctttgtaatacaacccatagcagatagaactaccagtaaatccttggagatgattactttctaaaaatccaaatgatagtctttaccttttccattgctgtctgaatgccagtagtctccattacattttatggctaaatttattattattgttttaataattctattctctcatttctttgacaaatccatttttacattttacttctaaattatttcctaaattttctgacactacttcatatcctaaatcatttaaaaactttaacttttcagttacattcataatgtcctttcaagtaatttcagtaatattatatacaatttttacttaaattctgcttagttagtttaagataattttaagcggttttgttatacaataaaaagagtatgagtaaaaatttataattttaaaaatttaattgttagaaaaaacttagttaaaaaaaatcagatattgtattcatgaaaaacatagaagtaaaattattacatcatacaccattagaaataacaatagacgctataagaacttgttgggatagtggatgcaaaaaagacagtgtttatgaagatggtagattagttttaggtaatcaagataaagcattattagataggattgttaatcatcacaagcaccttagtacaatagaacatgtatattataacttttttataaaaggtattagtagagcgtgtctccaagagttagctaggcatagacatgcaagtcttagcgtagagagtactagatatactttgaaaaaacatctaaaaaatgaagaaggattcaaatatgaacaagactttgatagagcttctaaatatgtagttttgactgaagatttagaatctaatttacaaatattatctaatttggataatttattaagattagtaaaacaaaataagagtaatgatattgtaaaatatgctttacctgaagcatttaggacaaatttacactggactataaatgctagaagtttaagaaacttcttagagttaaggtcgtctaatcatgctttacatgaaataagaatattagctaataaagtttatgagtctttgccagacttacataagcagactttgtttaaaaatattataaaggagtaataatgagtaaaataaaatcaaaagattttgccaatttcttactttttaactctaagaaagatctaagtaatttagaattacaattactaataaatttaatttcaatagattatgaaaataaattttatagaaaattattagaagacgaactaaccaattttaaatcatattcttttaaaatatcagaagatgtttattgggattttagaaattatggagctaattcaataaataaacctgacaaggaaattaagttaaatttatctaaaggaaaagttaggtttataattaacagacttgagtactataacgaaaatggttattttaataatgttagcattatacaaaaacattatcaagaagaaagaaagttagaaaaattagctgaaactcacgcaaaaacttttatgagtgctgtttggttatgtattcctatatttactttgttagctttattaaaatatatatttggataactttataaggattatattttatggttgaagatattcagcagttaaaagatgataaaataagctatttaaataaactgttgccacaggatgaaaacggatattttttagatattagtaaccagaaagttagctatggtaataatcctcaactttcatatattaatactaaattacctttgaaagaagaacatataatagagattcaaaaatgtagtacagatattatctattttgtggaaaattatgttaaaataagaagtcttgatgaaggtttagtttatcctgacttaagagattatcaaaaagaattaatacaacaatattatgaaaatagattcaatgttgtattagcaggaagacaaagtggtaaatctgttacaactttattatacatattatggaaattatgtttttgccctgataccattgttggtatttgtgctaataaatttactatggctgctgagaacttacaaagactaatggacatgtatgctgatttaccgatatggttaaagccatccgtgaaagtttataacaaagagtcatttgttaatgaaataggatgtaaggcatacattagtgcaactacaccagatgcttttaggggtcttagtatcaatttaatttttattgatgaatgtgtagctggtgacacaaaaattacagttagaaataaaaaaacaggtgttattgaagatataacaatggaagaattatataacagaataggataaacttgcaatcttaataaaacaataaaaagaacgaaaattggaaaaagcgttaaaaaactataataaataaacatgccaaattatttttccagtagtaagccaggttctaatcagtctaatatagtagatagtacaaaacctggttttgtgtcatcttatcaaaaaaagacaaaagaaacacaagctataagtgaagaagcaaaaaatataaacactggcaaaaaagtaataaaagatacagttgatgacgctttaaaagaaaaaactacaaaagagcaggaaaaagctgcccttgatatagttaaacaactaatgaaaaaaggcactcgtaattttaaagcagaagactttagatttagcaacatgatctttatgcaatatgatgcaaagtttaaagatgaggtatatgataaaacacctttaattttagtattaagtacatcaagaagttatgttttaggtttaaatttacattggactccagtaccacttcgtatagctttgataaaaatattgtttaaaatgaataaagctgcaattcaaaaaaataaacaattaaaaataacatataaaatggttaaaccacttttatctgcactgcatttaggaccagttataagattatatattaagaaaagaatatcaagaaaaggtattataattccacaagacttatggttggtagctgctagactaagagccgaatcatttagtggtggatattctgctgataagttatatgcaaaagcaattcaaaactataaaaaatcaaaatctaaaaatattcgtaaaaatagaaaaatgttttaagttgattttaaggataaatattatataatattagtaaattattaatgctaagagaatattatgacagttaatgacaaaatagaatttttaaatgatcttgggtatgaaactatatcggatagtttaggacatgacttagaagtaaaatgtaaaaatgggcatgtttttaaaagagcatttagagtatttaaaaaaggttatacaacttgcccaggatgcataataggtgaaaaaactaagtttctagaggatttaggttataaaattatatcatacactttgggtgacaatttagaactaaaatgtaaaaatggacatgtttttaaaagaacatatagtaactctaaagaaatgtatgacagactgtccagaatgtacaaaagaacacaaaattaagtttatggcaaaccttgagtatgagattatatcggataacttaggtcatgatttagaagtgaaatgcaaaaatggtcatatttttaaacgaccatttggtaattttaaaatgggtaatatagactgtcctgaatgtatagcacatactaaaactaagtttttaaaaaatttaggttatgaagttgtatcagaaaatttgtcagattatctagaagttaaatgctccaaaggacatatttttaaaagaacatttaaaacatttgaaaaaggtgctgcagattgtcctgtgtgtatggaacatgaaaaaactaaagttttaaacagcctaggatataaaactatatcatgtagtaatgtacaatgtaaaaatgggcatatttttaaaagggcatttagtttgtttagacaaggtgttataacttgtccagaatgtacaaaagaacagaaaactaagtgtttaagtagtctaaaatagaaaaccatttctgaaaacctagcagacaacctagaagtagaaagcaataatgggcacattttcaagcgagcatttgataattttaaaaggggtgtaactttatgcccaatatgttatccaagtacaagctcattttaaaaagaaatgtctaagatattaagtaattacataaacaatgattactctatattaggtaataaagaattagacttctacttaccagaccataacttagccatagaatgtaatggagattactggcattctgagagtaatggaaaagataagaactatcatttgaataaaacagagagatgtaaggaaaaaggtatacatctactccatatttttgaacattcttggattgaaaagaaagaaatatggactagtattattaacaataaactaggaaaatctgacaaaataatggctaggaaatgtgttttgaggaaagttgataaagtagaagagaaagagttcctagacacaaaccatctccaaggatttactggtagttcaatttgttatggactttattatcaagatgagttagtttgcctaatgtcttttggaaaacctagatttacagataagtatgactgggagttaatcaggctatgtactaaaatgggaataaatataataggtggtgcttctaaattattgaaacatttccacaaacataatcctgggtcattaataagttattctgacagattatattctaatggtgaaatatacaagcagttaggatttacatttagtcactactcaaaaccaggttacttttactttaaaaatggaataaaatattcaagacaacaatttatgaaacataagcttaaggataaactagagaaatttaatccaaacttgactgaatcagaaaatatggaattaaatgggtatcataaagtatgggattgtggtcagggtgtttggattaaattaagttgattttaaggataaatattatataatttcatatatctaaaagatatgggatttttggctattgttgattaatttattaatcttattttcagctatttttaaaggaaattattatgaatgaatttgacattttaacaggattttcaggtgcagatttaatgcaaaaaatgccacaaaatattggtcaaaaaagttatgttgataacagattttggaagttgtccaaaaacaaagagggcaatggtgctgctatgatcaggttaataacagatcgcaataaagtacctttcgttcacatgtatcactataactctaaaaagaatgtaggtggcaaagatcgctggttaatagcaaatagtccaagtacaattggattaccttgtcctattcaagaagagtattttgaagtattaaatagtggtgatgaaaaactggcaaaatcactatatggtagaaaggtaaaatactacactaacattttagttgtaaaagatccagctaatcctgaaaatgaaggtaaagtgtttctatttgaatttggaagtaagttaaaagaaaagttcctagcttggattaatccagatgaaacacaaaggtctctaggacatacagaaaaagaactatataaccctataaatggttataatatagagctaactattaaaaaagatccacaatcaggtttcttcaattatgataacacaagtttagcaccatcaccttcaaagttaggcgggttagaaaaaaatgaagatattatagacataattcttaataaaacttacgatttaagtgagtttacaaaacctgagtattttccttcttatgaagaattaaaagaaaaactagaaaggtttaaaaatccttttggcactaaaacttcaagtgttccatcagtggttgaaaaaacaaatgataacccaccatttgaaacacaagaatcaaaaccacaacctcaacaacaagtggttcaacaacaaaaacctaaacaagaaaacagtcaggatgatgactggttaaataatctttaaggtataaaatgctacaattgtaaaaataattgtagcatttaaggaaaataaatgaatataacacattcacaatatgaggttatggtttctgcgtataaaaaagactttatacctaacaaaaatgaaatgaatttattaaactcgtttatgttatgtagatggatgagtaatgatattcattctgttgagtttgctaattttattaacaatcataccgatatacctataaatgttcagtattggtttgcacgctcaataatgaataaggtaacttatatgggtagacctccaaaagaggataaactaaatgaatacgaagaagctgttagcaaatactataatatatcttttaatgtagccaaacagtattgtagcattctacctaaagaaaaacaagaagaaattttaaatatgtttaaaggagggaggataaaatgaaacgagatgaatccattataaagtcatttaaaagggaaataaatctacagacaagatttattaaaaataaaacaaaatatacacgaaaagaaaaacataagaaaggggctataaatggttttaattgattttatgcatttagcttttaaaagtttatatgtagctgttggaaaagatatgtatagcaaacagaaacttagttttgaaaaatatcatggtatgtttgtgcatttagtatttaattatttaaaattagtccaaacagagtatgcaagagattatggaaatgaaattgtccttgctttggaaggatctaattcatggagaaagtcatattatcctgaatataagacaaacagaaagttatcggatgtttttgattgggaaaacgaagtatttccagctgttaatgagattattgatgttattaaaaaatcactaccatataaagttttaagagtaaaaggtgctgaaggtgatgacattattgctgtattagcaaatcatactgctaaacctgtattagttgtttctgaagataaagattttatgcagttgctaataaacaaacatataactttgtttaaacctattaagaaagagttctttagaaatatagaagaatcagaaataacaaaaacattaactatgcatattttacttggtgacaaagcagataatattccatcaataatggaaggcacaactttcacacctgactttataaagtttcttgaaaataatggtatttttgaaacagatgtaaatgatttcaataaattagaaatatcaaaaacattatatgatttatattctaagcagtctgaaaaatcaccttttaaaccagcttattttggtgaagtaggggctaagaaattcttagaaaacttaaatgaaaatcttgaaaaaaacaagcttgtttatgataattttgtcagaaataaaacattaattgattttagagaaatacctgacaacattaaagaaagcattatagaacagtataatatggaaaagccaacaatagatctcaataatcttcttaagtttttcttaaaatataattgtaaaaaacacagtgatagtatagcttcatttaacagtaacatgggtacttctttatttgatgattggatgtaatattagcagtcttataaatatctataaattagatattataggactgtgttatgatagaaccaaaaagagagcctacacaagacttttttgtatgtttattaaaagaacctagatgggttagtactgatgatctatatgctattttgttatcaccaggagttacatatccagccgaaatagctatgatgcatcctgattttttcggtggtgatgatgttgtatttaagcctgaacctccaattgatccagataatcctgatttatctaactattatacaaaaccagaaacaaataatttattggatcagaaagcagataaaattcatacacatgttgtagctgatataacagatttaaatttggataaatttgctacaaaagaagaaacatatactaaacaagagatagatgataaaatagacgaaatagtaccacctgaaattgatttaactgattatgcaaagaaagatgcagttaatatttttacaaaagctaatacttttacagaagcaccttcagtagaagtagatgcaacactagataatcatgttattagaaagaaacagtttgacaataacataaaagaagttaaagatctactatctaatgtattttcatataaaggatcaaaacctacatatacagaaatagaagccattgttgataaaaagataggtgatgtatggtatgctgaagatactggatatatgtatatatggaatggtaaaacttggtatgatttaggtaaatcttttgatgctagtaaatttgttgatataacttcagaccaagtagcaataaatggtattaaaaaattcacaggaaaattaaaagcattaacacctgttgattctgatgatgtggctattttgagctggacaacaaaacaaataaatgataaagttgaatctgttgttggtgatttaaattcattaaataatgaagtttctaaagataatttagttaatgctataaatagtgtagatgataagtttaaaacaacagctaaaaccaataaatcaaatacatttacaggtgatcaaacttatgtagatcatattttactagaatctgttccttctgaaagaaatcatgcagttaatttgggatacattttagataatcctggaggtataaaacttcctgatcatacagcacttacacaaaattctgttacagaaataacttttggatatgcaaatccagtatcatattctgcacaacaattaaaaaatgtattcctaaaagatatagtaggcaatgaatataaagctataatggcagataaaacatcatttacagaaaatccttcaaaagaaatggttgttatactttctagaactgattatgacaaaaaatatagatagttaagtttgatataactaaaacagttgatgagcttaaacaatatgagcttaaagaaggagaagttagagttatactatcttatgatactgtatctgtttattctagtggatatggttatggagccatgtttgctagaaacgctaataaaaaagacggagacttaatatatgattattatactggaagtcaaaatgatataacaaataatagaaaagtatctataaaaatagataaacttggtattaatactccagatattgtaagtatatctatgactacaaatggttctgaaaaattaactgtaaaaacagatacactagatcctgtagaaaatacatacgaatctgcggatatgacttatattcatactcctgtcagcaaaattgtaggagatgttctgtatagtaatatatctcaagcaataaaatcaatacatttattagaaaataatatatgttctttaaagcctgcaagtatggaattacaacttgtaagactcaaagaacttaatcaaacaataaataacatgttgcaatctatgtttgatgagagtcctatagcactagaaaatggagattacatagatgtttcatttagtggtagtgcaagttatggaacaggatattgtgggtatgttaatataaaagatactataagagatattacatataaagcttataaagtatcttcaaatgcttttaatacaactagtggaactaaagttattgcagttctcacttctgataacagtaaaacaaatgtaacttattccgatagtgtatcaacattagaatcttatgaagtagcagaaaatgagatattattagaaatatcattttcaactgctaagcaatattctgctaaatacggatatggagctatgctagaatattggggttctgtatctgatttatgttatgattattatatgggttcaaacctagatatgaactgtccatttaaaataacaatactaaaactaggaagttctgttaaagctgatactatacaaataggtgctcctacttttgcaggatcattagttatgcacctaagaaaaaatacaaacgatgttattaatttccttgtatctacaggtatgaatgtaacaggaagagatgggactgaaagtggatcagtatataatttagtagaaaaatcattgaaaccattaaaagttctaacatctgaagcacatcaatctataaatggtataactacttttaataataaagtgtatatgaatatagaaaatgaaagaattacagacaacaaacaactaatacataaagaatacctagataaaaatattacagataatgtagcatataatattagtaatactccattaataccttacactgatgttagttctttaaacaaaaaaaaaatatctgtaagaatatctgcgacaactaataactctaattattcatctggtgatacagtagtagttagtaatttcaagataaaacttaaaggagatgatgagtaccttaaaccttatggggttgaagttattgatagagaaaataataaaataggtttaaatttaataggagatgatacagtatataatgataatgatgctttattatctacaagaccttctgattttaattcatctagtgtagatctttctagtggaagtaacgccttagtaactgttaaaactaatggagcttatgattatagtggagtttatgatataccaaatccttttagagaatataataaaaaatactctttattcttaagtaatgatgggttaaaaaatccttattaccaagttgatataaatagctccaaacaagttgataatatatcttttcaattatttggaactagtgctacaaatccttttttatattctaaagactgtaaaattgaattatttatagaaaatactgttgtaaaaaccttcaatgttaaaggaagctctgacaataataatcctgtaaatattaatatagattataaagatggtatgttcttgatatctgttcttgattctataaattacataaataatagaattaataaaaatgcagaattacttacagggtcaggcaaacctaatttttcattaaaccctaacaaaataggttctctatactctgatacaactaataaagctgtatatatgtgtatagacaatgcttttggtgctaataaatgggtgaatatagtaacaggggatgaaattaaaccaagccttagaaaaatagagatcacttgtaatgtaaaattaagaagtggccaatacggtggttgtatgagcggtgttaaaataggatttgataacgggtatgcttctacaaaacaaatagttaaagggttaaatagcggtcaaatattgctatctctagatgggttgggtaacctttctgggtattctgaagttagttctttaactcctagcggtcaagatataaaagttgatgtggatactactgggatatataatgacccttcatatcattgcgttactaatatatttaaagaataccttggcaatgctgatcaatgttcgctatggtctgatgctagtgttaaacagcttaaaataacgttattgtctgaaaagattcctaccaaaatattatatgtaggaaacggatattatggtcaaacatctgtttctgatgtaaaagctgtatggtattatgtaaatgatagcggagacaaaatagaaggtaatgtagataatgatttaaaggtaagtaataatgtttctgaaacaaacgatagttcttatatatatgcgttcaatataaattaaatgcataggattatattaatgatagagccaaaataatatagataacactaaaggtgaaaagatattataaataaagatggaaataagagctactatttggaacatcatttatataagtaaaccttaagaatttctatgatatactatcatagaaattataaaggaaatattatgatagtatgtaattataatgtagtaccaattataataagtttatataaaaataattttaacacgcaagaggttaaaatatgtggttataatcaacttaatgaatatattaaagatgattcaaataagtttgaaataataggatttaatactgattctatcaatttaccaaagaatatagtaaatcttgaaataaattttgaaaatataccaaaatatttacaaaacccattaaaatcatattatgaatgggataaaaataatcaaagggattttttatttggatattatttagatttatattttaagaaaaataaactgccagcattagctgatttgcttaaaaataatacagaagaaaataacatttataatattgttaagaataattttgtatcaatggaatattctttacagcaaaatattattaaagaaaaaattattaatgatatatatattatgaaaggtaattataattcctttgtatataaaatggtaacatcacagtataagacatatatactagatgacgatttaggcaagctaataatattttcaggtgatcttaagataatttatgatagaatatctcatttaaaaattgatattattaaaacagaaaattgtattatattaaatgatattgataataaacaacagatagtaaaattaatgttaggattataatgattagtggattaattttaaaaagtcttattaatgatgaaatatattttgataaagtatattcaattttaaaacctgagcattttattggcgtagattctgatatttacaaaacaatacaaaaacttgtaaaagagtataataaaaaacctacacctaaagaagtagctttaaagttaaaagataattttaaagatgagcaacaagaaaactgtataaacaggtttaaagagattatgttagataaacaaaatgtatctccagagtttcttaataatgaaacagcagaatttataaaacaagctgaaatgagatcttgtattatacaaggtgcaaaacttatacaagaaaaaaaggacattggcaagatatatgaaaggttagggcaagctatatcatttacaatggatactgacataggtatgaaagatattgatgcacaagaaagggatatattaagaagagaaaccaaaattggtatttccacaggtgttgaaatattagatgaagttttagcaggtggttacatgcctagcacacttaatttcatatgttctgttacacatggtggtaaatcaatgtttttgtcacatttttgtgcaaatgctatgttaaaagggtataactgcctttatataacattagaaatgccttcaataaaaatttgggatagaatagaaagtaatatttttaatattgatattagtgaactaagaaattataatgtttcagaaggatataaaagtttaccaaacttaggaagatgtgttgtaaaagaatatggtgctggtagttttgatgttttacaattaaaatcattagttcaaaaagtagagtcatctttagaaataaatttaaattgtataataatagattacttagcacttatggcttcgtatgctttacaacctagtgtaggtttatattcttattataaaaaaattgcagaagaactacatgcttatgctaaagaaagtaaaaaatgtgttttaagtgcagcacaacttaatagaaatgcttataataattcaaatgctgatactagcaccatagcagaatcattaggtatagctcaaacagctgatactattgcaatgctgcatagatcaccagaattagatgaattaggtcaggccattgtatcattcactaaaaacagaaatagtggtaatttatctcaaaaatatgttggtataaactttaaacaatcaagattttttgatatagatcaaccagattaaggagggactaagcataatatagtataattacattatatttatttttgtaaatataaaataaaattactaaaggagtaaaaatgttacagaactttgtaggaaatagtagtcataccatcagtgttaatggctgcaccatatggtataattgattcaacaccaaataacaaatggatggaagatttaaaaaaagatggtaaatttacaccaaatattaaaaaaattgaaaagcagttttttgagttgcaaaaaacaatcagctcggtagcatcaatttatacaataccagctgaaaaaggtttacaggatttagcctatgttgctaatttaggtatgattttcccacatttaaatccaaatgaagatcgtagagtattagttagtaattttaagtcagaaccacgcaaaggtgaaacaaaagtaggttatgagtactttaaaaaacttggatttgaccctattattatgcctgatgttaatgaaaaaggtgaacctatgtattttgaaggtgaagcagacttaaaatggttatatggtaatgtgtatgtaggtgctgatggtaatagaactaacggtgcagctttagattggattgcaaaaacattcaactgtgaaattataaaattccctagttttgatgagtatttgtatcatttagattgtaatgtattcccattaggaccggatacagaggcatgcttggttaatacatataatcttgataaagatattattaaagaacttgaaaaacatgttgaggtaattccattaggtgttgatagtcatgatgacccagatcaatatgattttgcattagcaggaactacaaatagtgtattattacctggtggtatagttattacgccatctgatatttcagagttaaataagaaatctgataaagatttatatgaaatggaaaaagataaaattgagtttatggatgaaatctgttctgagttaggattacagttagtagttcaaaatatatcaggctattatgttagtggtgcttcattaagctgcaatgtaatgcatcttaatcaaagaggttatttaaattaatcttaaagtggtattataccactttactttataagaaaggaatataatgttacttaatagtaaaactattgcactagtaaattcattacagctaattaatgaatcaattatattttcatcaaaattaacaggtataaaagatagtgctggtagcatcattgcttttattgacttggaaaagcttgaaaataaaccatttcctaaagattttggtattctaaaaattaaagagtttatggatttattaaaaataattggtgaagatgcaaacataacaatggatgataaaaatattattcatatttcaaaagatgggatgagttgtaaatatcttactacaaatgttgaagcattatctaatgcttgtggtgtaaagccaacaatacttgaaaatgttaataatgctgagctagtatcttcttttgagttagatatgacagtttcggataagattaagaaagctgctacattattaggatttgatgatatggtattaaatattgacgatattattactgtttctacttctgaacaaggtataaatggtaatgaattttcattaaatgtaacaccaaatgtaataaattcaaaggcaaatattttcataagtattaaaaatttaaaaagaataccaacaacagattatattgtatcggtacataaacatacatcaaggcaagatacatatttgcttaaattaattccaaaaaataatgatgcacttataatcctgatcccatccaaagttgtaaaataatactataaataaccttaaaaggttatttatagtgatacaatacaaagatataaatccgaaaaatattgaaaaagatatagtaaatgttgatactttttatgtgtcattaaaaaatattgtaagcactactattggggatatagctggatttccagagttttcaaataatgctcagctattatttgatcaatatagctcagttgcattggatgcttataagacatctttaaaaacatcaattcaaaaatttgattatcgcattatagttgataatataaatatttcaaaaggaaactctgataatagtgtatatattgaaataaaatatagagttaaagacacaactatatcagatacagctagcataaaggttggataatggcggataatattttaattccatataattatgatgatataaaagatgaagtaataaaattacttaaaaataaaggatatagtgctgatgtaaaaagttcaaatgcaaatctattagcagatatattatcttatttagcttatagtataaatgtaaatacctcttttcaagcaggtgaaatgctattatcaactgctcaatataggaaaaatatacttatgggtgctagacaattaggatatgaagcatcaagaaaagtatcttatgtttattctttggaaataaaacctttgaaagatgatacaaaagatgatgataacgaagataaaagagtttattcaatacccaaatatacaatgtttaatagtggttcaaatacatattattatatgggaagtgatattgaagttgaattatctaataaagatataactactggaaaagcatccactataacaatagatgtaaaggaaggagttttacataagtgggacaaaaataaagacacacaagtttttactattaaagctattgaacaaaatagaagtataaaatcttcaaataaaatatcattatatcaagacaacatagaagaaaatgggtttgaggtttttgtaacttatattgatatcgaaactggagatagtaaagttgatgagtattgggaaaagtcagatcaatttatgatagatgcagatagtgatacaaataaaaaatattttgttttaaataacatagattatagtggtgttgatatctatttttcaatatcaggtataggtacaaatttattaccaggaagtaccgtaaaagttacatatttagaatctaaaggaagtagtggtaagtgtggggataatttttcattttcacaaaatacatatccttttaatctcatggaaattgataaatttgaaacaaaaatagttggcactgatgaagaaaccaatagttcaataaaagaaaatgctcccatatttcataattcagcaaacagggcagttacagtaagagattatattgcaatctgtaatagatatacaaatatatatcaaacccaagtgtggggtggggatgaagagcaagttgtacaactaggacacatttggttttcatttatccctgaataccgtaatcaagatttttcattagatgaaacaacacaaacatattcattagtaaacaaaaatgattcatattatttaaaacaaagtgagctaagatctaatacattagataaaaatggatatttagtaaataaaggtatatttgatgagttagattcttataaaataatgactatggaattacacaatagatatcctatatatatggattttgattatgaaataaggataatcaaacaaaatattgtagtttcgaaaaatgaaacacaggataaactatttaatattttaaaagattattttaaatcagatatagaaagttttgaatcttcttattttcattcaagtgttataaaaaggttagggacagaattatatgatttatcaggtatacaagtagatgttagtatgaatatacctttatatttaagaaataaagaaccaaacaaagatattttatatatttatctggctataccttttgagcaaataataactaaaacacaggatgatcaaaatgaattacatgttaacttattaccacaaataagttcagatgactttggtggaaaattagaagttgattttaaaaatcctataaaaggatttacaattataggaagttctaatgctataataggtacttttgatgtaggaaatggtcaatcagcagttttcaatggtaaaaatgttgtcacttcagatggattaattataaagaatactaatataagtttcaatatatttgcaaatggaacaataataggaacttataaaataatatatgataatagaagaaggtttatagttatagaaataacagatagtatagttttaagcagtcttgataatataactccaaaatatataagggtaaaatattctgatgataacctatcattttataaaaatacaatagctagattatcttcagtaaaatttgtaagtgaaagtgatgttatatgatagatcgtgttgatttgcccaacatttataatgaaaataaactgcataaagatagtgtggaagctctatatgaggttttagatgagttaaatccatattcattagatatatataacatatttaaaagacctaataataacataacagaaaatattgttaaaatatatgcagaatcattatattatggtatgcaaaaagcattgacaaatccagttgtaattcagagaatgaaagaaaaaataggtacaactgataattatcaaccatttgatataaaagaattttataaaaaattattaaaagattattttgttaattttacaagttttaaagaaaaaaaaggtcttgatgtagcaatagaatatgcttacaatattatatttacatcaggacttcaacctggtttagatgtaaatggttcaagtggttttaatttaaaatggggtacagaagataaccctgatgagccgtttttcataagaatagaaggcctactagatcctatattatatgaaggtagtgttaagtcaatagcacatccagttggttttggttataactatgttataagtcttgttttagaatttatagagtatatagatgatttaattaacttcaatgtaaaaacattagaaattgtttcaacaaactatagaaaagagtttgataaagataaagtagaagatatctatacctctaaaaatatacaaaaccaagaaagaatagttataacatttaatgatgggaaacaattaataaaagattttaatggttctataacatataatgaaaaagatggtagcgtaatagaaaactggaataatacatacatattaaaattagattatgatatttctctaaaatttagattaaaagatgaatttgataattccgaaaacaaccttatagtatatgattgtgtatggaatagattaaacagttttgatacgcctattataggggaagccattgtaaataaatttagagtagctgataaatattattcatctcttgtaattggtaaaattgatgataatactatttatacattacctgatgatcctaccaaatatactccagataaaatgccattatttcttacaaatgctataaatagaggtttatttgaacatatacatgatgatatggatatatattcaactaatgattttatagataatgctgtaaatgaaaaaggtattagtaataccgttggaaataaaataatagtgggatcttttaaagttggatcacaatctgaaaacccagaaggaggtgcagttcttgatgattcatttagtattgaaagagagataatcccaacagaatattctgaaactgttacaaaaaatcttaaaactaatttttatacaactatattggataactttgatgaaaaagttgttaatgatgatataaaaataacagttggttcgtttaaagtaggtaatataaatataggagcagaacatattgataatggtgttatattagatgacgcttttgatataaatattttaaaaataaggaaaaataatggtagaatcaattaatccaccaaaaggatattttaaaattgaattattagataaaaatagaaatgttatagatacttttgaaaaacataacttagttgtaaatggatcaagacctgttctagcttcacacatggctggtagaagtacaactccagtaaataaacttgttttagggactagaggacatattggtaataacctgatgatgccaaaaacagctaatgaaggttttacagctgctagaactcaattatttgctgaagaagaaggtgagttttgttatcatgttaattttacaccaccacaatctgatggacaagctgttgttacagaagatgatgtaggtgctggatcaacagttgaagttactaatagcaacaatacaattacatatagaatagagctttcaacaacagctggtaatggaacatcaggtgctgttggttatacagaagcaggtttatatgcaggtaatgatttattttgtatgagaacctttgctgttagaagtaaagatgtttcatctatattaagaattacttggacattaatattctaatatgtctttatataatattgatagactaagaagctcccttaaacaagggggtgccatcaattcaaaatataaaattgacataaaaatacctaccctattgaggtctctaccgttttttaaaacagtaaatatatcaggtgaatatttaagtataatggctaatagaacatctattccaggtaagtctatgagtactgtaaaagtgtatcatcgtgggcaaccatttgttataagaggtgcagcacaatttaataatacacataaaataacattttataatacacctgatatggatattcatcaattatttagtgattggatttatagaattgatagttttgatagtgcaattacacaatcaatattcttaggtaactatgttggttttaatagtgtaggtgctggttatatgagtgatataatagtatcacaattatcatctgatggtaaaactgaaactaaatttaaactatgttatacttttcctattgatatagctgaagttgaattaagtgcttctggaaaagaaatatcatcaacagaagtcacatttgcctatacatattgggaaagagtataaataataataaaaatggagataattaaaatgcctttatatacagttgataaattagcaaatgctcttaaaggtggagcaaaaagtgataaatattttatagaaataggtactccgttaggtgctccagaagtagcatttacagaagaggatattatattatgtaaaactgctagtttcccagaaagaactcttggagaagttgaagcatttgtccaaggtaggaaattaaaattaccaggtgattcaacatttgatgcagcttggagcccagtattttatcaaacacctgatcataatattagagcgaaatttttaacatggattgataaaattgatgtatacaaaaacaattatcatacttgtgatccatatagtttaatggttacagctaaggttcaccaagttaattgtaatggtgaacctgttgcaacttatgagttttttaatgtatggccatcaaaagttggtgaaatagaagtagcagcagataaaaccaattctatacaagaatttacagttgattttacatactcacattgggaaaagatagcttaattaaataaggtatttaatggggcttgaaagtggtgagttaagaaatgaagcacaaggtggatacaatccaccttttgagttatctacttataaacaccaagtaaaatttacaccacctaataattttgaaagttatataaaatgggaattattaggtgatattcctttacatttaaaaatagatgaaaaaactggtttaataactggtgatatagaacttcttagcaaacaaccttcagcaaaaaatgctatatatgaatatcaattaatgaaaatagatggtagtaattggaggcatttaggtttattaaaaaatgggcaaacttttacatttaattttcaagtcaaacttacttatacagtacaagtaaattcaggaggttctagattaggtaatacagtaacagaagtaagcgatgttactattaccatattgcaagacaatgatataataagcactttattttgcaaaaattatattgatgaagcaaaatttcctttaaaaatcggagataaagtatatactgatgctgttgagtttatgaaaaatcatcctaataaaaacaattttaaaataaatttggtttaagtttattttaagtacattatgatataatattgataaattaatattgaaaggataaaattatggaaaaaaattacaatatttttttaagaacaaaaagtgttacaatattaaacttaatgatgatctgaaagataaacttaaagatacaatagaaaacataaatgattatgatattattaaaattaaattaggtagaacattttttaatcagaaaagatactataaaatatatgctagaaaaaaacttggtttttataaaacattactttcagaaaatgatgattcatacttctttatggaaaacacatcaaaaattatacgcagagtatttaatgagtatgatgtaaattgttataatctatatcctagtaaaaaatacaggtatggtcttagtatatttatgcttatttgctgtagtataattttaatagttttattattaggtataagtgctttatcatatatttttaaaggctattttttagcatttggtttaagtttattttaaacaggtaacaaatggataaaataaagtttttaaataatttaggttataaagttgtatctgaagacttagttagaaacttgtatgtaaaatgtaaagataatcatatttttaaaagagaatttggtgatttcaaaaaaggatatataaaatgtcctaagtgtgaagaagaacaaaaattagaatttataaaaggattaggttatgaagttgttactatggatgaaaaaggaaagttattacttaaatgtaaaaatggacacattataaaaaaggattttggtaactttaaaaagggaactactacatgtaatgaatgtataaaagaagagaaaattaaatttattagaagttgtggttatgagccagcgtcagaaaatttagcacatgacttattcataaaatgcaaaaacgggcatatttttaaaagagaatataatgatttaaaaaaaggatacatcagttgcccaaaatgtaatgaagaagataagataaaacttataactagttttggttataccataataaatcaatataactcagaagaattagaactcatgtgcaaaaatggtcacatatccaaaagaatattccataattttaaaaaattcccattatgtagtgaatgtgttgaagataaaagaacatcatttataaaagaattaggttataaagtagttggaaaaaacttatttgaatgtaaaaatggacatacttttagcagagaagtaaagagttttagaaaaggatgtgtatattgcccaatatgtaacccttctactagctcatttgaaaaagaaatatctgaattactagataactatatagaaaatgattattcagttttgggtgataaagaattagacttttatttaccaaaccataacttagctatagaatgtaatggagactactggcattctgagcaaatgggtaaagataagaactatcatttagataagactaataaatgcttagaaaaaggtattcagcttttacaaatattcgagtcatcttggatagagaaaaaagatatatggaagtcaattataaacaataaactaggaaaatcagagaaaataatggctagaaaatgtattctaaaagaagtatctaaaacagaagagaaagagtttctagaaagaaatcatctccaaggatttactggatcaactgtgtgttatggactctattaccaagataagttagtctgcttaatgtcttttggaaaacctagatttacagaccaatatgactgggaattaataagattatgtactaaaatgggactaaatattgtaggtggtgcttctaaattattgaaacattttgaaaaagaaaatgaaggttcattaataagctactcagatagattatactctgatggatcaatttataaacaattaggattcgaatttagccattattctaagccaggttacttttactataagaatgggactaaatactctagacaacaatttatgaaacacaaacttaaagataaactagaaaaatttgatccaaacttgactgaatcagagaatatgagtataaacgggtattataaagtatgggattgtgggcaaggtgtttggataaagaataggaaagggatattatgccaccagtaactagattaggagatatagcattaggacatagttgttatccaccttctcctacaatagaagcaagttctaatgtttttgcaaattcaatagctgttcatagattaggtgataaaatacaaccacacgcatgtcctgacacaccacctcatggtagaaatagttcaagtggtagcacaagtgtttttacaaattcaaaagctacttgtggtataggggatgctgttaattgtggaggtataatcgctcaagggagtaataatgtttttagaggatgataataaaccgctttcaaaagttttaaacgataatattattataaaagaagatgaaaaaaatatttacattaagtttaaaaagaatataataatagaatctgataacaatgttatttttttagcaaaagactacattgttaattcagctaaagaaattcatttaaatccagatgtaaaaatatccgctgatgataatgttgatgatattgttaaaaagatagatgataagaaaaatgaaattagtatcagtagtattggaaaattaacacataatcacaaacattgtaaaattaaatgtttttttaaaaaattatttaatttaaattaatatttgatgctttaatattagcatttccagtaactgtaatattacattcgcctttaattgtaatattacagtctttatcaatacttatggtgttatttcctttaatatttgttgtattatctttatcaacagttaagtttttattttcttttatatgtgttgtatcattcttatctataatagaagtttggttttctttaacatttaagtttctatcttttacaacatttattgttactgtaccttctttatcaattagaacttctgtaccagttttatgaaatatatgtattctttcatccccatttgaatcatcaaattccatataatgccctgattctgtttcaaatacttgattttttaagtatttttcaccttttgatttattgtttgtatcaggttgatttttataatcatttaaaggatattgacctgtaggatctttaaatgattgtaattcttcattttgattattaacaccttttaaaacacctattataataggttgatttctatcattttgaaacaaatgaactaatacataagcacctttttttataaaacttgtaaaacccataccagaaaataaagaaaaatccaatgaagtagcccaaggtaaagtttcagtaggtatagtttcatcatctataccaataattcttactctatatctttgtgattctaaaggatctttatcatcttcaattacacctttataaaaaggtagggtttgtgttaatattttaaaattcttttcatttactctcatacagaacctattcttcctaatgttattgtttgtgtaaaaacattaccagatgatatatgatcaattattttagttataaaatattcaccagtaacataaggcatttttgattttaatgtttcaatagatgaatttgcatcaaaactcactttacacattaaattatggttaaacatgccagccacattaatatttatagcagaactttctaatatttcagtattatatattgaatcaactatattatgtaagtatgggaatatttttataccttgaatgccatctttgtcatttattgttaaacttgtttttaaaccacttttaccatgcgatatttttgtattgtgttcttctttagtaattctttttgaatcaacttgataagttatagacggtggtaaaattgcattttgagttaacatatcaccttgtattaatgtaaagtctttaacagaataaggtgagtattcttgtgtttgagttggtgaaaactttactacttttgatagatcaggtgctaacttacctatattatcagtaggcataataacaataccttttctagtattaataataagtaaatcatcaaatttttgcatattatttagaagatataatagatttttattaccttgtattacataattctcataggtatttttaggtgtatcttttataataacatttaatggtgttgaaattaaatcagattttgtactaaaaatatctttaataacatctgttgactttacattattgtacccttttgaaataaaagtattagcaaacatattataatattcatcaactaactcaaattttatagtggcaatagattgaccttcaaaatctctgtctatttttgttaccttaaatactctttcaaatttaatattaaagtgatcttttaatgaaactttaaaacatattccgttatgtggtggtaaaagttctgttattttttgggtatcattaaaaataacataaccttcaacgcataaatcattataatcccagattattgtaaaatctgatatattagctgggtctagtggtaattcagattttttattgtttgaatataaaagtattgcataatatgcttcaggcataattttaaaatcagaaaacatttaacatatcctttatggattctttaaactgaggtataaactgcctttttataaaaataactttccttcttgattcattctttttttgtatttttgatagtatttgattatatagatcttcaggtttaaaattaggtgaaaaatattcttgttgttctttatattgattttcagcattatcacttacccaagtatcgcctttagcaaaattaagaataccattttcaccaaagtttaaaatcatcaaaatatcccataaagatgaatcattatattctcttaatgctaatacttcaaatctaacattatcattcatttctttaacataaaacattgataaattatttttcataaattctcttaattttggtatatttactgaatatgtaggagataatgaaaatccattgaaatcaaccattattttattattcaaaacagaatttttcataacttgcccttgtattataaattaactattttcatcttgtgaatatttataatttagttcctcttctgttagccctatattaggttctgatattttttcattcccatttgaatttgatgtatcagttgtttcaacaatatctgatgtcattcttaaaggtcgtttttcttcaaattgtaacgcaatagataaatctcttggtaatccgtttccatataaagcagatgcctgacccatgtaattaatattacacattttaagatttaattcagtttctccgttttcttcatgatttaattgtaagagtttatttaatgtttttttaagctgttcacctttagctggatctttagatccaaattctattgtaaaaacataatcttgtgatatcaataatccagttttatctgtacccaattgagtcccagtcattattgatttcaactgtaataacgccttaacaatatcctctgcatgctttgcattattaggtaaaagaatagtttcaaaattaaagaccctatttggtgtcccattatatgtattaataatatgagggtcagtcctgatattattccgttttagtagattatacccaaaaggtaatgctgcaccagttgccattccaactatagcaccaccttttttaattttacctttaactgtagacattttattaggttttggtttagttccactaggctttattgtatgtggtggtacttctgtattatgtacttttttagaacccttgttaaaaaaattcacaaatgatcttatagatgccataatttattgtcctatcatatcacctattggatctatttcatcttgattaaattcatggctaaatgcttctgctaaagatgatggtataggtaatatccaaatgtattcacatggcacaccaggttttaatctaggtcctgcctcccagttagatgggtttataatatttgaaatattattctctgccatgtttaagatattatcaaatacttttgatggatcatcatctaaaatatcattaatgctatcttttatacccgatacatcacttcctattttataagcttttatagcaatataatctctagcttgtgagtcacatattaaatcaaatatttgaatagtttgtgtatcattcataaaattgcatcctttctattctttataaatatcatcttcttttaaagaagtttctgatttaccttgatcgttatataggctatttattttcttttcccaatcatctctccataaaggtttcctttcaacaaattgaatactcagagaaaattcagtcgggttaccatcatgtcttagcattagttgccttgatcctatattagtatttattaaagatataaaaaaaccttctgtaatatctcttgaagcacttaataagtttgaaactaaaggtgttttatcattttgcagtgaaataatttctatacaaaaaatgtatttcataatcaaaaaattcataggtattatatttcctacactacctaaagtaataggattccttttagcttttgtccagttttttaacttacttatttgagcaacataagcgtcatattgttttcttgattttggtattatattccaagacatatctatatttctaggatttgatgacctatatattgataaaatgttaggatctagttgaataccacttctttttaatgcttgttcagatatattttttatagaagtttgacctgcataactacttgcttttgaaatagcactacctaacaagttcatagactgtacttcatatgattgtacatattggtctgataatgagtttggcagagggaaatagaatgtcccagcagcatctgttgatataacagcagaatctctatcaatcattagctcaactgtgcgttttaatatattacttgaagtttcggatagctgatctatagatgagtactctccttctgagttaatatcagttgatccgctttcatcaactttttttatcaaatcatcccaggaatccataacttccttccctatacctaaattatcaatatcgtaagctgttattttaactaaatatttttcattatctaatccaggtatattaattacttcagccatgttataatcctaatttctttgtaatttcaactgatttgacagcatcaacagaaggtttatcaccgtctccattagtagaagattgtttattatttattaaattaatacctttttgaaattgatcctttgataatcctgacatttcagtaaattgttcgtctgtatcattttgtaacatattttctgttaattcaagaccagtatttgttaaataataatcttctttagttccatcatcatatgttcttgttttcttggtaataaaattaccatctgatgtataataggtattatcatcttttccttttttataagttatattttttgctttttgggttttaacatcataagaagttgctatttttttctcctcataacctatatctccaggaatagatacgccattaccagtatttttgtaacctatatccccagggatagatacgccattaccagcatttttgtatcctatatctccaggaatagatgcacctttattattttttggtgcaaactcatcacccaatctttttacttctttattaatttcaattgtgtcctctggagcgtacttttttgatgtattattagaataattaataggttctgttttcatatctgttataactttatttgcagttggttcaatagtctttacatttgttataactttatttgtggtttgtttaacatctcttgtatttgcttttataggtttttcttgttttatattagaaacatacatagatctacctatatttatagaataatatttaccagaagtagaaactattgtacttgtagataattgtttttttacatttgtattaattggagtaatagtagtacttataggttttgtcttttgcaatgtatttgcttgtttctttttagtttcaatgatatcagcttcaagcataccatcaccgtttttatcagtaatgttttttggttgaacatgccaaggttccttatttggtataggcctccaaaaaccatgttttgaaagcattccactagaatctaattttattgcatctgcactattaatatctactgccataccatattcatgtaatgaatatccaggtctgtttgcaggactacccttaccatttataaaattattatatagtttttgctgtgattctatactcctataaccagaagttacagtaaattgttttttatatatattaaagtaatcataagccattagatttaaattgtataaaaggtttgaatctaattttcctataccagtattaaatggttcactaccactatatgaaaaataatatttagatggatcaaaaccttctaaagtaagacttgactttgttgtagtaataccatattttttaacatgagcaactccttctgctgtcaattttgccctacctacatgtttttgtaatacagaacttactcttcctattacagtagatggtgttgaaacatttgtatttttttccattttctgtggttctatatcaaattgactcaaaactgtctgattttgaagttttttgtttacattaaaaaattgtgcttttgttaacctgttaagatcttgtacatctccaatgttataactttgtgaggcacttttatcatatactactttatataatttatctccaaatagtgatgttttttgtttcccttttttgtcttttaatggttctaaagaattgtccaaaatcatttttttaaaatcatttaatatattagatggtaggacatcatctatattatcattaaaatcatcatatgttacttcataagaatttgaaaaataatacattgcgttgtgtacaagccttataaatccttgtcttacatgttgttttccaaatattgaattctttaccattgaatatagttttggatctttttccttcattaagcttaaagattcaaaataataattatcaacaaatttattagttttagcttgagttgtgatgtattcaaaaataattaataaatcaggtcttaatttatcgtaagtttctgaattttttgataataaagttggatccatgttatcaagatctgtatataagtatataggtaatccattaactaaaacacttccatctttttttattttttcagctatacctaaacttaatttcattataccatctttagccattttaaaagtactaactataatatcttcaaatacaaacacaattgcatttttaagcatagtttcaagtgtatatagctcattattttcttctgtttttaaagctgcaccagcagatattaatgtaacattgaccaatccacctttactaaatactaattttggtacaacagtaataactctagaacctgatcctactaaccttacaggtgggaataacattgcaacagcacctaatgtctttagaatgtttattcccatttgcttatataaagactcattattaaatcttccatataaaatcatataataaggtattccattattagacatataatctagcaaaggtttaaatgtatcttcagtataatttaatattttagtaatagtttcaatagaagcatcttttaaagaatctgcatctaatgaaaccatttggccatctattttaataatatcactcatttttatcctcgtttgttaacaattcaatttcaaaaggatataaactatcaaaatctgttttactaaaacctaattgtgatataaaatatttaagtgtagaataataccattctaaatcaagcattataacataattttcaaataaatcttttaattctcttacagctaaaacatcattattacacataatacattttactttagcacataattttaaatcaccatcatcatttaattgatttaaaatagagttataatcttttaatggtaactcattacatagctcaatattttgttttgaaatagtatgttttttattgttaatttcaacttcaacagtttttggaggtataaattctaaattctctcttatgcttattcttgtatcaataggattgccacaatgtggacaagttagtaatatatcactataatcaccattagcataagacgataagactatcatggtatataatcttgaaatataatccaaatcttttgtttgtggtattaatatatcagctattttatttatttgatcttctaatggtagttcaatccaatcaataaattgatgtaatatacctatttcatcttttatcttccatacatttaaatagtaatgtttgttattaataacaatgtcttttatcaaaataagttccttctaacagattcaggtaattcttttaattcaacatttatttcactattacaatttttacaagagcaacttttaataatactatgttttggtatagaatctctaaaataatcaaatactctattaaaacatgataatgggagttcattaatatatttttcaaatataatatgattacctcttaattcttcaccatttatagaaatataatcaatcatataatataattctaataatcttttctcgtggtctatcatgttttttgtttctgcaataagacataaagagtcatcttgtgataattcttttttaaaataaattgtaacaataatattatctacatttatttcaataggttctaacgagtattcggttatagagatatcatcatcagtaaattttatgttattcatttcattacagtatgggcatttaaaactagaatctatttcactacatacttcagagaaatatttcttaaaaaatagaaatctagcctcatcatttgtaatatatttaggttggtttaggcatttatatactaaaacatcaataatatcgctgtcataaacataattattatcattatataatttatttaataaaacagaatgttttcctttccaaacttctaattccatagtttcctctctataaatattac

SEQ ID NO: 4 - DNA, 123818 bp, Camplyobacter Phage CJLB-10
gctagtagaaggattgcatactgggcataagatattccctcttttaaaatgtccgaaacttctttgaaaaatgtggccttctgggcattcaacggttaaatattttgctaagttttctgatgtaattttgtaacctaattcatttataactagcattttttcattatctttgcattttggacaatatgttacatttttaccaaaaaaattgctgaatgttctttgaaaaatatgtccttttggacatttaacttctaaactatgccctaaagactcagactgaattgtaaatcccaacttacttaaatatatttcttttttgtttttatcacattcaggacatgtaactatacctttctcaaaggtataatatgtccttttaaaaatatgtccttttgggcatttaaccattaaattataggttaaatcatcagaaacagcttcataaccgcatttccttagaaagtctagtttattctgtttattacaatctggacatataatatgaccatcagtaaatttgctaaattgtcgcttaaaagtgtgcccacttggacattctactaaattatcagatttatatttaaatcctaaattatgaagatggtttatcttactttcaagttcacattttggacatgaatatgttccttttttaaaaacactaagtgctcttttaaaaatatgtccatgtttacattctacttcaaagtaatcacttttatcttttgatagtatattatatcctaaattatttaaaaattgtgttttttcttcatctttacagtttgggcatgtagtataacctctttcaaatacattaaatgcccttttaaaaatgtgtccttttgaacatttaacttctaaattaactgatagatttttagatataacttcatatcctaaattattcaaatatgttattttatcgtcattatccatataattatatcctaaatattttaatactattataacacagactatattaaactacccttaatttataaataaataggataatataataacttatgaaggtaaaattaaatggagtttttctttttcaaaacaactaaaaaatacacaaaatcactactcagtctattcaacagtatacaagttaaaaagaaaatagatgaaaaaacagataagtatgtcacagtacctattagttttggaagtaaagatgctgcttcagtctttagtgatacagagttagatcaattattaaatggtaattttaatatattacctagaatgtctttagctttaatgagtatggaaagagatgatcaaagagctacaagtagatttcaaatacctataaaagatattgacggaaaaaatataacttttcaacataactgtgttccttattcttttgattttgtattaagtatagctacaaggtctttaacggacttaacttctatattagagcaaattttacctttctttaacccaaacattaatttaagggttagagagttagaatggttaacagaacctacaactatacaagttgaattaattagtgtagattatgaattacctgatgaaaatgatggagctgatataagagtttgtagtgctaatgttacaatgagacttcacgggaatatatatccccctattaaaaatggtgcttattatacacagatgatactgatgataacattaagtttattataaatgtattagaagataatggtgttaatcctattatatcaaaacaactaaattattttactgtgtttgctaaaaataaaggtgccttaaagttaagtattcaagcagtaaattcatttgatttacaaagtaatatttatgaaatggagttagaattctcatgaaagaaaaagcagaagcattaggaaaaaaattagataaaataaatgatatttttaatgtgacagaaaaaacaatagttgaagttgagaaatcagatttaataaaatctaatccagaagaaaatttaaaattcacatatttaaaagaagattttaacctaatgagagaatctttagttaatactattaaaagaggacaagatatattagaagttatttcaaataatatattagctgatcctttatcttctaatcaagctgttatggcttattcaacattagttgatactataaacaatagtacaaaactacttactgatatctacaaaaatatagttgatattcaaattaagatagctccaaaagaagctgaaaaaggtagtggtaagcaagaaataatgactattgctcaaataacaaaaatgattagcaagaatcaacaaagccaaaattaggctttgtttaattctattgcattaaaaatcatttgtgttaatatccctcagacatttttattaacctttaatagtatattttcaattctttctgaaatataacaaccagtaagtacaataacagttataaccttatttaaattaacttcatctatttctactaatataactattagatataacaacaaaatacaagcacaaaaattattcataaaccaatttagtatttttttaaacattttatctcctttttaattatttatcaagattccaattgatattctctaaaatcacaaagctctcctactttatcttctatttcttttttgtggtttggacataattctataatatcacataataattttattgaaaagaaaaataattcagtttccttatctattttttcaataggtatattatagtttaaacttataaatttttttacagtatcatattttgattttattttgtaattttcgaatacaactttatctgaaaatgcaaatctaatattgtgatagttattaccaatcttacacattttaataaaattacttagtttcattgtttttccttctaacaaatttatatttttatcttcttttatgctgttttcatcctctttgatgtttaacccatgtccatttaattcttgcttaagtttttcataactgtaaagttcttttttacttgtgtagcaattaaaatattctagcattttatttcctctagtaaattatctttattattcatattgtaacataatagtcttaaattaaacttattttgtattaaaaatatgtaaaaatttctaatatataaagtcttcaagtgcattttcaagtagatttttataattatttctatcagcaaaataatatttaccatctttaaacaaataaatgtattttatatcacaataatagtcatcaaatactacattcttaaatgtttccaaattcattcttacatcatgattatagttatgttcatattcaaagaaattgcataaatcaatgcagtttgataaaaagcgaatatctttacctatatttaataattcacacaatttattataattataattttgtaaaagtattctaccagctaattatagacatatttgtaattttccattttatccctttttaattaaataattttctttacttttataattataacagattagccttaaaataaacttatattatttatttttatttttcaagttcttttattaatttacttattttaatttttcaacctacaacctgtaactttcataatcggctttataccattttgcttatctttaataaacttatttaactcatcatcataaccataatgactttcaatctctttaattttttctagcatacatttatagaagtcaaaacctaagtctgaaacttgtttctctatgttagaaagtatataacttacaatttcattataactaattctacttattccataaattacttcattatctaatgctaaagaatttttattatcaattaaacagctatttagatatattaatgctctcattcctgaattatgataaaagtcgtattcatattcaatatcgaaactattaaaacaaaaaattactatatcgcaaagtgcatctattttttctaaatcatcttttgctctaaaatattcactaattttttcaaaaatattacctaaaaacttttcttgttgattttcataggttaaattcttttctctatatttttctaatctttctttaatttcattaaattgctttttgttcattttttttccattttctattgtattgtattctattctattctatttattttaactagttctatatttaggttttctatactacaacacttattacaattttcattattttcccaattacaataacaagtttttacaaagttttttacaatataatctgcttgttttctatttaatacttcaacatattcattttcaaataatgttgttaccattaccttttcctctcaatttacacaaattatatcattatagacttaattatcatccatccagtctgctattcttaaagcatcctcataattttcaacaaatacttctccgcctctatcaccgaaaacataatacttattgaatttaaatttatatgagatataataattatcttttgcggtgctttttatttttataggatagaatatacacattaattctataatccattgtttaattttattcattatcaccttcctttattgtaatattttaaataattttattattccataattataacagattagccttaaaataaacttatcttactctaaactctacactatttacctcttaatattcagtaataaatttatcatcaggttcctgataaggacttccatattcaataaacatacgacgatgaataggttcattaaatatttttaaagcatcttcataatcacttattgaaattaaatcttttttatcataaaaataaacattgtctggtgaaattaagcaatttctaaagtcttttaataaatgccaatgttttccatctattaaacaaaacttttggatgttttcatatttatcatcatataactcaactgaaaatttataaagtgccatatatgataatttcattaataaatcatccaaaaacattatacaattagttttattatcaaaatgcttgaaaatatgcgttagagaatcaagtttatctttgtactcataagaattaaactctattgtatttttttcaaattgcttaattttttcaagtgcttttttctcagaaggttttaattttgtattttcatttatggttttagcacaatcagagttttcatcctttagatacaaatctaagtaaactaaatcggttgtttggataatttcagactccgtaattttcaaaatgtaatcaattaaaaaatcatcttgtctataagtgagtgtaataataccataatctttagttatttcattacaaagacttttgtctcttttaattgcttttaagatatattttggtaaatcacaatcaacaaaaaataatgattttaaagggttacatttacactttacttttctaaaagttttcttaaaacaatcaggactataaagtttatcaaaattgatttcaactctatcttgcctacaaaatttaaaattttcaaatacaacttcaagtaacatttcttactcctttcaaaaatttcacaattataataaacttaaatgtctttattataatgtttatttgaattattgtgcggtagatcaacaaacaaattactttctatacaattacaaatataaccactactaaagctactcgtatttccatcaaagctaacttttttatttggtattatgaaatttataggtttttgtaagtttgctaatcttaatgtttcactaaaatcttgataatttatgctcattaagttcattaataacataaaatcaatattctcttgggttaaaagtcttatgatttcatttttcttactaaaaggtgggttgcttattaaaatgtcaaagtcataattaagccaccatttgctaaaaaagtctttaccttgattaatatgtccataaattacatcaaaaccatagtgtttgaaaactttaacataattagaactttcatcatcaaaaggacaaagtattttaataatattcttttcatacaaacaaggtattaaaaattcaattaatatttttggtgtgtaatactcatcttttaaatcaaaagcattattgtaactcttcatactttaagctcctatcattttttcctacttattattcttcttttagttctatacaattattatactataatagccttaaagttggcttaaaaataattagttagtcttattcctcaacttttataccacatttttctaaaaatttattacgctcttcatcactaatttctatttggttaatattttcatatcttctaggatattttgattcaccttcaagaatatatttaccctcaagaaaatctttatacgcatgttcaaaaaattcattagtttctttatcaaattcaattccatcaggaattaatactatacctttagcttttatttgtttcattatcacactctttgtaatttgttctatactttttcttaataaactcataaaaatttgattttttataagtcttgtcaatggagtcacttaagtttttcatagcttcatctaattcaggatcttcaagtcctgttttaataacatttccataagcatctaaataatcaatttgaccataactatccctacattttttatccattttaatacctatttaattcttcaataacttctttttcaaataataacgcattttccatattgctctttataactaaatccatattaatgcaatagttttcataatcaattttaccgtctaatagtaattttatataattatgagcattttgaaaccatttaaatcttgaattatttggtaaatcaaaattatcatttatagacttaattatattacccatacactctaatatagatggtaaatattctaataaagtttctttatttataatatcatttatcattttcagtaaccaatctgaatgaagatcataaaaaataaattcatctaaatcttttccatttttaatagctttatttaattcatttctaaaatatcccataataaatgtagattcatataataaatcatttctagctctatcaatatatctaattttattcaaaatagctatatctttcatcgttggatctaattttttaaattcttctaatatatgatcataaattggtttttcaacaaattcagagtatcctgaaacatccaatactttatatccaaatctcatgtttttaaaatttaatttgcgtttaataatgaattttgactctatcatattcctaacctttcagatatctctttaattttctcttttgaagcctttttaaaatttttattttctaattctttatcttttaattctttataaaatttctttaactcttcatcttcattttctcttcttatattcatatcaagatcaaaactgaataatgttgatttaaatgacccaagttcttttaaaaattccttttcagcttttttgttagaaatattatctccaaacgattgacaatgacttatcttgtattctaaacagtctattaaatcatttataatactcatataatctttaattgtaaaatcatcagtatgagctaataagtttaaaccttgtattgccttcattttaatgcttaatttactatgttcttctctcaactctgatatttttctatccacaattgatctaattccaagatttgtggggacgactactacattctaataaagcatcaatttcttcttgacttaaaatcattgccataattatactcctttataaaatatttaattagtattctctaaatttttttgctccgatatcacattcatctaaaaattaatcaaattccttcatctcttcatcatataatagagctttaaaattattatttttattataaatatatcacttttcttttgtattttttttataaaaattaaatattaccataattaatggtagcataatataaggaaagtatataactaatatgcatagtaatattataccaccgactataggtgctccagcacaaaagtttttaatatgttctaacatcttaatcccttgtttttatatttttcatttataatataatttactgttaagttcttctgattttttgagaatttgttttactaattcattatcaccatagtctttaatgtataataaatagtcttttagtaacatatactctgtgtctttatgttctttcggagtatcagtatgtgcataacggaatatatgggtacctaatctgttaattaatgtttcaatatccacatttttatcatttatttttaagtattttatattatttttcatacagcttatgaagttggtaattcttttaaattcatcatctgaaagattacacatatatttaacattgtagaactcatcatcataataacatatgcaattatttaaaaatgctaattgctcagtttcaaatttaaaagatatcacagttgcgttattcatattattcctttcaaatgtttatggtattataccacaaataatcttaaagattacttaaataattcattttcagttaataccataaattccatattatttattctacagaactctcttgcagcttcccattttgcttgattttttgaaactgttaatgcttgttctactactctttttttatttttttctgtgattatttttggttttttaaatatagcgtctttttgtggtttaatttcaataagatatttctttatgttgttgtctttatcttttacttcaatataaaaatcaggaaaatatctgtgctttttacctaggaactcataaggtataattattgattcactagcccatttaagaacaccagcattattatcgcaccataacataaatctatattcccatgagctacgatagatgatgtttgttacatcatctatatatttttctgggttaataggtttataaaaaccttgtttgaattctggcattagtatttaggttgtattattatataagcatcttcaatataatcaaatggatcatcagggtctataaacactccactatctactaaaattaaatattttgaaatatcatcatattttttaagatctttttttataattccaactattttatcatttatttcatcagagattctcatagcatcttcaatacctgtaactatatatcttaattcaataatattacaatgcatttttaataacaactcttcattatcaccatcaaactctggatttgcagaatcatatgttatttttattttaaaatcatcagtttctactatactttctttaccatttatatacttgtaaaatccatttacatcaagtccatagtcagctaaagatgattcattaattttcccagctttattaatataacctataattttgttgccaattatatcatttattttgtgaataactaagtcaatttgtttaggtttccctttattatctgtaacctttgttactttaatattatcatttactgtgatattaacatcacataatttattaccatttttgtccttatatgtagctattaaagtatttcctttctcagaaacactatgtgtagcatttaactttttacctaaaaaatcaagtgattttttggctagatccttttgaggttccacttcctcatttaaaaaaatactgtaaatattcattaattctcctttaattttatattatttataaaaattatttaacagttttctttaataatcattgtttctcctttagttttgatttataaaaattatatcacagttttcttaatttttattttcttttaactactaataaattcgcgttttcgtggatattgcctctaactaaaagttctgactcatttaatattcttaaacctaaagtgtcatttttgctaaattctaatctgaattcaccgctatgtcttttaattattacaccaattctattagtatcatgaacaatatcatcaaagattatgacatccccttcataaatctttttattatttttgtcataaaatcctgtaaatgttctagttccattgttttttctcctcgttatgtgatataatttttcaaaatttatggtattatatattagtggatattaccgataactttcatatttttttctgacttaaatacttttaaaaaagatatatcaggttcagctttccttttataaattttattattaaagtttttactaaaaatttctattttaaacattttataagtattatctcttttaatatgataaagttcttcaagaggctcatattctaatatatcattttcatagattttatttccatttttatcaaaataaccagtccatagctctatttcagcatcattattatttttatttagtattatcccaaatcctaaaatcaaaatcttttagttccatattatttccttattatctgtcttccaactcatcctcatcttatattttgcacttttttcattcatcatacttgcaatagtttcctgaaacattgaagttctaaataataaacatattctaatatatccccttcataaatctttttattatttttgtcaaaatagccagtccatagctctatttcaaaatctttttatatccattttctttccttttaaagcttttaagggtattgtatcaaaatatccttaaattaaacttagagatcaaatttggaaactttatctaatatttcttcttgtctttttaaggcccatagtttgttattagctaaatcatgaaaatattcaattgtatcatattttttctggagtttctaacatttcaaatttatcaaagaaattgtttttggcaggaaaatttcttatttatatcgatacaaataatcgaaagagacagaatcacttactaaaagccatacttgttttttgaataccctcatttacaatagattcaacatattctctttcttttcttatttcttctaatctttcatcagtatattctttttcttttaaaactatttcaaagatttcttttatttttccaggtgtcatttcacaaacctcctataatttagagtaagcattactgatagttgtttttctgttaacttacatataactactttcataatatattaaggggattatataatataatccccttaaatgtaccttaacacaaattatcttcaactttatccctgttaaaatttctataaataattaactgataacaaaaacatataaaaaatataaatattgatataaactctactatcatatttttatattccctattattaatgtcattaaatataacacaagtaacaacagaaaatattacataactgcaaaataaattaagctgtatcattatgttccttcatatcatttggtaaataatatttatattgaccatttaaaagcaatttcatcaaactcttctaatgtaggtaaacacatagattttatgaaattatccacaatatcttttgatatctctttacctgtttctagtgatcttttttcaattctttctagtattgtgttataggggcataacataactattgcaactttgttgtaatttttaatcaaacttgatgaatttaacaaagactttcttgaagtatttgttttatcaattacaatatctttaccttgttgtagtagtctatttaacttaaatttaaagatgttatctatttctttttggtcatcttgagataatttactccatatttctgagtatgtatctaaattaaattttgttttaccataactcatcaatatatcatctcttgaaattacattttcatattgattacacaaagttgattttccaactccaggaacacctattaacattgttatagttggttttgttatatcaataggttttgtttcataaggttttaataatcttatctgtttatatatgtcagttgattttggtgtatgagttactctacctaatgaatcacacattgaaaacttacataataattgcaaatcatcataagtgaattttatttttaatttatctatatcatatttatagatatcatgataagcaactatttttattatttttattatttcttcttcacttaaattaaacttagataaaacatcacaagcataatatactccaacattttcatgattaaggaatcttacttttactgttccattatcttttgttactacttctcttgtaaatatcttacctaaatcatgtaaggctgcaccaaacattaaaactttataatctttatcatttttaaataaatcttcaaccttatttaataccattattgtgtgatctaatacagttttttctaaatgatatgggttatcaacagtttcagttccatttaaacatttatgtaacatttctgaatacatatgatttattaattcttttttgtttatcattctactattcctttcaagcataagggaattatatcattaatccccttaaatataacttaatcacatataatgtactattttttcatcttttttataaggtgctgatgttggtaaaactatctcacaacataaattactttgtgtaacagttctatttagcataccttgtttatttacattatctgtaaagaaaatgtaaatatttcctgtttcaactctatactttaaaatttcatcaaataactctctagcatttattgattttttcctaatgtttgatttctgctcatattctaaataatatttttcaaaatcatcaccaaaactatccaacaatttttgagtatcttttggatcaaataatgtatagttttcattattataccatctttttacaaatacatcatctattttaatagcatattgtaaatttcttgctctagttgattcagttccaccgttatcttttaacattatcaagttttgaacatccatatgccatgttgggtaataaacacagcaactaccttttctggtagaaccttgattccatgcagatattgtagaatctaataattttataaatggaataggtcctgatgaaacaccaacaccatctataatagaaccagtagctcttaaagctgaaatatcacaagcagtaccacctttattcttactatatattgcaagattatcatttgtagctaatattgaatgtgaatcatcacccatcttagccaatacacaagatgacaactgacctttattaataccagagtttaacattataggtgtagcgtatgtaaatttgtgagttgaaattaaatcgtatatccttttaattttttcaactctgttattttcattcatacaaataaacatagcaactctcatataagttatttgaggtgtttctaattttattgtttttgttctatttaaacaatactttgtataaaacatactaatagctttatagttttgaaacaaataatctctattattatcaatatatttatctaattcttgtatttcattttctgaaaaattattaacaaagtcactagaatatatccctgatgaaagaccaagtcttaaaacattaccaagagatatttcatctcccatgttttttcgatatttaatgatatatagttttgctgcaaacttttcatacattggatataacatacttatttcattcacagtagtagataatatttcatcataaagatcttgtattttaatgttatctcttaattttatttttgattttgacaaaatattcattgcatatgattctttattatcacacacttttaataaaaatttatacattttatctggactgtatttttcaacagtcccattccttttaacaacatttatgttaatatcatctaattctgtaagtgatttaactggcaacatttccatctccattcaatattttttctaactcattttctaatatttcatcattatacacttctaactttgtatcttttttcataacaccttttgaataagtgatgctatcaacttcttgaagcatttgattttcactgcttatattttttatttcttggaattctttgactaagtctgtttttggtgcattccatataggttgaaagccacatttttttagtctatcatcaacaaaaaactttagaaaaccatcaatattttcaatagtcaatcctggaataggacccatagatagtaaatatttagcccattctaattcatcttggtaaactttttttgctatttttctagcttttcgtgacaaactatcatcaaaaaggtgtgaaaatccttgatgttgctcacttctaagagttttaataataaaactaaaaattacaaggtgaatatcttcatcgttatttattaattttataattttagttaaatttggtattttgttaccaccagctgaatatttattaatcatataagttgttaaaaaacttacataaaacttaacaccttctaaaaactgaattcttaaacaagcttctaatatttttaatttattttcatcattttcttctaaattgccttctagtaattcataagtgtctatttcatcattaattctagtttttatttcaggatattcacaatattcatcaaaaatatcagtagggtttggaaatacgctttttataatatgtgaataagatcttgaatgaatatattcaaaataagcctgtgtttttaaacaaccttctaatcctgatgatgttactagtggtattaatatattgtccaaacctctattttggccagaatccattaatgtttgaaaagttaaatttgcttttatttgtctttgattatgctcaggcaattctataaatgactttggttcatgaatcatactaatttcttctggaaaccataattgtgcttgttgttttctatctaaactttctaattgattgtgtgaataccagtcatatctttgaaaacctgagtattctccaaagaaaaatttttccttggatctatctgtcactaaattggttttactcaataacatattgtaatatccttactcattaacatcaaaaaactgttcaacatatattaaattatacatgctatataactcaatacaatttgaaatgaagtcatacacaatatatgtaattgaaagacttacaactatattatataatatagttgtatatttgttggtaacaagtaataaaatacaacaaattactataaatgaccatataagtatatttgtatatgtttcaaataccattgtagcatattcttttgggttttcaagatgtattccaattctatcaaacacttcaaaagcaacagtcaaactaacaaaattgataataattgagagtacacaataacatataattgcataaattcctaactgtttattcattttctttctccttataataaactattttataatttatttttttatcatctaaaatagaaatcatattctttgaaccttttgaaattccatcccaaaaaataatagccatatctgtttctttgtttaaactatcggccatcaatttatttcttataggtcctgctgattttccatatagattccagtttggtttatatttttctatcttaagagagttatcaataccatattgataacctaacatatcagcaccacgggccataccacatacaattgttgatggttgtatgtttaattcaagtattttatttttcaataaattataatcattaaaatctctgctaccagctactaataatttcatttgctactctttaccattgtaccaacacaactaccatcacttattttgcaaatatatccaccttcatctacaaagaaaaaatcaccactatatttcattccgttttgtccttcaattataaactgtctatctatagttataattttctgtaaagtttttaaatttataaacttacatattaattctttaattttcataagcatccttttttatttatattatataatattttaacttagattatccttaacccaaacaccttgcccacaatcccatactttatgatacccatttacttccatattctctgattcagtcaagtttggattaaacttctctagtttatctttaagcttatgtttcataaattgttgtcttgaatatgttctattattcttaaaataaaaataacctggttttgagtagtgactaaatgtaaatcctagctttttgtatatctcaccatttgaataaagtctatcagagtaactaataagacttcctttattatgtctatggaagtaactaagtaatttagaagcaccacctattacatttagtcccatttttgtgcataatcttattaattcccagtcatatttattagtgaatcttggcttaccaaaactcattaaacaaactagctcatctttgtaatacagcccataacagatagaactaccagtgaagccttggagatgatttttgtttagaaactctttctcttctgttttaggtacttctttaataacacatttcctagccattattttctcagactttcctaatttgttgtttataatactagtccatatttctttattgctgtaccatgaatgttcaaaaatgtgtagaagatgaatacctttattctcacattttagtgttttatccaaatgatagtctttaccttttccattactttcagaatgccagtagtctccattacattctatggctaagttatggtctggtaaatagaagtcaagttctctattacccaaaacagaataatcattttctatatagtcatctagtaattcagatatttctttttcaaatgagctagtagaagggttgcatataggacatgttattttaccttgtttaaagttaccataagttctattaaaaacatgtccttgtatacatcttacttttaattcatcagctaaattattagaaattatttcatatcctagattgtttatataatttattttactagtatctttacattttggacaagttgtaaagccatctttgaacttcccaaatgctcttttaaaaacatgtccatttgagcatcttacttctaatcccttagatagattttctgaaacaacctcatatcccaaattatttaaataatctaatttatttcgaatatcacatttaggacaattaattttgccatttttaaaatcaccaaatgctcttttaaaaatatgaccttttgggcattctacatgtaaactatctgctaagttctctgaaaccgctttataacctaaattatttaaatagtttaattttcctagtctatcacattcaggacaatttacagaacctcttttaaaatcatcaaacattcttccaaaaatatggccatgtttacattcaacttttaaacttttggataagttttcagaaatagctttatatcctaaattatttaaaaatattattttttcgtggttagtcatgtgtgttccccatattaatgtttagggggatataccctaaacattattttcggtagtttcgttattaggtgtaatattcagtaaagagtatttatattctagagcatctacaaaatctttattagagagtagctcactaaagaactcatcaagctgctcttgtgatgcactttttaaatacaactttttctctgtaaatggattaaaatgactatcaccttgtttttgtaggaatccaagttctaatcctagatcagccaaacctgaccatttatttataccgttatcaaaagtaactaaaataggtatttttgatttttctttgatgaatcttgatttttcaacatttattgtaaattgccaaccttgtaaattctttttactatctttttcttgtgcttttccaacaataaaaatagtatcagcactataaatcaccccagtgccaccggataccacttgaccaccccacaaagatccaatatcatcataagtatgatttacaacaaccatagggatctgtttcatagacaaataaggtgttacaattctaaacaaactcttgatatgtttgcttctttgcatatctacaactgatttttcatttatagcattttctatttcagctttacttgctaagtttcctaagctatctagaattattataactctatcaccatcttcgatattttctaattgatttgcaatatcaaattttaattcctcaacattcataactggtgtatggataactcttgttgtatcaataccaaagttttccatatagtttggagtgataccaaattcagaatcataaaaaatacatacagcatcaggatatttttgcaaatatgaagccatcattacaagtgcataattacttttaaaatgtttgctaggacctgcaattactgttagtcctggtgttagcccaccattaattttaccacttaatgcaagatttaacattggtactggtgtttcaacaaattcagttttaccaaaatatttactatcttcaagtttattagttctatcttttagagtgctattttttaataatttattaattaatgacattttataatcctttctaaatttaagaatattatattacaaatattcttaaatattacttaacttgtgaattaaacttctctattgagttataaagattattatagttaaattcaagatgtttatattgattgtgtataagtataaaatcatttggagatattaacagatattctttaccattaatttcttgtttcatgattttaacacctattttatgaggaatgtatttttcatcaagaggatattttaaatactctttttcagtaactgttattgttttggttgctgttgaacagccaacaaacataaatgtactaaaaattaacaataatatactgtgtttcattctcatcctttctaataagctttaatttttgtattttagtctcaacattttttatgttattaagaacttccttatattttacttctttttctctaaaaacctcaatagtaagattattatagtttttaagcgcttctaattcctttttagaattttttatattttgtgttaattgtttttcattttcaatcaatatagcatttgatttttctaatgaaatatatctataagcagtaaaagctaacaaagatcctaacaaaatataaattatgtttgactttataaatgaaaataaaaaattaaacatttatctaatttttttaattaaatttatttattttaattagatttttatagatccttttttaaattatttatatttaactttatcgtttttaaatatataataatttttttcatagattcaactaaaaattttgagtatatcatacttatatccttttttcaattatttatattttatgtcgtattttataagagcagctactaaagcacttagacataattctctatctctacttgtcctatcatgatcactataatgttctataagcattacagcctgtggtatgctttctaactcaaaaaatttatcaacatttttaaacaaatactggtaaaaaccactataacttactgtttgtgctataatttttctagcttcagtataatcttttttctttaaagcttcgactaaattggaataattattaatattttcaaatactttttcatctattactaatttattattaacagtattatgctgcataactattaacatctctctaatacatggataaaaacattgaataagtttctgtaaatctttcttatcatattctactttttcattttgtaatataaattccaacctatcaagtattttaacacctagttcagttttattatcattaaactctttatcaaagtctatacatgtaacacgagtcaaaataggttctattagtctatcagtataatttgctgttaatataaatctacaattttgggtatattcatctattatatcacggattgagcgttgtaattcatttgtcatcccatcacattctgataaagatataatttttaatgaaccatctattgaaacactgcttgcaaatgatgtaattttatttctagcaagatccactccactctcttttgatgagttaatgaataaatgagttgcacctaattcatcacatattgctttgtttaatgaagtttttccagttccaggtgtgttactaaaaaaaccaaggtttggtatttcaccagaattaatccattcttttatttttgaatgaagttggtctggtagaatcatatcatctactctagacggtctatatttttcagcccatatatattctttttcgtttatatttttcaaatcaatcccttccttttttctgtattatatattaactatacttaaaattaccttaatctataatacttcgccttcaatttgtttaaatacagtttttatgtaatcttttgattcatctgtaaactttaaaaacttaaaaacattcaaaatactttcacatataatagtattgtttataccattaaaatctttaatattatataacattagataccaatacacagtaacgaaagatatttgttttttattatattcacgcattacttctttaaacatcggttttttgtatttctcttctaataatgttatgtctttttttattatatttttatagaattttattgtgtttttaaacttctcatattctgttttattgtaatttcttaaataatcacataaaccataaatactagatggactgtatttaaacattatatatacacacaataaaatgaagtcacctctatcagaaaagtttaacggataaaaacctatttttttatccattatatctttgctatgagatacacataataatttttcttttaagtttttttgaaatgtaagaaacactccattagaaatattataaatatcataatagtgcaatttcatgcagtgttccttactcccatatatctatgttatatatctatgttgctttggtttgaatcatatcttgtaaatttgaatttttttaagtctttctcaacaatatccctgaatattgcatagtcagacaattctgatgctattaattcaggctccatattaatatgatttccaaattcaattataacatctaaaatacaatcatccatcatatctttttgttttctaaactcaaagagcttattaaaaagctctgttttactttccactactgccccatccaccgttattacctctaactaaattttttgtaatgttatcaaaatcatcttttgatatgttttctattttactttcattacattttaataactcaaactgacaatacttatcacctttttttatagtgtatggttccttaccaaaattatacacttttacttttaaattcccactccaagaagcatctaatataccaggataaacaaataaatcttttataaatcctagactacttctagtgttaaatcttatataatatccatctggaattattaatctaacaccattttcaacatactcaaacccaccaggttgaattgttttatcttctattgaaaacatatcgtaacaagcagagcccattactgatatttctggtaattttgcattactgtcttctagccatgtttttaatacacacatatttttatcctattaattaaaagtaatgattcatcatcaaaatcatatatttctacaaaattatcaattaggtcaagtaatacattaatacttattttaaaagatatttcaagtaatgattgtgggtttttgtttattatattttctaaattatccttcataagtactgacaaaacagtcccataacatggtagttttgtatcatcatctaatttaacagatatacagttcaattttatttttttattttctatacttttactttctctaacattttcttttaataattcataagtatgagaaaagttttcactaatcaacaatattgggtttaatttcaccaactcttcaaccatatttaaaatttctatatttttcatttttacctctttcaatttaataatgcatgaatgcctgttacagcagctggaataatacctcttgtaatagctgaatcacctacaaaaaagatatttttgctaaaatcctgtactgtaaaattattattataactaactctaggacctattatttttatttctggaaaatatcctttccattcctttatatgtagtatatcacaaagttccttaataaattctgaaagtgagtcacctaagttatcaaaacaatttaaaaactctaaagatgagttctgatttaattcataaattttaccattagtaatggtttctatttgtgataaataatcttctacatttacatttttaaaagaacctaaaatagcccagttagattttcccgtccatttgtcttttacatgtaatccataagcgtgtccatttgcttgttctctaataggaatagaatatccttttactttttctgttacaacttctgctgttccatgattaacacaaaatgttctcaactctttaagatgatttttgttaatattcttagagaacttaaaatcatattgaatattatttgctaactcttgaattgtattattatattcacactcaaacctaaatcctatatgaatttggtcagcaacggatttaatgttgtttaattcaaaggtttctttaatatctttcatgccacttctaccaagacctataaaaagtttatcataagttatatatgattcaataccatttgtatctcttactgttatacatttatcaagttttgaaggaatatatgtagagttacaataaattgtaacacctttactttcaagccattttatcatgtttttacacatttcaagccccaaagttgaacctatatgataacactcagattgttttaaagctatattaccataaccacttacaaactttgatcctgtttcaactggttgtgttatgtgtatagaagcattttctggtaagaacattttaaatagtttattttttaaaaaatcataatattctaaaacttgttgcttattaatgtactcaaatataggttgatcatcatgtagtgaaaatatatttttattatcactaaatgcaccaccacctagaagaccatttacaatatctattgtaggtatcctatcattaatatgtttccctttttcaataacaattacttcatcatgtttcatattaataatattattcataataccataacaaatagtgtatatatttgctacaccaccacctataaatacatatttcatataaccttccttaattttagttattatataataatttatgttaagaaaaacctttaactaaaggttttcttagtcaaatcataattaccatgcaacaaataatcaaaatagaaaaatattttctttaactctgatttattatcatctttactgccaagtcttgaaacatactttactatgttaccttcacaaaaattcaaattatttttatatataaaatcaatgggttctattgccagtttagtataatgctcaggtattacctcttctttatcgctgtgtttatatgatgatgctttataatactcttgtttaatagctttaaatacatccatatactcgggatcttgtatagcaacaacatttttattgtttatgtagctaagttgtgttattaagtatatctgaaacttattaaaattattactattacaatactgttcaaaactataactcattttttatcctaatattaatttactattatttgattgcttactaatagcatcttttataatagtttccaattctgttagattttctactattttctgagtatcaatatcagataatactaactctccaacataagactgtagtatttcattaatatcattaattttattttttatagtcattactaactccttttattatatttgatattatacaacatttaatcttaagattatcttagttatatattattttaatattttttatatacatgctataactatactgggctaaatctaacccacttttatttaagtatttgtcatacccccttcccttgtaataatgtaatatttctaagtcatcactagttttatatttttgcttaatataatttattataatagcagtagcttctatttgattttttaacgagtttatatgttttatattatgtttggctaataccatcttccacattttgtaatttattccacttattcccttaacattattatgtttatgttttactttatatttgaagtatgattctgattgtattaacgacattataaaaactggatttagattgtattttaaagatacttcaaatatgtagtttgttatttcagtagcgtttttgttattatattttgaaatgtggtttatcatattttgttttaaatatgataacctttcttgaataatatcttcaaaattatatttagcatgaaaaataactgattgtgatgttgttgtaaatacaatgcataaaaaaataacaatatatgttagctttttcattatagctttttcaatattttaataatattgttttagtagtttttcacaccccttaaactttagctttctttgttttggattcctacaataaatagtgattttcaatcttttttccaatgcttttttgtatttttttatagctctttctggtatctcatctaatgatatactatcccacatgttatcacacatttttgcttctactgaaatatataaacttgtgatatatcttctaaagtcaccaatttttaaacacaaactatttgctaatgcataaaataatggtccttttcttggagtccattttgcagctaactggttttttaatctcaactcttttgaataaaatgccaatattttttctttgttagaattacttgcaactttgtacatctcatttaaatctttaaaacagccatattttacaacagatgttaaaaacatgtcattaatattatttgttttttcagcgatatattttagaagtaaaattgaattctttatatttcctccatttacatctctggcccataataaaatctgcattgcttgttttttatcttcctgtttggcatatttgaataattttataagataattaatatcttttgagtaaaataacgcttttgcaaaatttttacaattaaatttcatatcattccttttatacttaaagaacaccaggttaagaatatctgaagattgaaaggagggacctatttcaggtctgcgtattaaccttatgtgttctatattattactcaggctatgatctctttaaaagtaaagagaaaattaacataataagcttaccataaccttgatatattcattaataaaatgaatatatcaagattatgatgcaatcataatctttcaaataatttatttatatcatccaaccaaatatctttaacgtgtttttgtgataactcattaaaactttgttgcaaaccactcaactgttcattcaaactatttatgctctcttcacttaatgaatataaaggcatatttataagtgtatcaatattatcaactatacctatattatttatttgtttgataatatcctcttttttctttctttcaaatataacctttttatccaaaactgctttgatgaattttattttattattaattagttcaatttggtctgaatatttagataatttatgttgttttctcttttgtatatactctaatttaacatctatatattcttttaaaatcccaatctcatctttataggttttaatgaaattgtttctatcagcacaagtaaagttttcggtatcagttgtttctatccctaataatttatgaatattttgattattccaaaaatctccacttacatttattacatattcaaaattgtcacctaatgagtagtctttataatcttttattatttttttctcttttagtgagttaaaatgtattaacatactctcattagtagcataaggtgttgtttctgttatttttaaattataagtgtctattttttcataaacacctttaaatttccattgttttttaccatgttctgtattaagtaattcaacagtacccttataacctttaaaatatgggaccagtggttttggttgtttgttatctaaaatgtctttaatagcttgtttaacatcttcagcacttctttgcattatattttgggcaaaacccacacccataccgttattgttaattaataatattaatggtaaagtaggtaatagaaactttggttctattttttgtccttcaaaatactgatgatctaaaatctcttcatcgtctttattgaataaaagatcataataatctgatttttttatagaagaatatcttggttgagctgatgttggtgaagtcctacatcctatagctgataatggtttaaataatggtaatgtaacaggaccacaatcaaaatctcttgcaaaatttgtaattatatcaggtaaaatatcttcattatgcaaatattgtgatttagatgctatttctgactttaatgttgaaacttttttataattagccaagtctttactaaaataaactattttacgacctgaatttttaaatccatcaattaaacttgctatacttctaatgttatcatatgaagcatattgacataaattatcattaaataatgtattaatattcatttctatcctttcattttatatattatataacattttaacttaaaatttccttaacccaaacaccttgaccgcagtcccatactctatgatatccattttccaccatgttttcatattctgtcttatttggatcaaatatttctagtttatcttttaacaaatgtttcataaattgctgtctgctataacgagtattattcttaaaatagaaataacctggtttagaataatgactaaatgtaaatccaagcttcaaatatatacttccatcagaataaagtctatctgagtaacttattaatgaccctgggttatgtttatgaaaatatttaaataatttagaagcaccacctataacatttgtgttcttcttagtacataatctaattaactcccagtcatacttatctgtaaatctaggttttccaaaagacattagacaaactaactcatcttgataatagagtccataacagatagaactaccagtaaatccttggagatgattactttctaaaaattctttttcttctgctttagatacttgttttaggatacattttctagccattattttattagattttcctaatttattgtttataattgacttccatatgtttttcttttcattccatgatgattcaaaaatatgaataagctgaatatttttctcaacacattgttctgttttagttagatgatatttcttatctttattcattgattcactatgccaaaaatcaccattacattctattgctaagttgtattctggtaaataaatatctaattcttttccattcaatatttcccaattattagttccacctgttaattccctaacttcttgctcgaatgtactataatttggataacaaaatgggcacaaatgatgaccttttgaaaaattgccaaatgtccttttaaacacatgaccttgttggcattttacttctaaattatccgctaagttatcagacataattgtaaaccctagactgtttaaataagcatgtttattttctgcttcacatataggacagaattgctgtccatttttaaagctgttaaatgttcttttaaatatatgtccttttcggcattttatttctaagtcattagttagattattagataatatttcaaaacccaaattgttaataaaactatgtttattatttatttcacatatagggcaactagtgtggccatttttaaaactcttatatggacgcttaaaaatatgacctttctcacattttacttctaagttagtgcctaaattattagacataatctcgaagcctaattcttttaagaaatcatatttttcttttttctcacattcagggcaacttgaaataccatctttaaaactcccaaatgttcttttgaaaatatgccctttttgacattttacttctagtttttttcctaaattttcagatataggttcaaaacctaaactgtttaaaaaagttattttttgtcctatttcacatgtagggcatgctgtatatcctttttgaaaatcataaaattctcgcttaaacacatgctctttagaacattttactactaaattagtagttagattttcagatattacttgaaagcctagagtatgtaaatactctattttctcttggtttgtcatactgaaggcctataagttttcaatattaaatgattttgtacttaatgtttgttttctaaaatcaatgccattgtctgacatccactgctctaaaactttttcatcattatctttccactcaattttttctaagcaattgtctataccatcttttgcaaaaacaatattataattagctgcagaccaacttcctaatcctttcatgtatataacttcagcatttttaggtaaattttttgcatctgcttgatattcacctaatgtataataccatctaattaacttatcattttgtaacactgagataataggtgtttttaatctatacactctaccttctgttagtaagtttggctgtaatttgtaaactagtgctgtaattaaacatgcaatatggtttccatccaaatcagcatcggtagctattaccatgttttcatattttgtttcaggtaaccctaagcccatagcttctacaatatccataactctttgattttttaataattgtgctgtagaacattttaaagcattttgtaatttacctgttaaaggtaagaaactactacaatctctacctattgcttgtattaaagaagaaagtgcgctatctccttccgctatatacataaatttaggatctttagtatgtttagtaaatttaggattaaatctttctttagcttcttttctttcaaaagtattttgttttctattttctaattcttgttgaactttatataactcaattattgggtctttaatgtgtgtatttttgaataatagttcagcaaaatcagtatattttagtgtaggtattcctaattcagttatagtattcttaatttcttcttttgtttggcctccaccaaatcttaaattctttttatttttaagaatcagaatgacacctatcctgctttttacagctgtatttgtaattttggagtatccctttcttaaacgattaccaaaagcatttacaatgttatttgaaatataatctaatgctaccccacctttatttaaatcaagtgaatttacaatatgcacaaacttatactcatcagtaggaaatatagcaagttctaagttttcatcactttgcaatattgagaaactatcagagtaatattttataaattctttaaactcttttactttaattagttttccctgaaatgtaaattctataccaggatttgaataagctatgtttataagtaacgcatgtatatgatttattaagtcatcattgatttcttttaattctagcctttcaaaatctggtttaaacttaattgtaacaccatgtgttgatgaagcaggcgctttgtcttctttatgctctattgtagacatattgtttaaacattttacaatacctctatccccttcaagagtaattgttgttaattgatactcagaactaaataatggtattaatttagaacctataccatgcgcacctattgtgattctgtcttttttttctttttctaaaaaggtatagttacttgatgttctaaacttggtagttgccataacataagtatctattggtaatcctctaccattgtctgatattgttattataccgttatctttgtcaatctttaatgatattttattagcgtattttccatcagttctagtaaattcatcgattgaattttgaatagcttcatctatttgttttgttaatgtttgattatacactatttctttattaacaattttgttattttctaagactttaactgtattattaaatgatgttaatgaacctgttataaggtgaggcaggtttaaataatataatatttcattatccatatatacaattttattgtctgtcattattctacactcctttatttattagttaaattatataacaatactccttaaagcgggcttaactaattttatttgtccacaatcccatattttaaaacatccagctggatcctgtgaaactttagttttagtttttacataaataggacttggttctaaatattcaacaatctcaaatcctaatttattatatgtactaacactttcatatgatctatccacataagtaactatatcatattcttttttaaagttctctaaaatatattcagcaccaccaacaacttctatatttaattttgaacacattcttattaacagatattctttaccattattcaaaaaagacattgcaaacattaattcattcttatggtataaaccataacatattgagctatttgtatagtaccataaatattcaaatatatggattagtcttatatttttgctttcacactctaatgttttatccaaatgataatttttatctttacccatttgctcagaatgccagtaatctccattacattctatagcaatttatggtttgggacataaaaatccaattctttatcacccaaaactgaataatatgttctcctggatatgtgaccatttttgcacatgagttctaattcttctgattttttattttgttattttttttacatactggacagtaagttataccatttttaaaacgtgcatatactcttttaaacgtatgtccatttttacattctacttctaaattgtcacccaaagtgtatgatataattttataacctaaagattactaaatagtcttttaaaaatgtgcccatttttacacatgagttctaattaacaacattgtacccaagtgattgtatatattctattttattatgagtttcacacttacatttcactatcaaccctttagataagttttctgaaataacttcataaccaagattatttaaaaaagatattttttcttccctttcacatgcaggacagtgtatagtccctcgcttaaaataatatgtttattaggacattcaactatgtttgccgaagcatctataagcctatatcctaggttttttagaaactccgacttttccataataatctctaaattaaccctatctttttattgtttatatttttcatatgtgatatgtcattttcttttagataatttttaaaattatttttacaagcaatgttatatttttctccttctataatattacttaaattacactgaagaatgttatcatttattaatttgttgaatgattttttaggtaaaccattgttttcccatattttcaaggcttcttttttagtcaatgttcttaggtttaatatatcaaatgttctacctgctcttaataatgctggatcaatctcattaatgtttctatttgttgtaattataaactttgttttacatgtaatatcattatttataccttcagtaaatgataaaaagtgtgacataaattgatttcgttgtgcatctataccattttgaatatcagatctaggcaatagataatctaaatcatcaaataatactaaattgtacctatttgctaataactcattccagaacgcatcaccagctaataaactctcattctttacaactgcaacatttatacagttactatcatcatctgacttatcaaatactttctcttctaattcaagatgtttatatttcttataatccaaatttaacaaaaaatttaaataacattctgcaagttttgttttccctgttccaggttggccatataatattaaaatattgctatttgcaaatagaaactgtataaacatttcatttaaatctagaaaagggtaataatcataatcaatatttttataattatctttagttttagatgaatctacatatactaattcccctttttcttcatagaaactctttattttgattaataactcatcagtaccagtaatatatttctttaaaatattgttatagaatccttttaaaaaatctatactgtttgaatacatatctaactgaacacttttacctattctataagttatttcaatgtatatgttagataacctaaaaacaaatatatttttatcaccttcaataccatcccattcataataagaagtttttaaaaatgtttttatttcatctaataattcatctaatttatcaactgggatttttatattttctaactgttcattataattatcacatataaacttgcttttcaaagcaaatccaggttttggtgttccaaatgcattatctgaaattacatgtttaatactcatacaattctccttttttagagaattgtattacttaattccttaaaaatatcttagttagtataatatattttcattatgtatctcacaaaatcttcttaaagcctgtttacataccagtcaccatcatcttcttcaatatgctgtataatttttctagagtccattatatccaactcttcaaacatcctccaagctgtttctgcatctataccatgcaatttcttttacttcagaaataaaatcatcaaaatccatgtcagcttcattcaatttagtactactttttttcctttttatttttattttattttaaatttaattccttaaaaatatcttagttattataatattttaagctttcaactaatacttcatgaaacacatttaaatcttcatatgtaattagcatattaatttcttttataaagtcttccaaacttgtaattggttcaacatcaaactcaaaatcatgactatgttcaatattatactcttgaattatttgcaatgtttcattaatagcttctatttcatgtccttttgcaaattgagctaaaccgtttatagttatatcttttattaactgtttgtccattgtatatccttctttctaataaatattttaaaatatttattagaaaggtttataatgacttttgttgaaaaaaatatgattaaagaactcaagaaaaccatatcagcaaaaaaaccattagttttatgttttatgtcaaaattactacaaaaagaaatacaaaaactcttaaaaggtaataaacttataactattataaaaattatattatatgcttttgataaaacacctgttgaagtaaaaagaggggttttaggatatgttgaaaatgaaaaaaatattccatttcagtataaatatgataatataacaaaaacactaacattttcattaaataaaaaatcatattattttaatttatgcactgctaatgaatatattaaagtcttagcaaatgaaactaattggatgattttaaagaagaatttaaataatgcattaaaaaatataaagtaggatatatcctacttttattaatattctactgtaacaacatcatttttatatactgacatttcatttgtaaatgttatttttgttaaagtactatcatgtgtataatttgttgttggaataaggtttccattaacatatacttttgaaggttttaatgaaagagaattatcggaaacttctgtaactggagtattataatcacttgaactaacagttatattaacagaagatgatatagaacctccacttatttttttccattttgatggacttgtatctggttgattccctctatttccatctgataaagaaacatatatagaattgttatattttactatttgattttgtgtatatgttgtgcctgtatcccaatttgatggatcagtaataccaataattgaattcacttgagacataacagtatcaagttccctttttaattgtaaactaggtttccctaggacatcttgatctgcaatttcaccatttttagggcataacttttcaaattctgtatagtttgtaatagccatttataaaatctccattttatttttatttatatttaatagcttatttgtggtggaaaaggatcaaataaaaatgttacatcaaatgttgccaaaccattactattttgatcaagtgataatccaccatgacttcttatcatagcacattgtgtatctataataacatgtccaccatttttaaattcattgttttgtacagattgatttatgtaattcctagattctcttaatgttcttttccttatcttaataatccacatctgatcatctggatattgatcttttaaatgaccagtaagttttttaaaagctgaatataaaaaaccaccatcactatctctaaaagttatagttaattgttgtaattcgtgtcgtccttgggtataaacccaactagaacctatccattcatttatttcagcaaatgaaataggatctattgaaactctttgtattaatatatccatatttggtaagtcaagaatattaattctaccagcaccaggaacttcattttttaaagcaaaagtatcaatgctatataaactttctaaatcaaaattaataccatatgttttttgtattttttgtgctaattcagttatagctgattgtgttttatcaccaccaaaaaaatctgatattgcaccaacagctgtatttaatatacccataaaaccctctctataaatattactaatatttatagagaggaaactatggaattagaagtttggaaaggaaaacattctgttttattaaataaattatataatgataataattatgtttatgacagcgatattattgatgttttagtatataaatgcctaaaccaacctaaatatatcacaaatgatgaggctagatttctattttttaagaaatatttctctgaagtatgtagtgaaatagattctagttttaaatgcccatactgtaatgaaatgaataacataaaatttactaatgatgatatctctataaccgaatactcgttagaacctattgaaataaatgtagataatattattgttacaatttattttaaaaaagaattatcacaagatgactctttatgtcttattgcagaaacaaaaaacatgatagaccacgagaaaagattattagaattatattatatgattgattatatttctataaatggtgaagaattaagaggtaatcatattatatttgaaaaatatattaatgaactcccattatcatgttttaatagagtatttgattattttagagattctataccaaaacatagtattattaaaagttgctcttgtaaaaattgtaatagtgaaataaatgttgaattaaaagaattacctgaatctgttagaaggaacttattttgataaaagacattgttattaataacaaacattactatttaaatgtatggaagataaaagatgaaataggtatattacatcaatttattgattggattgaactaccattagaagatcaaataaataaaatagctgatatattaataccacaaacaaaagatttggattatatttcaagattatataccatgataatcttatcgtcttatgctaatggtgattatagtgatatactactaacttgtccacattgtggtaatcctattgatacaagaataagcataagagagaatttagaatttatacctccaaaaactgttgaagttgaaattaacaataaaaaatatactatttcaaaacaaaatattgaactgtgtaatgagttaccattaaaagattataactctattttaaatcaattaaatgatgatggtgatttaaaattatgtgctaaagtaaaatgcattatgtgtaataatgatgttttagctgtaagagaattaaaagatttatttgaaaattatgttataatgcttgatttagaatggtattattctacacttaaatattttatatcacaattaggttttagtaaaacagattttgatagtttatatccttttgaaattgaattgttaacaaacgaggataaaaatgagtgatattattaaaatagatggccaaatggtttcattagatgtagattctttaaaagatgcttctattgaaactattgctaaaatattaaattatactgaagatacatttaaacctttgctagattatatgtctaacaatggaatcccttattatatgattttatatggaagatttaataatgagtctttatataaacaaatgggaataaacatcctaaaaacattaggtgctgttgcaatgttattcccacctgtaaggttagtaggatcaggttctagagttattactgttgtaccaaaattagtatttagtaaaggtggattagtaaatgttacattaatatctgctggtgcagctttaaaaacagaagaaaataatgagctatatacacttgaaactatgcttaaaaatgcaattgtgtttgtatttgaagatattatagttagtacttttaaaatggctaaagatggtataatgaaattaagtttaggtatagctgaaaaaataaaaaaagatggaagtgttttagttaatggattacctatatacttatatacagatcttgataacatggatccaactttattatcaaaaaattcagaaacttacgataaattaagacctgatttattaattatttttgaatatatcacaactcaagctaaaactaataaatttgttgataattattattttgaatctttaagtttaatgaaggaaaaagatccaaaactatattcaatggtaaagaattcaatatttggaaaacaacatgtaagacaaggatttataaggcttgtacacaacgcaatgtattatttttcaaattcttatgaagtaacatatgatgattttaatgataatatagatgatgtcctaccatctaatatattaaatgattttaaaaaaatgattttggacaattctttagaaccattaaaagacaaaaaagggaaacaaaaaacatcactatttggtgataaactatataaagtagtatatgataaaagtgcctcacaaagttataatattggagatgtacaagatcttaacaggttaacaaaagcacaattctttaatgtaaataaaaaacttcaaaatcagacaattttgagtcaatttgatatagaaccacagaaaacagaaaaaaatactgcaaatgtttcaacaccatctactataataggaagagtaagttctgcattacaaaaacatgtaggtagggcaaaattaacatcagaaggagttgctcatgttaaaaaatatggtattactacaacaaagtcaagtcttactttagaaggttttgatccatctaaatattatttttcatatagtggtagtgaaccatttaatactggtatagaaaaattagattcaaaccttttatacaatttaaatctaatggcttatgattactttaatacatataaaaaacaatttactgtaacttctggttataggagtatagaatcacagcaaaaattatataataattttataaatggtaagggtagtcctgcaaacagacctggatattcattacatgaatatggtatggcagtagatattaatagtgcagatgcaataaaattagattctagtggaatgctttcaaaacatggtttttggaggcctataccaaataaggaaccttggcatgttcaaccaaaaaacattactgataaaaacggtgatggtatgcttgaagctgatatcattgaaactaaaaagaaacaagcaaatacattgcaaaagacaaaacctataagtactactattactccaattaatacaaatgtaaaaaaacaattatctacaagtacaatagtttctacttctggtaaatattattctataaatataggtagatctatgtatgtttctaatataaaacaagaaaaacctataaaagcaaatacaagagatgttaaacaaaccacaaataaagttataacaaatgtaaagactattgaaccaactgcaaataaagttataacagatatgaaaacagaacctattaattattctaataatacatcaaaaaagtacgctccagaggacacaattgaaattaataaagaagtaaaaagattgggtgatgagtttgcaccaaaaaataataaaggtgcatctattcctggagatataggatacaaaaatgctggtaatggcgtatctatccctggggatataggttacaaaaatactggtaatggcgtatctattcctggggatataggttatgaggagaaaaaaatagcaacttcttatgatgttaaaacccaaaaagcaaaaaatataacttataaaaaaggaaaagatgataatacctattatacatcagatggtaattttattaccaagaaaacaagaacatatgatgatggaactaaagaagattactatttaacaaatactggtcttgaattaacagaaaatatgttacaaaatgatacagacgaacaatttactgaaatgtcaggattatcaaaggatcaatttcaaaaaggtattaatttaataaataataaacaatcttctactaatggagacggtgataaaccttctgttgatgctgtcaaatcagttgaaattacaaagaaattaggattataacatggctgaagtaattaatatacctggattagataatgaaaaatatttagttaaaataacagcttacgatattgataatttaggtatagggaaggaagttatggattcctgggatgatttggtaaaaaaagttgatgaaagcggatcaactgatattaactcagaaggagagtactcatctatagatcagctatccgaaacttcaagtaatatattaaaacgcacagttgagctaatgattgatagagattctgctgttatatcaacagatgctgctgggacattctatttccctctgccaaactcattatcagaccaatatgtacaatcatatgaagtacagtctatgaatttgttaggtagtgctatttcaaaagcaagtagttatgcaggtcaaacttctataaaaaatatatctgaacaagcattaaaaagaagtggtattcaactagatcctaacattttatcaatatataggtcatcaaatcctagaaatatagatatgtcttggaatataataccaaaatcaagaaaacaatatgacgcttatgttgctcaaataagtaagttaaaaaactggacaaaagctaaaaggaatcctattactttaggtagtgtaggaaatataatacctatgaattttttgattatgaaatacattttttgtatagaaattatttcactgcaaaatgataaaacacctttagtttcaaacttattaagtgcttcaagagatattacagaaggcttttttatatctttaataaatactaatatagggtcaaggcaactaatgctgagacatgatggtaacccaactgaattttctcttagtatccaatttattgaaaggaaacctttatggagagatgattgggaaaagaaaataaatagcctatataacgatcaaggtaaatcagaaacttctttaaaagaagatgatatttataaagaatagaaaggatgcaattttatgaatgatacacaaactattcaaatatttgatttaataggtgactcacaagctagagattatattgctataaaagcttataaaataggaagtgatgtatctggtataaaagatagcattaatgatattttagatgatgatccatcaaaagtatttgataatatcttaaacatggcagagaataatatttcaaatattataaacccatctaactgggaggcaggacctagattaaaacctggtgtgccatgtgaatacatttggatattacctataccatcatctttagcagaagcatttagccatgaatttaatcaagatgaaatagatccaataggtgatatgataggacaataaattatggcatctataagatcatttgtgaatttttttaacaagggttctaaaaaagtacataatacagaagtaccaccacatacaataaagcctagtggaactagaccaaaacctaataaaatgtctacagttaaaggtaaaattaaaaaaggtggtgctatagttggaatggcaactggtgcagcattaccttttgggtataatctactaaaacggaataatatcaggactgaccctcatattattaatacatataatgggacaccaaatagggtctttaattttgaaactattcttttacctaataatgcaaagcatgcagaggatattgttaaggcgttattacagttgaaatcaataatgactgggactcaattgggtacagataaaactggattattgatatcacaagattatgtttttacaatagaatttggatctaaagatccagctaaaggtgaacagcttaaaaaaacattaaataaactcttacaattaaatcatgaagaaaacggagaaaccgaattaaatcttaaaatgtgtaatattaattacatgggtcaggcatctgctttatatggaaacggattaccaagagatttatctgttgcattacaatttgaagaaaaacgacctttaagaatgacatcagatattgttgaaacaactgatacatcaaattcaaatgggaatgaaaaaatatcagaacctaatataggactaacagaagaggaactaaattataaatattcacaagatgaaaatagttaatttataatacaagggcaagttatgaaaaattctgttttgaataataaaataatggttgatttcaatggattttcattatctcctacatattcagtaaatataccaaaattaagagaatttatgaaaaataatttatcaatgttttatgttaaagaaatgaatgataatgttagatttgaagtattagcattaagagaatataatgattcatctttatgggatattttgatgattttaaactttggtgaaaatggtattcttaattttgctaaaggcgatacttgggtaagtgataatgctgaaaatcaatataaagaacaacaagaatatttttcacctaattttaaacctgaagatctatataatcaaatactatcaaaaatacaaaaaaagaatgaatcaagaaggaaagttatttttataaaaaggcagtttatacctcagtttaaagaatccataaaggatatgttaaatgttttctgattttaaaattatgcctgaagcatattatgcaatacttttatattcaaacaataaaaaatctgaattaccactagacccagctaatatatcagattttacaataatctgggattataatgatttatgcgttgaaggttatgttatttttaatgatacccaaaaaataacagaacttttaccaccacataacggaatatgttttaaagtttcattaaaagatcattttaatattaaatttgaaagagtatttaaggtaacaaaaatagacagagattttgaaggtcaatctattgccactataaaatttgagttagttgatgaatattataatatgtttgctaatacttttatttcaaaagggtacaataatgtaaagtcaacagatgttattaaagatatttttagtacaaaatctgatttaatttcaacaccattaaatgttattataaaagatacacctaaaaatacctatgagaattatgtaatacaaggtaataaaaatctattatatcttctaaataatatgcaaaaatttgatgatttacttattattaatactagaaaaggtattgttgttatacctactgataatataggtaagttagcacctgatctatcaaaagtagtaaagttttcaccaactcaaacacaagaatattcaccttattctgttaaagactttacattaatacaaggtgatatgttaactcaaaatgcaattttaccaccgtctataacttatcaagttgattcaaaaagaattactaaagaagaacacaatacaaaaatatcacatggtaaaagtggtttaaaaacaagtttaacaataaatgacaaagatggcattcaaggcataaaaatattcccatacttacataatatagttgattcaatatataatactgaaatattagaaagttctgctataaatattaatgtggctggcatgtttaaccataatttaatgtgtaaagtgagttttgatgcaaattcatctattgaaacattaaaatcaaaaatgccttatgttactggtgaatattttataactaaaataattgatcatatatcatctggtaatgtttttacacaaacaataacattaggaagaataggttctgtatgagagtaaatgaaaagaattttaaaatattaacacaaaccctacctttttataaaggtgtaattgaagatgataaagatcctttagaatcacaaagatatagagtaagaattattggtatagatgatgaaactatacctactgaaactttaccttgggctacttcattagatttttctttattttctggtatgggttttacaagttttataaaaaaaggtgcttatgtattagttcatttgtttcaaaatgatagaaatcaacctattataataggtgttttaaaaggtgttaataatcaaaatgaagaattacaatcatttaaagatcctacaggtcaatatcctttaaatgattataaaaatcaacctgatacaaacaataaatcaaaaggtgaaaaatacttaaaaaatcaagtatttgaaacagaatcagggcattatatggaatttgatgattcaaatggggatgaaagaatacatatatttcataaaactggtacagaagttctaattgataaagaaggtacagtaacaataaatgttgtaaaagatagaaacttaaatattaaagaaaaccaaacttctgttatagataagaatgatacaacacatataaaagaaaataaaaacttaactgttgataaagataatacaacaaatattaaaggaaataacaccataagtattgataaagactgtaatattacaattaaaggcgaatgtaatattacagttactggaaatgctaatattaaagcatcaaatattaatttaaattaaataattttttaaaaaaacatttaattttacaatgtttgtgattatgtgttagtttctcaacactaatattaatttcatttttcttgtcatctatttttttaataatatcatcaacattatcatcaacagatatttttacatctggatttaaatgaatttctttagctgaattaacaatgtagtcttttgctaaaaaaataacattgttatcagattctattattatattctttttaaacttaatgtaaatatttttttcatcttcttttataataatattatcgttaaaaacttttgaaagcggtttattaataatttctgatatcatgattttatcctctgaatacattattactcccttgagcgattatacctccacaattaacagcatcccctataccacaagtagcttttgaatttgtaaaaacacttgtgctaccacttgaactatttctaccatgcggtggtgtatcagggcatgcgtgtgattgtattttatcacctaatctatgaacagctattgaatttgcaaaaacattagaacttgcttctattgtaggtgaaggtggataacaactatgtcctaatgctatatctcctaatctagttactggtggcataatattccttacctatttaaaataaacttaaaccaaatgctaaaaaatagcctttaaaaatatatgataaagcacttatacctaataataaaactattaaaattatactacagcaaataagcataaatatactaggaccatacctgtattttttactaggatatagattataacaatttacatcatactcattaaatactctgcgtataatttttgatgtgttttccataaagaagtatgaatcatcattttctgaaagtaatgttttataaaaaccaaatttttttctagcacatattttataatatcttttttgtttaaaaaatgttctacctaatttaattttaataatatcataatcatttatattttctattgtatctttaagcctatcttttaaatcatcatcaagtttaattgtaacacttttttttcttaaaaaaatattgtaatttttttccataattttatcctttcaatattaatttatcaatattatatcataatgtacttaaaataaacttaaaccaaatttattttaaaattgtttttattaggatgatttttcataaactcaacagcatcagtatatactttatctccgatttttaaaggaaattttgcttcatcaatataatttttgcaaaataaagtgcttattatatcattgtcttgcaatatggtaatagtaacatcgcttacttctgttactgtattacctaatctagaacctcctgaatttacttgtactgtataagtaagtttgacttgaaaattaaatgtaaaagtttgcccattttttaataaacctaaatgcctccaattactaccatctattttcattaattgatactcatatatagcattttttgctgaaggttgtttgctaagaagttctatatcaccagttattaaaccagttttttcatctatttttaaatgtaaaggaatgtcacctaataattcccatttcacataactttcaaaattattaggtggtgtaaattttacttggtgtttataagtagataactcaaaaggtggattgtatccaccttgtgcttcatttcttaactcaccactttcaagccccattaaataccttatttaattaagctatcttttcccaatgtgagtatgtgaaatcaactgtaaactcttgtatagaattaattttatctgctgctacttcaatttcaccaacttttgaaggccatacattaaaaaactcataagttgcaacaggctcaccattacaattaacttgatgaaccttagctgtaaccattaaactatatggatcacaagtatgataattgtttttgtacacatcaattttatcaatccatgttaaaaatttcgctctaatattatgatcaggtgtttgataaaatactgggctccaagctgcatcaaatgttgaatcacctggtaattttaatttcctaccttggacaaatgcttcaacttctccaagagttctttctggaaaactagcagttttacataatataatatcctcttctgtaaatgctacttctggagcacctaacggagtacctatttctataaaatatttatcactttttgctccacctttaagagcatttgctaatttatcaactgtatataaaggcattttaatttatctccatttttagtattatttatactctttcccagtaagtataagcaaaagtaacttctgttgatgatatttcttttccagaagcacttaattcaacttcagctatatcaatagggaaagtataacatagtttaaatttagtttcagttttaccatcagatgataattgtgatactattatatcactcatataaccagcacctacactattaaaaccaacatagttacctaagaatattgattgtgtaattgtactatcaaaactatcaattctataaatccaatcactaaataattgatgaatatccatatcaggtgtattataaaatgttattttatgtgtattattaaattgtgctgcacctcttataacaaatggttgcccacgatgatacacttttacagtactcatagacttacctggaatagatgttctattagccattatacttaaatattcacctgatatatttactgttttaaaaaacggtagagacctcaatagggtaggtatttttatgtcaattttatattttgaattgatggcacccccttgtttaagggagcttcttagtctatcaatattatataaagacatattagaatattaatgtccaagtaattcttaatatagatgaaacatctttacttctaacagcaaaggttcgcatacaaaataaatcattacctgcatataaacctgcttctgtataaccaacagcacctgatgttccattaccagctgttgttgaaagctctattctatatgtaattgtattattactattagtaacttcaactgttgatccagcacctacatcatcttctgtaacaacagcttgtccatcagattgtggtggtgtaaaattaacattataacaaaactcaccttcttcttcagcaaataattgagttctagcagctgtaaaaccttcattggctgtttttggcatcatcaggttattaccaatatgtcctctagttcctaaaacaagtttatttactggagttgtgcttctaccagccatgtgtgaagctagaacaggtcttgatccatttacaactaagttatgtttttcaaaagtatctataacatttctatttttatctaataattcaattttaaaatatccttttggtggattaattgattctaccattatttttccttatttttaaaatatttatatcaaaagcgtcatctaatataacaccattatcaatatgttctgctcctatatttatattacctactttaaacgaaccaactgttatttttatatcatcattaacaactttttcatcaaagttatccaatatagttgtataaaaattagttttaagattttttgtaacagtttcagaatattctgttgggattatctctctttcaatactaaatgaatcatcaagaactgcacctccttctggattttcagattgtgatccaactttaaaagaacctactattattttatttccaatgatattactaatacctttttcatttacagcattatctataaaatcattagttgaatatatatccatatcatcatgtatatgttcaaataaacctctatttatagcatttgtaagaaataatggcattttatctggagtatatttggtaggatcatcaggtaatgtataaatagtattatcatcaattttaccaattacaagagatgaataatatttatcagctactctaaatttatttacaatggcttcacctataataggcgtatcaaaactgtttaatctattccatacacaatcatatactataaggttgttttcggaattatcaaattcatcttttaatctaaattttagagaaatatcataatctaattttaatatgtatgtattattccagttttctattacgctaccatctttttcattatatgttatagaaccattaaaatcttttattaattgtttcccatcattaaatgttataactattctttcttggttttgtatatttttagaggtatagatatcttctactttatctttatcaaactcttttttataatttgttgaaacaatttctaaggtttttacattgaagttaattaaatcatctatatactctataaattctaaaacaagacttataacatagttataaccaaaaccaactggatgtgctattgacttaacactaccttcatataatataggatctagtaggccttctattcttatgaaaaacggctcattagggttatcttctgtaccccattttaaattaaaaccacttgaaccatttacatctaaaccaggttgaagtcctgatgcaaatataatattgtaagcatattctattgctacatcaagaccttttttttctttaaaacttgtaaaattaacaaaataatcttttaataattttttataaaattcttttatatcaaatggttgataattatcagttgtacctattttttctttcattctctgaattacaactggatttgtcaatgctttttgcataccataatataatgattctgcatatattttaacaatattttctgttatgttattattaggtcttttaaatatgttatatatatctaatgaatatggatttaactcatctaaaacctcatatagagcttccacactatctttatgcagtttattttcattataaatgttgggcaaatcaacacgatctatcatataacatcactttcacttacaaattttactgaagataatctagctattgtatttttataaaatgataggttatcatcagaatattttacccttatatattttggagttacattatcaagactgcttaaaactatactatctgttatttctataactataaaccttcttctattatcatatattattttataagttcctattattgttccatttgcaaatatattaaaacttatattagtattctttataattaatccatctgaagtgacaacatttttaccattgaaaactgctgattgaccatttcctacatcaaaagtacctattatagcattagaacttcctataattgtaaatccttttataggatttttaaaatcaacttctaattttccaccaaagtcatctgaacttatttgtggtaataagttaacatgtaattcattttgatcatcctgtgttttagttattatttgctcaaaaggtatagccagataaatatataaaatatctttgtttggttctttatttcttaaatataaaggtatattcatactaacatctacttgtatacctgataaatcatataattctgttcctaacctttttataacacttgaatgaaaataagaagattcaaaaatttctatatctgatttaaaataatcttttaaaatattaaataatttatcctgtgtttcatttttcgaaactacaatattttgtttgattatccttatttcataatcaaaatccatatatataggatatctattatgtaattccatagtcattattttataagagtctagctcatcaaatatacctttatttactaaatatccatttttatctaatgtattggatcttagctcactttgttttaaataatatgaatcatttttatttactaatgaatatgtttgtgttgtttcatctaatgaaaaatcttgattacggtattcagggataaatgaaaaccaaatgtgccctagttgtacaacttgctcttcatctccaccccacacttgggtttgatatatatttgtatatctattacagattgcaatataatctcttactgtaactgccctgtttgctgaattatgaaatatgggagcattttcttttattgaactattggtttcttcatcagtgccaactatttttgtttcaaatttatcaatttccatgagattaaaaggatatgtattttgtgaaaatgaaaaattgtcaccacacttaccactacttcctttagattctaaatatgtaacttttacggtacttcctggtaataaatttgtacctatacctgatattgaaaaataaatatcaacaccactataatctatgttatttaaaacaaaatattttttatttgtatcactatctgcatctatcataaattgatctgacttttcccaatactcatcaactttattatctccagtttcgatatcaatataagttacaaaaacttcaagcccattttcttctatattgtcttgatataatgatattttatttgaagattttatacttctattttgttcaatagctttaatagtaaaaacttgtgtgtctttatttttgtcccacttatgtaaaactccttcctttacatctattgttatagtggatgcttttccagtagttatatctttattagataattcaacttcaatatcacttcccatataataatatgtatttgaaccactattaaacattgtatatttgggtattgaataaactcttttatcttcgttatcatcatcttttgtattatctttcaaaggttttattttcaaagaataaacataagatacttttcttgatgcttcatatcctaattgtctagcacccataagtatatttttcctatattgagcagttgataatagcatttcacctgcttgaaaagaggtatttacatttatactataagctaaataagataatatatctgctaatagatttgcatttgaactttttacatcagcactatatcctttatttttaagtaattttattacttcatcttttatatcatcataattatatggaattaaaatattatccgccattatccaacctttatgctagctgtatctgatatagttgtgtctttaactctatattttatttcaatatatacactattatcagagtttccttttgaaatatttatattatcaactataatacgataatcaaatttttgaattgatgtttttaaagatgtcttataagcatccaatgcaactgagctatattgatcaaataatagctgagcattatttgaaaattctggaaatccagctatatccccaatagtagtgcttacaatattttttaatgacacataaaaagtatcaacatttactatatctttttcaatatttttcggatttatatctttgtattgtatcactataaataaccttttaaggttatttatagtattattttacaactttggatgggatcaggattataagtgcatcattattttttggaattaatttaagcaaatatgtatcttgccttgatgtatgtttatgtaccgatacaatataatctgttgttggtattctttttaaatttttaatacttatgaaaatatttgcctttgaatttattacatttggtgttacatttaatgaaaattcattaccatttataccttgttcagaagtagaaacagtaataatatcgtcaatatttaataccatatcatcaaatcctaataatgtagcagctttcttaatcttatccgaaactgtcatatctaactcaaaagaagatactagctcagcattattaacattttcaagtattgttggctttacaccacaagcattagacaatgcttcaacatttgtagtaagatatttacaactcatcccatcttttgaaatatgaataatgtttttatcatccattgttatgtttgcatcttcaccaattatttttaataaatccataaactctttaatttttagaataccaaaatctttaggaaatggtttattttcaagcttttccaagtcaataaaagcaatgatactaccagcactatcttttatacctgttaattttgatgaaaatataattgattcattgatcagttgtaatgaatttactagcgcaatagttttactattaagtaacattatattcctttcttataaagtaaagtggtataacaccactttaagattaatttaaataacttctttgattaagatgcattacattgcagcttaatgaagcaccactaacataatagcctgatatattttgaactactaactgtaatcctaactcagaacagatttcatccataaactcaattttatctttttccatttcatatagatctttatcagattttttattcaactctgaaatatcagatggcgtaataactataccaccaggtaataatacactatttgtagttcctgctaatgcaaaatcatattgatctgggtcatcatgactatcaacacctaatggaattacctcaacatgtttttcaagttctttaataatatctttatcaagattatatgtattaaccaagcatgcctctgtatccggtcctaatgggaatacattacaatctagatgatataaatattcatcaatactagggaattttataatttcacagttgaatgtttttgcaatccaatctaaagctgcaccgttagttctattaccatcagcacctacatacacattaccatatagccattttaagtctgcttcaccttcaaaatacataggttcacctttttcattagcatcaggcataataataggatcaaatccaagttttttaaaatactcataacctacttttgtttcacctttgcgtggttctgacttaaaattactaactaatactctacgatcttcatttggatttaaatgtgggaaaatcatacctaaattagcaacataggccaaatcctgtaaacctttttcagctggtattgtataaattgatgctactgagctgattgttttttgcaactcaaaaaactgcttttcaatttttttaatatttggtgtaaatttaccatctttttttaaatcttccatccatttgttatttggtgttgaatcaattataccatatggtgcagccattaacactgatggtatgacactatttcctacaaagttttgtaacatttttactcctttaataattttattttatatttacaaaaataaatataatgcaattatactatattatgcttagttcctccttaatctggttgatctatatcaaaaaatcttgattgtttaaagtttatacctatatatttttgagacaaattaccactatttctgtttttagtgaatgatacaatagcctgacctaattcatctaattctggtgatctatgcagcattgcaatagtatcagctgtttgagctatacccaatgattctgctatggtgctagtatcagcatttgaattattataagcatttctattaagttgtgctgcacttaaaacacattttttactttctttagcataagcatgtagttcttctgcaatttttttataataagaatataaacctacactaggttgtaaagcatacgaagccataagtgccaagtaatctattattatacaatttaaacttatttctaaagatgactctactttttgaactaatgattttaattgtaaaacatcaaaactaccagcaccatattcttttacaacacatcttcctaagtttggtaaacttttatatccttctgaaacattataatttcttagttcactaatatcaatattaaaaatattactttctattctatcccaaatttttattgaaggcatttctaatgttatataaaggcagttatacccttttaacatagcatttgcacaaaaatgtgacaaaaacattgatttaccaccatgtgtaacagaacatatgaaattaagtgtgctaggcatgtaaccacctgctaaaacttcatctaatatttcaacacctgtggaaataccaattttggtttctcttcttaatatatccctttcttgtgcatcaatatctttcatgcctatatcagtatccattgtaaatgatatagcttgtcctaacctttcatatatcttaccaatatcttttttttcttgtataagttttgcaccttgtataatacaagatctcatttcagcttgttttataaattctgctgtttcattattaagaaactctggagatacattttgtttatctaacataatctctttaaacctgtttatacagttttcttgttgctcatctttaaaattatcttttaactttaaagctacttctttaggtgtaggttttttattatactcttttacaagtttttgtattgttttgtaaatatcagaatctacgccaataaaatgctcaggttttaaaattgaatatactttatcaaaatatatttcatcattaataagactttttaaaattaatccactaatcattataatcctaacatcaattttactgtttgttgtttattatcaacattatttaaaacaatacaattttcggttttaataatattaatttttaagtgagatatcctatcataaatcatcttaagatcacctgaaaatattattagcttgcctaaatcgtcatctagtatatatgtcttatactgtgatgttaccattttatatacaaaggaattataattacctttcataatatatatatcattaataattttttctttaataatattttgctgtaaagaatattccattgatacaaaattattcttaacaatattataaatgctattttctgtattatttttaagtaaatcagctaatgctggcagtttatttttcttaaaatataaatctaaataatatccaaataaaaaatccctttgattatttttatcccattcataatatgattttaatgggttttgtaagtattttggtatattttcaaaatttatttcaagatttactatattctttggtaaattgatagaatcagtattaaatcctattatttcaaacttatttgaatcatctttaatatattcattaagttgattataaccacatattttaacctcttgcgtgttaaaattatttctatataaacttattataactggtactacattataattacatactatcataatatttcctttataatttctatgatagtatatcatagaaattcttaaggtttacttatataaatgatgtttccaaatagtagctcttatttccatctttatttataatatcttttcacctttagtattatctatattcttttggctctatcattaatacagtcttacatatctaatttatattgaacgcatatatataagaactatcgtttgtttcagagtcattattgcttatttccaaatcattatctatactaccttctattttgtctccgctatcatttacataataccatacagcttttacatcagaaacagatgtttgaccataatatccatctcctacatacaatattttattaggaattttttcagacagtaaagttattttaagttgtttaacactagcatcagaccatagcgaacattgatcagcattgccaaggtattctttaaatatattagtaacgcaatgatatgaagggtcattatatatcccagtagtatccacatcaacttttatatcttgaccgctaggagttaaagaactaacttcagaatacccagaaaggttacccaacccatctagagatagcaatatttgaccgctatttaaccctttaactatttgttttgtagaagcatacccgttatcaaatcctattttaacaccgctcatacaaccaccgtattggccacttcttagttttacattacaagtgatctctatttttctaagacttggtttaatttcatcccctgttactatattcacccatttattagcaccaaaagtattgtctatacacatatatacagctttattagttgtatcagagtatagagaacctattttgttagggtttaatgaaaaattaggtttgcctgaccctgtaagtaattctgcatttttattaattctattatttatgtaatttatagaatcaagaacagatatcaagaacataccatctttataatctatattaatatttacaggactattattgtcagagcttcctttaacattgaaggtttttacaacagtattttctataaataattcaattttacagtctttagaatataaaaaaggatttgtagcactagttccaaataattgaaaagatatattatcaacttgtttggagctatttatatcaacttggtaataaggattttttaacccatcattacttaagaataaagagtattttttattatattctctaaaaggatttggtatatcataaactccactataatcataagctccattagttttaacagttactaaggcgttacttccactagaaagatctacactagatgaattaaaatcagaaggtcttgtagataataaagcatcattatcattatatactgtatcatctcctattaaatttaaacctattttattattttctctatcaataacttcaaccccataaggtttaaggtactcatcatctcctttaagttttatcttgaaattactaactactactgtatcaccagatgaataattagagttattagttgtcgcagatattcttacagatattttttttattgtttaaagaactaacatcagtgtaaggtattaatggagtattactaatattatatgctacattatctgtaatatttttatctaggtattctttatgtattagttgtttgttgtctgtaattctttcattttctatattcatatacactttattattaaaagtagttataccatttatagattgatgtgcttcagatgttagaacttttaatggtttcaatgatttttctactaaattatatactgatccactttcagtcccatctcttcctgttacattcatacctgtagatacaaggaaattaataacatcgtttgtattttttcttaggtgcataactaatgatcctgcaaaagtaggagcacctatttgtatagtatcagctttaacagaacttcctattttgagcaatgttattttaaatggacaatccatatctagatttgaacccatatagtaatcatagcataaatcagatacagaaccccaatattctaacatagctccatacccgtatttagaagaatattgcttagcagttgaaaatgatatctctaataatatttcattttctgctacttcataagattctaatgttgatacgctatcggaataagttacatttgttttactgttatcagaagtgagaactgcaataactttagttccactagttgtattaaaagcatttgaagatactttataagctttatatgtaatatctcttatagtatcttttatattaacatacccacaatatcctgttccataacttgcactaccactaaatgaaacatctatgtaatctccattttctagtgctataggactctcatcaaacatagattgcaacatgttatttattgtttgattaagttctttgagtcttacaagttgtaattccatacttgcaggctttaaagaacatatattattttctaataaatgtattgatttaattgcttgagatatattactatacagaatatctcctgcaattttgctgacaggagtatgaatataagtcatatccgcagattcatatgtattttctacaggatctagtgtatctgtttttacagttaatttttcagaaccatttgtagtcatagatatacttacaatatctggagtattgataccaagtttatctatttttatagatacttttctattatttgttatatcattttgacttccagtataataatcatatattaagtctccgtcttttttattagcgtttctagcaaacatagctccataaccatatccactagaataaacagatatagtatcataagatagtataactctaacttctccttctttaagctcatattgtttaagctcatcaactgttttagtaatatcaaacttaacatctatattttttgtataatcagttctagaaagtataacaaccatttcttttgaaggattttctgtaaatgatgttttatctgccattatagctttatattcattgcctactatatcttttaggaatacattttttaattgttgtgcagaatatgatactggatttgcatatccaaaagttatttctgtaacagaactttgtgtaagtgctgtatgatcaggaagttttatacctccaggattatctaaaatgtatcccaaattaactgcatgatttctttcagaaggaacagattctagtaaaatatgatctacataagtttgatcacctgtaaatgtatttgatttattggttttagctgttgttttaaacttatcatctacactatttatagcattaactaaattatctttagaaacttcattatttaatgaatttaaatcaccaataacagattcaactttgtcatttatttgttttgttgtccagctcaaaatagccacatcatcagaatcaacaggtgttaatgcttttaattttcctgtgaattttttaataccatttattgctacttggtctgaagttatatcaacaaatttactagcatcaaaagatttacctaaatcataccaagttttaccattccatatatacatatatccagtatcttcagcataccatacatcacctatctttttatcaacaatggcttctatttctgtatatgtagattttgatcctttatatgaaaatacattagatagtagatctttaacttcttttatgttattgtcaaactgtttctttctaataacatgattatctagtgttgcatctacttctactgaaggtgcttctgtaaaagtattagcttttgtaaaaatattaactgcatctttctttgcataatcagttaaatcaatttcaggtggtactatttcgtctattttatcatctatctcttgtttagtatatgtttcttcttttgtagcaaatttatccaaatttaaatctgttatatcagctacaacatgtgtatgaattttatctgctttctgatccaataaattatttgtttctggttttgtgtaatagttagataaatcaggattatctggatcaattggaggttcaggcttaaatacaacatcatcaccaccgaaaaaatcaggatgcatcatagctatttcggctggatatgtaactcctggtgataacaaaatagcatatagatcatcagtactaacccatctaggttcttttaataaacatacaaaaaagtcttgtgtaggctctctttttggttctatcataatacagtcctataatatctaatttatagatatttataagactgttaatagttattacatccaatcatcaaataaagaagtacccatgttactgttaaatgaagctatactatcactgtgttttttacaattatattttaagaaaaatttaagaagattattaagatctattgttggcttttccaaattatattgttctataatgcttgctttaatgttgtcaggtatttctctaaaatcaattaatgttttatttctgacaaaattatcataaacaagcttgtttttttcaagattttcatttaagttttctaaaaatctcttagcccctacttcaccaaaataagctggtttaaaaggtgatttttcagactgcttagaatataaatcatataatgtttttgatatttctaatttattgaaatcatttacatctgtttcaaaaataccattattttcaagaaactttataaagtcaggtgtgaaagttgtgccttccattattgatggaatattatctgctttgtcaccaagcaaaatatgcatagttaatgtttttgttatttctgactcttctatgtttctaaagaactcttttttgataggtttaaacaaagttatatgtttatttattaacaattgcataaaatctttatcttcagaaacaactaatacaggtttaacagtatgatttgctaatacagcaataatgtcatcaccttcagcaccttttactcttaaaactttatatggtagtgactttttaataacatcaataatctcattaatagctggaaatacttcgttttcccaatcaaaaacatccgataactttctgtttgtcttatattcaggataatatgactttctccatgaattagatccttccaaagcaaggacaatttcatttccataatctcttgcatactctgtttggactaattttaaataattaaatactaaatgcacaaacataccatgatatttttcaaaactaagtttctgtttgctatacatatcttttccaacagctacatataaacttttaaaagctaaatgcataaaatcaattaaaaccatttatagcccctttcttatgtttttcttttcgtgtatattttgttttatttttaataaatcttgtctgtagatttatttcccttttaaatgactttataatggattcatctcgtttcattttatcctccctcctttaaacatatttaaaatttcttcttgtttttctttaggtagaatgctacaatactgtttggctacattaaaagatatattatagtatttgctaacagcttcttcgtattcatttagtttatcctcttttggaggtctacccatataagttaccttattcattattgagcgtgcaaaccaatactgaacatttataggtatatcggtatgattgttaataaaattagcaaactcaacagaatgaatatcattactcatccatctacataacataaacgaatttaataaattcatttcatttttgttaggtataaagtcttttttatacgcagaaaccataacctcatattgtgaatgtgttatattcatttattttccttaaatgctacaattatttttacaattgtagcattttataccttaaagattatttaaccagtcatcatcctgattattttcttgtttaggtttttgttgttgaaccacttgttgaggttgtggttttgattcttgtgtttcaaatggtgggttatcatttgttttttcaaccactgatggaacacttgaagttttagtgccaaaaggatttttaaacctttctagtttttcttttaattcttcataagaaggaaaatactcaggttttgtaaactcacttaaatcgtaagttttgttaagaattatgtctataatatcttcatttttttctaacccgcctaactttgaaggtgatggtgctaaacttgtgttatcatagttgaagaaacctgattgtggatcttttttaatagttagctctatattataaccatttatagggttatatagttctttttctgtatgtcctagagacctttgtgtttcatctggattcatccaagctaggaacttttcttttaacttacttccaaattcaaatagaaacactttaccttcattttcaggattagctggatcttttacaactaaaatgttagtgtagtattttacctttctaccatatagtgatcttgccagtttttcatcaccactatttaatacttcaaaatactcttcttgaataggacaaggtaatccaattgtacttggactatttgctattaaccagcgatctttgccacctacattctttttagagttatagtgatatatgtgaacgaatggtgttttatgtttatctgttattagtctaataacagctgctccactgccctctttattttttgataatttccaaaatctattatcaatataacttttttggccaatattttgtggcattttttgcattaaatctgcacctgaaaatcctgttaaaatgtcaaattcattcataataatttcctttaaaaatagctgaaaataagattaataaattaatcaacaatagccaaaaatcccatatcttttagatatacgaaattatataatatttatccttaaaatcaacttaatttaatccaaacaccctgaccacaatcccatactttatgatatccattttccaccatgttctctgcttcagtcaagtttggattaaacttctctagtttatctttgagtttgtgtttcatgaattgttgtcttgaatatgttctattattcttaaaataaaagtaacctggttttgagtagtgactaaatgtaaatcctagctttttgtatatctcaccatttgaataaagtctatcagagtaactaataagacttcctttattatgtctatggaagtaactaagtaatttagaagcaccacctattacatttagtcccatttttgtgcataatcttattaattcccagtcatatttattagtgaatcttggcttaccaaaactcattaaacaaactagttcatcttggtaatagaatccataacatacagttgatccagtaaatccttggagatgattttcattcaaaaattctttttcctctgtcttaggtacttctttaataacacatttcctagccattatcttcttagactttcctagtttattattaataatactagtccaaatatttttcttttcaatccaagagtgttcaaaaatatggagtaactgtatccctttttcattgcatctctctgttttatccaaatggtagttcttatctttcccattactttcagaatgccagtagtctccattacattctatggctaagttatgttctggtaaatagaagtctagctctttatcacctaatattgagtaatcattgtttatgtaattacctaatatctttgacatttctttttcaaatgagcttgtacttggataacatattgggcataaagttacaccccttttaaaattatcaaatgctcgcttaaaaatatgcccatttgggcatattacttcaagattatctaactaagtcttcagaaacaactttatagccaagactgtttataaaaagtagttttctttgtttttcacattcattacaaatttgtataaccttttttgaagtcgccaaatgctcgtttaaaaacatgcccatttttacattttacttctaaattatttcctaaattgtctgagatgacttcatatcctaaattgtttaaatactctagtttctcttgcttctcacatgtagtacaaataataataccactttcgaatactttatatggtcttttaaaaatatgaccattttgacattctactgttaaatcattatttaactctttagaaacaactttatagccaagactgtttataaaaagtagttttctttgtttttcacattcattacaagttaattgaccttttttaaaattgtttaaagttcgtttaaaaacatgtccatttttacattttacttctaagttatttgataaattttctgaaataacctcataacctaatttatttaaatgtttaacattttcctgtcgttcacactcagggcaagctgttgaaccacttttaaacctgctaaaggatcttttaaaaatatgcccatttttacattttacttctaaatcatgacctaaactatccgatatagtttcatacccaagatcatttaaaaattctattttgtcattaactgtcataataatattatataatatttatccttaaaatcaacttaaaacatttttcgatttttacgaatatttttagattttgattttttatagttttgaattgcttttgcatataacttatcagcagaatatccaccactaaatgattcagctcttaatctagcagctaccaaccataagtcttgtggaattataataccttttcttgatattcttttcttaatatataatcttataactggtcctaaatgcagtgcagataaaagtggtttaaccattttatatgttatttttaattgtttatttttttgaattgcagctttattcattttaaacaatatttttatcaaagctatacgaagtggtactggagtccaatgtaaatttaaacctaaaacataacttcttgatgtacttaatactaaaattaaaggtgttttatcatatacctcatctttaaactttgcatcatattgcataaagatcatgttgctaaatctaaagtcttctgctttaaaattacgagtgccttttttcattagttgtttaactatatcaagggcagctttttcctgctcttttgtagttttttcttttaaagcgtcatcaactgtatcttttattacttttttgccagtgtttatattttttgcttcttcacttatagcttgtgtttcttttgtctttttttgataagatgacacaaaaccaggttttgtactatctactatattagactgattagaacctggcttactactggaaaaataatttggcatgtttatactaattttcgtaatctaaatacaaatatcttttacttgtctattttcttgctttttccaattttcgttctttttatttaataaaaaataactttaatcattttttatcctttttataatttataatattatttatattttaaagcaaaattatcctattctgttatataattcttccattgttatatcttcaataacacctgtttttttatttctaactgtaatttttgtgtcaccagctacacattcatcaataaaaattaaattgatactaagacccctaaaagcatctggtgtagttgcactaatgtatgccttacatcctatttcattaacaaatgactctttgttataaactttcacggatggctttaaccatatcggtaaatcagcatacatgtccattagtctttgtaagttctcagcagccatagtaaatttattagcacaaataccaacaatggtatcagggcaaaaacataatttccataatatgtataataaagttgtaacagatttaccactttgtcttcctgctaatacaacattgaatctattttcataatattgttgtattaattctttttgataatctcttaagtcaggataaactaaaccttcatcaagacttcttattttaacatagctttccacaaaatagataatatctatactacatttttgaatctctattatatgttcttctttcaaaggtaatttagtattaatatatgaaagttgaggattattaccatagctaactttctggttactaatatctaaaaaatatccgttttcatcctgtggcaacagtttatttaaatagcttattttatcatcttttaactgctgaatatcttcaaccataaaatataatccttatattttatccaaatatatattttaataaagctaacaaagtaaatataggaatacataaccaaacagcacccataaaggtttttgcgtgggtttcagctaatttttctaactttctttcttcttggtaatgtttttgtataaggctaacattattaaaaataaccattttcgttatagtactcaagtctgttaattataaacctaacttttcctttagataaatttaacttaatttccttgtcaggtttatttattgaatctgctccataatttctaaactcccaataaacatcttctgatattttaaaagaatatgatttaaaattagtcaattcgtcttctaataattttctatagaatttattttcataatctattgaaattaaatttattagtaattgtaattctaaattacttagatctttcttagagttaaaaagtaagaaattggcaaaatcttttgattttattttactcattattactcctttataatatttttaaacaaagtctgcttatgtaagtctggcaaagactcataaactttattagctaatattcttatttcatataaagcatgactagatgatcttaactctaagaagtttcttaaacttctagcatttatagtccagtataaatttgttctaaatgcttctggtaaagcatattttacaacatcattactcttattttgttttactaatcttaataaattatccaaattagataatatttgtaaattagattctaaatcttcagtcaaaactacatatttagaagctctatcaaagtcttgttcatatttgaatccttcttcattttttagatgttttttcaaagtatatctagtactctctacgctaagacttgcatgtctatgcctagctaactcttggagacacgctctactaataccttttataaaaaagttataatatacatgttctattgtactaaggtgcttgtgatgattaacaatcctatctaataatgctttatcttgattacctaaaactaatttaccattttcataaacactgtcttttttgcatccactatcccaacaagtccttatagcgtctattgttatttctaatggtgtatgatgtaataattttacttctatgtttttcatgaattacaatcctttcttatttttaaagtgaaaaaaactccaaatacaattttcttttagttatttataaatattatttttaaatttatgttattgtataacaaaaccgcttaaaattatcttaaactaactaagcagaatttaagtaaaaattgtatataatattactgaaattgcttgaaaggacattatgaatgtaactgaaaagttaaagtttttaaatgatttaggatatgaagtagtgtcagacaatttaggaaataatttagaagtaaaatgtaaaaatgggcatgtttttataaaagaattaggttatgaaattgtatcggataacttaggtcctgaccttagaaaggaaagtgaaaaaatgggcatatatttaagcgagcatttgataattttaagaacaatttgtcaaagaaatgagagaataaatgactatgttaaaaatgagttagatttctattaaccacaccataatccagcaatagaatgtaatggagactactggcattcagaaagtaatggaaaagaaaaaacctatcatttagaaaaaaaacaataaattaggaaagtcagagagaataatggctagaaaatgtatcctaaaacaagtatctaaatcagaggaaaaagaatttctaaacaaaaatcatctccaaggcttcactggcagttcgatttgttatgggctatactttaataatgagttagtttgtttaatgtcatttggtaaaccaagatttactaataaatatgattgggaattgataagattatgcactaaagatgggattgaatgtaataggtggtgcctctaggttattaaaacattttcataaaaataataatgggtcattgataagctactcagatagactttactctgatggtaatatatacaaacaattaggattcgaatttagccattattctaagccaggttatttttatattaaaggtagtaataaatactctagacaacagtttatgaaacacaaacttaaagataaattagaaatatttgatccaaacttaactgaatcagagaatatgaaagtaaatgggtatcataaagtatgggattgtgggcaaggtgtctgggtaaaggacattatgaatgtaatggataaaataaagtttttaaatgatttaggatatgaagtagtgtcagatgatttgtccaaaaatcttatagttagatgtaaaagcggacacgagtttaaaagaaggttttatgattttcagcgtggcacaataatatgtatacaatgtgatcataactctaaattatcttatttaaactcattaggatattcagtaaaatctaaactaataaacaatgacctagaagttatatgtaaaaatggccattcttttaagcgtgcatggagtgagtttaaaaatggaaatataagatgtgcaatgtgttatgaacagcacaaaatagactttttaaacaaacttggatacacaatactcgatattaataaaattaaagtaaaatgtaaacatgggcatgtttttgatagagtatggagtcattttaacagtggagtggtagagtgtaagcaatgtaagagtaatacaaaaatagaatatatgaagcttgcagagcttgaaccgattagtaaaaatatagctgatggtttaaaactaaaatgtaaaaatgggcatgtttttaaaagaacatttagtaatctaaagaaatgtaatgtatgccctatatgctactctaacatcagctcatttgaaaaggaaataaaagaaatattcccaaaatgtatagaaaatgactactcgattctaggtgataaagaactagacttctacttaccaggacataacttagctatagaatgtaatggagactactggcattctgagcaaatgggtaaagataaaagttatcatttaagtaaaacagaaaagtgtaaagaaaaaggtattcagcttttacatatttttgaatcatcttggattgaaaagaaaaatatttggactagtattattaataataaactaggaaagtctaagaagataatggctaggaaatgtattttaaaagaagtatctaaagcagaagagaaagaatttcttgatagaaatcatctccaaggatttactggtagttctatttgttatggactctattaccaagatgagttagtttgcctaatgtcttttggaaaacctagattcacagataagtatgactgggaattaataagattatgcacaaaaatgggaataaatgttataggtggtgcttctaaattacttagttattttcataaacataacacaggctcattaataagctattcagatagattatattctaatggatcaatttataaacaattaggattcgaatttagccattattcagcacctggatacttttattgtaaaaacaaaataaagtattcaagacaacaatttatgaagcataaactcaaggataaactagaaaaatttgatccaaacttgactgaatcagagaatatgagattaaatgggtattatagagtgtgggattgtgggcaaggtgtttgggttaaaggtagcatttgagctacctttaatatttaaattgagcctattgcttcttcaaaactaattgtagcaccaacagcgacgaaattaagtgtgataaattctattgcataagtcggtttaattaagaaagacgcaacaaactgattgttggatttaaccaaaggcgtgttattgctatcatcacataccattttaaatgcatctataccgcgacccgcttgaacttgagttaataacggagaacacatacttacaaacatattttgagtgtgagtgtcattttgctcaaatacaacatatctagctgagttagctatgtttctttcaagataattaaacaacattctaacatttactctatcaaatgcactaggtttttgagtacaagttttttgtccccataaacaaattcctaaacttggaaagctaacaacaggatttatagcactcttatacaaaagatctctttgtccattattaggattaaatgccagcttgataatatctaaatattgtccttgatttaaaccagctgcagcaaaccatggctgtcttgcttgatttgtataagctcttaatcctgctgttgcaccggctaagttgatccatctatatttgtcattatacttatcatatatataaccataatttcctataaatgaaaaatacttattatcaatattcatttcaccagtgcttctatactctaaaagatttttaacacaatcttcagcttttaaaccaacaacttcactaaatggaacaccaccataacctataacatcaccacgagttacacaaaaatcagcacattctttattagccatttcatttgcaataacaatatcaatgtctatttcttcttttgaactaaaattatctgtataaccactaataatatcagcttttgttggagctccatcttcaccaaatttaagtgttatgatttcagaatccaaagcggattttggtaaatcagttattgtagtgttatttttacaatagacataagatgattgtctattaataacatcttcaatataattagatttattattataatctttagcgccttctttaattgaaaccatatatgtttcttttatttcgttgttttctaatacaactacagcaacttgatctgtatctggaatatattcaaagttatcatctaatggaataccactaataatatttttctttgctccaaaatcagcttttgttgcaactgctactttgatattatttccccaagaaccaactgatttagcaataaactttaattttgtttcagtatcactaaatttaatagaaggctctaaagtttcataaacatcattattaggaattattttaagagtttcttttagtttggcatctgttatagtattacttaaaccagtttttaaaacttcacctattgcattcattgatgggtgacaaatataaatttttgaagaattaccaacaccatcacctgtttgtatttctggagtgaaagttattttagtattagcttgaatactagcaatagtataaacattagcatcagttttttcaccaaacataatttgttggccaatatataaacctgttgtatctgttaaagctatttctgttgctttttcacctaatacagcatttattgttaaacctgaatcttttcttgtagattttccaagtttatcaatagctcttacaacatataaactacctgctcttcttaaaaaacaatacgcttgaaaaaaatcattataatttgagtttgtaggttttccaaatacactttcaagtgttggaatatcatttatgaaaactgcaccatcacatggaccttttggaaaaataccacaaaacgccccaaaactagatgaagcacttgaaaccgtaagagataagtcaatttctttaacttctacacctggacttagtaaagccattttctttcctttaaataaatctcaaaacagtatatttaaaatttttaagtttattaaaggaaataaaattaaacctatatattacttagtataactatcatcttctgaaacagttagcaatatatagttattttaaataaatactgttttctaatatctatttataaaaagttatcataggcagattcattaattattttggaatataatattgttatgtttagtttgggctcttctaagttatatagtatatttacttgatatagtctatcaagtttcatcttaatgtttacagagtttttaccccaagatgatatttttatatttcttgtaaagctaacaagaagttctgcttttatatcttttataattttatcccatgattctggggattctttagtccataataatatttctacattatgttcatcttctattggattttgtttaaaataaatcccacattttttacctatatttaaaagtatatttaataatttagtttccatttatcatatccatattataagttcttctattaatttcaccatatgatttatgaattgttatagaattaattgtaccaattccccttctaaagccactattagaagcccatttatttaatggtgctaaatttctaaaactctcacatctacataatggtgtatctattactttatcaacatgataatgcccaaaatatgcatatacatatttagaatgtacaaagttctctttattgtcaaatgcaataatttgtcccacatctttcatctttatgttatcaccatgagtaaaagccattaatacatttccaaatgagtgatatttgatattcatcaaagactcatcacaaataactcttttattaccagcaaaatgttcttttataatatattgaacagccatagatggtaatatatcgtgattacctggaatattgatatagtacacatatttatgttttccaagtgccttatagatcatgtttataattgaattataagcaactgataatatttgtgggaattttttatcaacatcaagtacattcccacttcttggtgttttatgtgtaaagtcattaatatcaattaaatcacctaaattacatataatacactcttctgtattatcagcaccacttattaactctgttgataattgatctaatgtttttgatgctatatctaaattccaatcactgtcattagtttcttcttttaaagctaacataccaaaatgcatatcagaaatattgtaaagcgttaatgaattagtatctaaagattttaatttagatacattcttaagtgaatattttttaaactttttagaagcaagttttatactttcaataacctcttcagatggtattgattttggtgcattttttacccattgtaaaacaaccttacctttgtcattatataatgttgatgtattcatataaatcctttcaagtttatattatttatattttgctgatttttcttgctctagtattttttcaatattatctgcttcgtctttatcgtgtcttagctcaatgaaaacaggtaatattaaagaatatttaccatttttttccattgctctatgggcttctactgtaacaattttaccaatcatattattattccagaagaaatctctataactttctttaaaaccagttccaacacatacttctaataaaccttcatcgctttcacatactaaagctcctaatgtattttcacaagatgtaccagatttaccacattgataaccctttattcttaaatctacttgaaacttaatttttaatttaagctggtcatttgatgttttgtcaccccaagttgcaaatttatttttaataataacaccttcttggtcttgtgaaacaagatttttataatgttccattatttcttccatattgtttaccatattatatacaattggatatataaacccattaggtgtttcagtaattttacgaacattgttaaatcgtgtttcataaggtatattgcattttctttccagataatcactataaggaatacaatcccatgcttttaaaataactttatttgactcttcttctgttatagtttggtttgtttcactacttttgttaataataccatttccaatctctcttggaaatatgttaccattttcaacacataataattcacccattattacacattcaccaagagtataatatattagctgttgtaagtttgaaaaatctcttttaaatttatattctgttcctgctctagatacaaactgaatattgtttttagtaacaattacattacaaaattgaccatctagtttttcttgaatatatgcaggatattttatttttgatgatgttttttcatttaataacgcacatctcatataaggtggtttttttacaaaattagggatagcactattgattgttttaatacctaagtcagcttgaagattctttcttattactttttgtagaagtaattgattttcgtaatctaattgttttgcaagtttaattacaaaagtttcagcatcattacctctgtatataccgttttgtaaatggtcaagtgatgatattatatcgtctaatatgccattacctgtttcagatggtaattcaaaatcggttattcctaatctagtttttggattatatactatatctaaaagtttgataaaactttgattatctttattatttttaattattgtaattttgcctgcatctgtattctcattttttaagctgttaattatatctactaacatgcaatacctttcaattttattgaaggtattgtatcataaaaccccttaatttttacttaagtttttttagggttaaagttttggtttgtttatattttataattttcggcttaattttacctctctttaatgtaagtctagaaggtgtggtagctatatcacctgaagttgtcataaattacctttattttggtttaaagtatcaacaaaaataatgaatttgtctatgttttccatagaatttgaatatacaatatatttaccatcatcatttaacttcactattatacctatatcatcatattttgattgaaacttaagtgataatttgatattatattttaattttaatgtttcagataaactaactggtagttctttactaaaatttaaaaaagacttgtcaaaattctgatctgttacttcaaattgaagatctaaacttgattcatataaatatttagtgtacattattaattagctcctttttatgtttttttataaatatctcaaaattatacgcataataatctttatatttaaatataaaaccttcaaaattgtgttttataaaaacaaatggttttatattatcatattttacaactagcataggtaatttatttgatatctcacaatcagcttcaacttgtaatatccatttatcccattgtgcacattcctggataattaaagagttaaaagatggtgcagttgcataatgtttacattcaatggtatatttaaactcagatgggcatattatatcacctgcgtagaaagtatgctcatttaaaacattcataccacgatagctgttactaccaccaaacacagaaccactagatatatttctttgaaatgattgagcaacattaaatacatcagcataattatctgataacatttttgcaactgttcgttcaaaagtattacctttagacttgcttttattagccataaataaccttttttaggttatttatttttaaaatattttgcaaaaccagtatatgtataattaaaaaatatagtttcgtcttttgatactaatataagttttgcatattttcttaagaactttgaaatcccatcatatatttcagaattactgccatatactttcttattgactacataatgtttgattttaaataatgaacattcaccacatttaaaaacagcgtccatctctactctaatagttggtaattctttagaaggtgaagctaagtatatagtacctgaaatatctaaaacaccaggaactaatattttgcgatttaatttgtgtaggtttttcgtagaaacaacatttgctgataactcttttgaatttataaattgtactttcattttctgtcctttcatctgggattctttaatccctaatttttataccgtaatggtaccaaaatagacttaagacaaccttaaaagtacatgggaaaaggtgcaaacgcaccttttttaccaatttactttatttccaaaaatatcataccagtcattagcatttatttcgttatcatcaacaaataatttgccttttcgttggacaacattaaacccaagaccatttagtctagctctagttgtttgtgaattataacctgctaatgaatatttttcatcaccatttttatttttaacagctattaaattatcgtgtaatcttacttctgtattgcctttatcatctacacttacaacagtattcccatctttgattggtttactattataaaaatataatcctattttcttatcaatttttctactttcatttattgagttatcatctaaatcatcatcttctagattattatctaaatctcaaccatcatcatctgaattgtcatccacatcatctatatcatcatctaactcaagatttaaagtttcaaaaacatcatctataagagtttgttcgtcttcggtaatatcttctctttctattaagaaaggtgtagtaccatttactaatatgatgcatactttttcaaaaattgatataacataatcttttccaacaacagaacccattatattttcatcagagaattcttccatgttttctaaagcatcttttaaaccatttatttctgactcatttatagaaacttttcttttgatatatttaaaatatcctttttctgcagcttcatttaaagtaatacctttgcttttatccatatttttagcccttcttttaactgcttcatttaatgtaataccttttttcatttaacatcctttatattttgattactttgtcgcctgtaccaacaaacattatatttgtgataatttgatcaattttatttttatctttagttgtttttattatatctataattttttctagagatggtgatttatattttaattcactaataagtttaagtgtcttttcccttttagtttctaaatcattctcattccatatgttttttaaatcatctttagaaatttgctttagtttggcttcatctaacttattaaaagcattttctactatagggttcttttcaccgtcttctatatcttttgcaatttgatcaggtgttccaccgttatataatgcttgtgaattaacatctttccattcttcaggagtaagttcttttttatattctttaattacccaagtatcgcgatcaaattgtttcacatcgaagttgtcttcaagctcttctaacttgttaaatttagcatcaccaccatacatcacacaataaccatgtcttaataattttgaatacgcactagctggtgccttaataccaacatctaaacagttcctgataagctgttggatttcttcatatgttaccattatattccttttgattagattttccaaattatttataaaattatacaacattttggtttaaatttaacttaaccaaaatatttataaataattatatggataagatagagtatttgaaatcattaggttataatttattgtctgttgaaggctcttatgtaaaagttgaatgtaaaaataaacacatgtttagacgggcttttgcatcatttaaaatcagaaatacaccatgtccagaatgtgaaatagaaaatagaaaacaatttttagatagcataaattattcccttattagtataaacggtagaaaagtagaagttaaatgcaaaacatgcaatactataatttcaaaagaatactgtaattttaagcaaggtaaaattacatgtaattactgtgaaactaataataaaatagaatatatacaatcactagggtacaatgttgttgattttgagtcaagaggatatataaaaatacaatgtaagcataatcatattttcagtagagcatataactcactaaaaaatggatttatatcttgtccatattgtgaacatgagcaaagagaaacatttttcaaattcataaatttagaattaataacttttgataaaggtaagataactgctaaatgtaagaaaaaccatatttttaatagaacatatggttcattcaaaagaggaagtacattatgccctatatgttatccaaaaagtagctcatttgaaaaggaagtaaagaatattctacctaaaaatgtaattgtaaataacagaactgtattagatggtaaagagctagatttttatctgccagaatataatctagctattgagtgtaatggagactattggcattctaagcaaatgggtaaggataaaagttatcatttagaaaaaagtttaaagtgtattaataaaggaatatatctaattcatatatttgaaagtaaatggtattctaacaaacaattttatataaatttaataaaaaatcacattaatggtacaattaaaagatatcctaataaagttatatctgatatttcttgtgaaaatcaattaatattcccaaaactaggttacaagcttattgataatgttgaacctaattttgaaatatttcagaacacactaaaagtatataattgcggatataatgtttgggttaaatcattttgacccaaacaccttgaccgcagtcccatactttatgatatccattaatactcatattctctgcttcagtcaggtttggattaaatttctctagtttgtctttgagtttatgcttcataaattgttgtctgtcataaataataccattcttaaaataaaaataacctggtttagagtagtgactaaatgtaaatcctagctttttgtatatctcaccattagaatatagtctatcagagtaacttatgagacttcctttattatttttatgaaagtaactaagtaatttagaagcaccacctattacatttagtcccatttttgtgcataatctaattaattcccagtcatatttgtctgtaaatctaggttttccaaatgacattaagcaaactaactcatctttataatataatccataacaaatggagctaccagtaaatccttggagatgattgctttctaggaattctttctcttctgttttggatacctctcttaaaatacatttcctagccattattttcttagactttcctaatttattactaataatactagtccatatgtctttcttttcattccatgatgattcgaatacatgtaataactggatccccttagattcacatttctctgttttatccaaatgataactattatctttacccatttgctcagaatgccagtaatctccattacattctatagctaagttatggtctggtaaatagaaatctagttctttgccatctaatatacttctatttcctttaatataattattcaaaatgtttgatacttcattctcaaatgaactgttaaaagggtcacaaataggacatatcgtttgtccctttttaaaattactataagttctattaaaaacatgccctttattgcattttacttgtaaattatcagccatgttatcagaaactatttcatatcctagcgtactcaaatatgatattttattatctttttcacattcaaggcaaatagtgataccttctttaaagctaccataatttcttgtaaaagtatgaccttttttgcattttacaattagcttatctgataagttttctgagagtatttcatatcctaaattgtgtaaaaagtttattttttcttgcttttcacattctggacagtttattgaaccttgtttaaatgtgataaaatctcttttaaatgtgtgtccatgtttacattgtacaactagattttttgaaagattatttgaaattactgtatattttaagttctctaagaataatattttttcttgtttttcacattctggacagtttgtaaaaccttttttaaatgtatcaaagtctcttttaaaagtatgtttatttttacatttaactatcatactcttatttaaattatctgttataatttcatatcctaaattgtgtaaaaagtttatttttccttgttcttcacatttaaggcatctaataacaccttttttaaaatcactaaatggtcttttaaaagtatggccatttttacattctacttttaaatggtcagctaaattttcagaaataactttgtatcctaaattatttaaaaaagtgtgtttttctgttttttcacatacagggcatttagcacaacctgttttgaaataactaaatgttttcttgaatatatgaccatttttacatcttacctctaagtcatttcctaaactgtttgaaataatttcatatcctaaattattcaataattctatttttgcttgaacttcgcatttaggacaatttactctacctcttttaaaatcactaaatggtcttttaaaaatatgaccatttttacattctacttctaaatcttttgacatactctgggatataggtttatatcccaggtcatttaaaaataatactttatccatctatattatgagcatgattcgcattcatgttctacaccattatctttttcagatttaaaataatataaagtttttaaccctaattgatgtgcatacatatgcagtagagatagtttgtgagaactcttttgaatataatttaattcaccattaaatgtataagaatacatatttacactttgactctgatccaaaaataattgacgaacagctgcagcttttatcaacatcataggatcacattcctgagctaacttataatattgattatattctttaaacataggtgctaatgttttaatgtttatatttccatcttctttatataaaagcttttgaataggttctatactttctgatgcatttatacttctacctgatgttgctgttggagctatggccattagtgcgcaatttctcatcccatacttcttaacatcttccatcagtttattccacttgttttcatcaggtttaaattttatcaatttttttgcctttttatttcctattaaataaggatataaacctttggcccattttgtttcattaaaaccttctgctcttcctttttcaatagctaactgcatactagcttttacacaattatataataattcatcaaaaagttttgcttgaaattctaaactttcttgtgaatcaataataattttatgttttgctaataaaacagctaagttagatacacctattcctaaatagcgatattttttattagctgtttgtgcatctttgaccatataataagccagatcaattgtattatccattgtacttactatatcatatattagattatatttttctgtatcatttaataaatcatactcatgcaagtttatactggcaagattacataatgcaatttcaccatttgtataggtttttactacatttatttcattcatctcacttcctttaatattatttatattatataatatttttacttagattatccttaacccaaacaccttgcccacaatcccatactttataatacccatttatactcatattctctgattcagtcaagtttggatcaaatttctctagtttatctttgagtttatgtttcataaattgttgtcttgaatatacttgattatttttgaagtaggaatatcctggttctgaataatgactaaattcgaatcctaattgtttataaattgaaccatcagaatatagcctatctgaataacttatcaatgacccaggattatgtttgtggaaatgtttcaataatttagaagcaccacctataatgtttaatcctatttttgtgcataatcttattaattcccagtcatatttatctgtaaatctaggttttccaaaagacattaggcaaactaactcatcttgataataaagtccataacaaatacctgatccagtgaagccttgaagatgatttgtgtccagaaactctttctcttcttttttagatacttctctcaaaatacatttcctagccattattttgtctgatttacctaatttattattaataatactagtccatatttttttttttctgtaccatgaatgttcaaaaatatgaagcaactgtatgtctttctctttacacttttctgttttatttaagtgataatttttatctttaaacttatctgagtgccaataaataccattacattcaatagctagtttataatttggaatataaaaatcaagctctttatctcccaaaatagagtaatctttttctatataattatctagtaagtcagatatttctttttcaaatgagctaatagaagggctacatattgggcatattttagcaccttttttgaagttatgataagaccgttttataatatgaccgtttttgcatataacttctaaatcatcagctgtattatctgaaattattgaaaatccaatattgtccaaatagtttgatttattttgctcactacacataacacatattgaaataccatttttaaaatgctcatatcttcttttaaaagtatgtccatttttacacatcacttccaaattgttacccaaattactagatataggtgtataaccaagattatttaaaaaagatattttttcttgcctttcacatgctggacagtgtatagtacctcgcttaaaattaccaagacttcgtttgaatttgtgcccatttttgcattgtacttctaaattacctgctaaattagatgatacaggtgtatatccaagtgatttaagatattctattctatccattaataatccattataatttttggggagtatataataatgtaacttaagagaggcttaattaatgtgactcggacttacaaagtccgagttatctactaagagattatgtagttatttaaattaacagcaaatgttctgatgaatgcttctgggtgtaatggagtagcaacaacatcatatctgttatttaaaatcatagcaggttgcccacttactggatctgttaaattttgttgtaatgtaatgttatatggtgcaaagaaaataccagcatcaaagtttgatgctcctttgtaagcaacagtacaataatcaaattcagcaaagttatcaacaattacatcgtaacgattatcgaatttaccaacatttggtttaataccactgttaatagcatcaatcttacttcctgctggagataaaacaaatgatccgatttcgtcaagaattgtagcaacttttggagaaacgattaatttattaccaccaccttttctagtttggcgaccgatttctctagcttcattgctaattctcatacttaaacctcttgctttttcaataaaccatctaccatctgcactattaacatcaaaatcagtacatacagtagcaacttcatttgctttttcaatgatagttctgtcaatttcaagagcaacttctgcacttaaaatgtcagctagttctttttcagcatttattccgtgttgtgcttttaagtcttgtaacatttcaatagtataagtaccttttacttttctagttttagcttcagctaacactctttgaacactaatacccatttctttcatgtctttaccaagagcttcaccagctgctgttgcataaggaccagtatagtttttaagaacttttaaccataaagcttcatttgtatatacagcctcaacagttgcttttttagtagcaaatgaagctgctttatccatttcatcaccaatagcaacagaaccagttgagttagattctaagcgaagtaatacatttaccacatcatctgtacctgcttgtttctcactatatactattttacctttaacagttgtagctgtcttaaatgaaacttcaataggagttccagtataattaaagtcatttttatttccagattctgttttaagttttaaaacaatagcattttttgttggactaacactattattaccatcacctacatagtgtggaaccattgcatacaaataagcagttggagttttaagtgcttgaacaccagctatttcagtaccaatcaaactaggtaatgctctacgaattactggaactaagattggtgtaaattttgcaatatcaccagttacagtgctttccataagcatttttacttcgtttccttggttttcaagcacagttctcattatatttttctcagattcattgagattagggtataagttgcttgtaataaatttttcttttgttgattcatctaacaaatatttgtcagccatagtatttttctcctttggttaatatgtattatttataaaaaattaccataagtggtattattttgtgactcagaaagttgttgctttccacctatacttttcctgctaatagtttttgattttagttctagtttattggcaatagatttaaggtttgattcataagaaatatcaccagtatatgctacactttcagcaagtgtatcaaacatatctctatttccaatgcttactgtatttcttatattgttatatatattatttttttgagcctcttctagtttcatctgaagttttttatttttttcttctaattttttaacatttttttcttttttaacactttcattaattcttttcaatgcatttataggaccacctactttatcagctgttctagcacatgcatcaactacttttttgttactactttcaactagtgtttcaaggttcattgatccttttttaacaaattcatcaactttatccttaataatattttcaactagcttattgtaatgtttttttactctattaatggcattatgtataactttttggttatttttattaacctgttgtttatacatttcagcactttcttttagcattttaacttgtttttcataatgtttatcaacttcaactgcgtgaatatcagcgatttttaaagcagcttcaactttattatcaacagctgcttcaaataattcttttatttcaccaacaacttcaggtgtaaaaacatttttatcaagtttacttaaaagttcttccatgataattcctttataattgtgaaaataaatcgacaaactgagaagttatactcttgttatttatattactttcatctgcctctacaagtataccatttttatctttaatataatttttatcttttaatataccattatcaaaagattcatttagacctttagtatgtgcatttctatcagacggatttggcactatatcaaatgtaattaattcatattctgtaactgttccattcattagctcaccacaacccctgctagaaacacctattgatataccttcatcaattaggttctttagttgatttgcttttgggttatcaagcaattttgctttccccataacataatcaccttcaattctaagatctactatttttgctacagcttcaagtggatcaacatattgtctatttggatgttgatattccattaaagaacttgtagtaggggtagttatatgatgctggtatgaattaacagcactttcccaaataggtcttggatatactctaccatttatattttgctgatttatagttgcaaatataccttgtatataataatttttttcacctctagactcgtttagttctactgaaccttttatttttaccggttcttctataattagtttcatttatactcctttaatactttaattaaagcttcatttttcttaatagtttcaatgtgatttacaacttttggatgattattatattcttgttgaagctttttttgaattacattagaaagtccatccatgtcttttctttcaacatattttacataattatacatttattctccttttattaattttgtagcttttttaattttttgatttataatatttttaggtatacctaattttgtagcttttttaattatatttcttttattatcagatatatcatctttaatttttaagtttttactttctatattatctagagaatcatcttcaggttcatcttcaatatcattcttaaaattgtcttcatcgtctgtaatatcttcatcgtctgtgatttcattaccaaattcatcttcacctggagttgtttgactaccttcttgaaggatttcctctctcatttggtctatttcttcatcagtcatttttaaaacattttttagtaaatatgatttgctaaatatatcaccttcatattctttaaattcagtataaagatctagcctctgttttaatatatctaagttttgtctttctaagaaattggattctttttcccaacctataaaaatatattttgaatagttatcaaattcatcttctgtaagaatattatttgttatggcatatcgtttcataatttcaattaataaaacattaaatctttgtcttaatctgttaataaaagcaaaaaacttaatctcggttgattctattgatgttgagctaaagtcaaatacagttttattttcacccattaatcgtgatgttggaacttttaaagcattatatagtttatttttaaaataatctaaatctccagtttcacctaaatttccagtttcatctaaaacatctacttgagttccttttgtaccacctctatttggaaaataataatcctctaccatagactggattgatgcaccatttgatatactaccggtttctgtattataatattttttatatttaaatttatttttaatatcttcaacggctgcaattgctttttcatacccaagattaccgacatcaatattaaacactctacgagacacagatcttgaatatcttaacggtatcataagatcttctaatgtttgtagttgatttacgatttttataacactatgcaaatgagataatattaaattatcagagtataatcctgaatcaattcttataatttcttctgggtcatatactttagaagtgtcatctgttactccataattattgctattattaaaatactgccatttgtttgttgatttattaaaatataaccctgatgggttcattataactgcatcaagtatattattgttatcatcgtaagataaacctattactagttgcccatctatatagaatcttctacacaaaacatctatgttttcatttaactgcaatatttcacatgacatatcaaataatgattggaatgcttctttcaaattatcagataatatattatctttaaaccctaaatagcaacaatcaatattattgggtacaaatgacatttcattcgttatttcatcaatagcatctgcgacttcaggatatgctgctattcttctgtattcttttattaagcttgcttgttttgatacatcactaattatatccgtctcaaaattattatatctataattcccttcatcaaaataacctaatacaatatcatctcttgtaaggttggcttctttatgtgggtcatctgatttaatagaaccttccttattttctacttttagaaaggtttttttgacagattcaactagaccattaaacatatttgccatcaatttcctttataaataatatcaaatatttataaaggatactcatgactaatataccaaaacaaaataaattcgcttatacagaagataaacctaaatacatagacattaatggtacaactaactatattttacctggatttgaatatccatcagatgtagcagttaaatttccacagttttttggtggtaaagataatgttttttacccagacttacaagtaactttagcacctgatagtttaacttttgaaaacggtaaaaagtcacaagcaataacttatacagctaccgatgggtcatcaattacatcagctgttgtaacagtagaaccaagtgatttagctacatggaatgaaggtgacaaaacatttacgggaaatgaagaaggttcaggtaaagctatatttgaacttacagatgataaaggtagaacagctatgaaagaattacctttaactgttacaaaagcaacagtagtaacaactttaactctttcacctaataatttaactttcgctaatgcaagtgctccaatgcaagaagtaacagttacaactaatgcttcagattttatgttagaatttaataatcaaaatatacaagctgttaaatcaggtaataaaattcaagtaactccaaaaacaggtaaaactggatcatttacaatcacagttaaagcacaagctgatggtggaaatcaaatatcaaaaactcttaatataactgttaatacaggtggttgataatggctactagacaaagcctcaaagattatatttttggcatgttaggttccccagttattactgtggaacttactgatttccaaatagatgagaatattaactttactatacaaaagttttctgagtttgctatgtatggtaaattaaaaggcacactattaattgacctacctaaaggtgtgagaaaaattaaattagaccctaaaatttctgaggttataacattacgaatatatccaagtggcggaggttttttagggttaagtattccaggtggtttagtaataacaccaactgaaatgcaagcaatgctatttggtggaacagtacaaggtaactttagtatgcaaaacatatattctgtattagcaaatatgtctatacttgatacatattttacaataataccaaattatgcttttaatccatttacaaatatgttagagttttttgaagacataaactctgaaaaggttttattagaagttagatacaagtatataccagaagaagaagatgggatatacgagcaaccatgggttaaagaatatgctttaaacttatgcaaaagaacttggggttcaaatataggaaaatatgatgcaccgttaataggtggtattaaagctaattatgaaaggattatacaagaagcaaatactgaattagaaagattagaaacagtattactagaaaactattgtgaaccacttccattattaagaggttaatcctcttaatatgataaaggagaaacatgtatgaagtactaacaccaaatggatttagtgattttgatgatatatcaagagaaaaaaaagatgtatataaagtaataacagaagatgattttataaaagtaacaaaaggtcataaatttgaaacacctaatggttttaaacaattaaaacatcttaaaattaatgatttgataaaatataaaaataagttttcaaaaattgtttcaatagattatgttggagtagaatatgtatatgacttaattaatgtacataaaaataacgagtattatacaaatcattttgtttcacacaattgtgcgtttatagataaatggtcagaatttagtaactctgtaatacctacaatatccgcatctaaaaaatcacaaataatagcagcttctacaccagtagggttaaatcattggtataaaatgtggtcagatgctgttgaaggcaagagctcatataaaccttttaaagttgaatggtggaaagtaccaggcagagatgaaaattataaagaacttatgataaaaactctcgagggaggtattagaacctggaaccaagagtatgcatgtgaatttataggaagttctgatactcttgttgatatgaccgttttatctaatattaaatttggaaatattttaagagaaccaaattttggtgaaacaataagagtatatgaagccccacaaataaatcacaaatatatggttctagctgatgctgcaaaaggtgcaatagatggttttgtatttcatgtaatagatgtaacaaatattccttttaaacaagtagcgtcaggaaaaataccagaatcttatttgatggcaccacctattttttataatattttaagaacatataatgaggctatgtttgtatgtgaaaataatgagggtgctggtacaagcgtggttgatttactattccaaatgtatgaatatgaaaatatatatcaagagccagataaaaaatggttaggagtcaggacaactaaaagcaatagaagtaaaaatcttagtaacatgaaactttttattgaaaataacaaactaatattacaagatgaaccaactgttaaagagttgctgacattttgtaatgttaatggaaaataccaagcacaaaactcaaaggcccatgatgattatgttatggcattaagtcttttgtttgtacctttgttagatttaaataatatagttgattataatgtatttttaaataaaataaacggtgattctgaaacaactgatggtgatgtaaaatatttacaaatgggattttttgatgatggtacttcatcattttacggtatttttgatgattaatataaatatcttaaaaaaggattattaagatgccacctattaaacatatgagtgtagctgatagaatagcacaaaaaagatatagaaaacaaccaaaagttaaaagaaaactaaaaataagagctaaaaaaaacgcaaaagctccttctgaaaatatgtcatggtcttctaaaaagagaggatatgttagaaaagatccaaaactaagaagaaccatgaaattagtagctaaattaagaagaaagtcataataatgggtttaaacaagtttgattctgttgattatgttttaagttctggacaaagaccttttagatataaagtgtcattaaatttacctgctaaaataacaaaaatatcaggtgcgttatatgacaatgcagttaatatattatgcaagggtgctactttaccagcaccttctatattaactacacctgttggtttagatggtagaactataaatataccaacattaatgaaacttgataacactacaaatatgacattttttatagatgaaaaatcaagtgtaaggcgtatattagagtactggactttttgtattgattcaggtataaccgcaaatgaagaaacaccatcagttcctggtgctggtgttgctaatattataggatcagttgctaacattggagcaggttttatatctgatattacaagtgatataccaattgttggtaatgctgttaatagtttcctaggtataaataaaggtgtaagtggtaatactgatattaatatgactggtgaattgaaattaaccttattaaattatagtggtaatgctgttggaagttatacatataaaaatatctttcctattgatgtgaccggaagtgatatgcaagatgatcaaacagaaacaattaatgaatttagcgtaacatttggatatacacattatgtatacaaaaaagaaacagaatctattatagatgctgttacaggaatagtggggttatgatttaacccataccccttgtccacaatcccatattttataatatccattaatactcatattctctgattcagttaagtttggatcaaatttttctaacttatctttaagtttgtgtttcataaattgttgtctattgagcgttctaccattttttgtatacatgtagccaggtttagaaaaatgactaaattcgaatcctaattgtttatagatttcaccattagaatataacctatcagagtaacttattaatgacccagggttgtttttatgaaaatgttttaataacctagaggcaccacctattacattcaatcccatcttagtgcataatcttatcaattcccaatcataactattagtgaatcttggcttaccaaagctcattaggcacattaactcatcattaaaatacaacccataacaaatagaactaccagtaaatccttggagatgatttttttctagaaactctttctcttctgctttagatacttgttttaggatacattttctagccattattttctcagactttcctaatttgttgtttataattgacttccatatatcttttttctctatccaagatgattcgaatatatgtaaaagctgaatacctttctctttacacttttctgttttatttaaatgatagtttttgtctttaaatttatctgagtgccaataaacaccattacattctatggctaagttatagtctggtaaatagaaatctaattctttatcacctaatactgagtagtcatttataatatatgatgggagtatttcttttaattctttttcaaacattgtattatttggataacactcaggacataaattatttgattttattaaattatcataagttctataaaatgtatgtcctttgttacatttaaaaatatttttatcaaccatctctaaacttatattattcaatagcgatttcttatcattttcatcacaaaatttacaaaatgttatcccactttttagagttggataactctttttaactatattattgcatttgttacatctcatatgatttacatcaatttttgtaaaaccacatgatttaataaattctagtttttctaattcgtcacattctgggcatgatattataccccttttaaagtctgctttatttctattaaatatatggttatttttacattgtatctctaatttagataatcgtatatccgttacaacataacctaaattatttaactctaataataatttgttatcatcacatgataaacatttattgtacttaagcatttggttccaacttctttttatattagaaccacatttatcacattttacttctaacccataatttaaattagaagaaatgggggtgaatccccattcttttaacatattaattttattttggttcaactctaataagttcatcaataccagcctctacatggaaactaggttctaaaataggaatataattccatttattactaaatggtattactattgtgcattgactaccttttctaatattcccaaaaatatccccttgttgatataaatgggtatttggttcccctcttgctggaacccatgctgtttgaatacaattaatttgctcgtcagctatttgaactacagcatatttttcttgcaatacaggtgaatatataatatttaataacctttcgttacaaaacatataacctaactctgttactgcttttttaaagttatttgcaaataaaccttcttcaacagctaacatactctcattattatagctttctgttggtaataatttttcgtatgttaaaaaaccatctgttggaatacgattataatgaacatcataataagtcataaacacatcaataactaacgcaccaccacgctcttttattaaattaagcatttcttcgttatttcctaacgcatttcgtaaggtatattttttcccttttattttaaggacttcatcatcaatatcatttacttgggtttgattaattataacaccatcagctgggcttttaaaggcacttgaattttttacaattgctctgtgtggatttctatagaactgggttctaaaaatttcaaagtcttcaaaactatcagccatgttttttacatgtgttctgcaccattcttttaacgatttagccattatcactcctttattttaatattcccattaaagactcatcacgaataagcatatattttactttatcgtttttgtgtaagtcaataccatgttgttttccaaaaacaactgtatcacctatttcaatgtctttaacttctgatcctatttgtaatacttttccttgtgtttgtctatcatcaataagtgatggatggacagttacaataatgccactttctgattttatctcagatggatatgcaacttctaacaaaacatcatgtggatgaacaattttaaatgaatttacatcaaagttatccataatcttcctttcattaattttgcgtaagtgtataacacttacgcttaaaaacatcttaatttatttcttttatttcaaaaactatattttcaatacctaattcttttatttttgtaaatagcttatgtgttatatctacactactaccaactgtgccattatttaaatcagaacctggtaatatacaaccttcagtatgttgtggtgcatttcctgtatggatacgaataagtctatcattaaatccttctacctcatcagaaacaacccatattgcaatatttgatccattatctgctttccattctggatattttttagctaataatccatttttacttgaattgcaccattttaatttatactctctagctactattctcttatcagttccagactcatcagtactaggacctatattttcacaactagcacacttaaaaataacattatcgttatcatctaataatgataattcaccaatggtagaaccttctattttatcactattttgccactttatacctgtatattctttatttctttgtaatattaattttgccatatttaatccttattgtttgttatttcactataaaaatcatcttttatgccttctaattcatccataaatccatttaattggattatattcatggtatcatcagaagtattttctaatatatcaacatcattatcttcatttataaatttaataggaactactcctaaattaacactaatatcacctagtgaacaatttaactttatgaaattaccactatattctgcgttgattccgcttatttttggacaccaaaattgaatataaaacttatcctgctgtggaaaattatttgaaaactttgggtctgtttttacttcatgataatctttaatagtcgaaattgttatgatgctattattataaactatttcaagatcatctattgaataaccataagcaacaaatctaatatagacatttgatttagacttttttacattatatgtaaaaccaggaataacttcatttagtggaaatacaacattactataatacattaatatccttgtaagctaggatattattcctagctattttttaattatttcatcttttactgattctattttatcaccaatttcagaagctttttccttattgttatgataaacaaaatatccagcaacaaaacctattaatccgcctgcaaaaaatgaaatcataatttctaccatattttctccttaatgttttataccgaaatatttatatcttacttaaatgtttaatatattgtaatggcagataataattaccattcatttttttatatcctagttcttttagaaaatttgtaaatgaaaagtaatctgttgtatattttatattttgtatgtcattatatgtaaaaatatcttttaatctaatatctggatatgttacacaatattttagaaacttagctctatgagataattcaagcaaattagatggattattcagcaaatagttttccaggaattcatttttatttttatttagcgtataaaatttaaaattgcgaatataatttaaataatttttatcctttttgatagcacaaatcaattcatctttaattttactattttcaaattcatttaactctatttccttagatatatcagcttgaactatattataatttacaatactatcaactatgtttatattactaaactgatcttgtaataataaacaaaatgacatcttatggtttaattcaatagtttcataataataacataatttgttataaaactcacttaaatattctaagtcatcgatttcaaaagaatcaataatattcttttcaacttcaagtggagtaatcatatttgtagaaccttcaacaaaaatatgaatattcgatgctaatcttgatctttttaccatttgaatagatgtgatagcatctatactagcactattatcaaagtgaaaatgatgacttatgttattcataatagaaacacctactgtaatgctaggcgaaaataaaatacaatcataattaacatatttctttttaaaatattctgtaaatatattatctctaatgaatctgtttgtattactgtttatagatattacttttaaattacttttaattaaaagactctcaaccgttttaaactcagataatgtagaaaatgacattgtaacaacttcatttctatttttgtttttacaaacatattctaatactgaaaagaatgtattcttttttgtataaaggctaacatttgtttggtctttataatggttttttattctgcatacatcacttaaaatattagaatgatcacttaaaaatgcatctaatattaaaaggtattttgagtttaatatattatagaattttctaagtatatttaacgcatatggtgaatcctctatactagtgacaatatacattagtaatgtttcaaactcatctaatattacataatcaaagtagtctagatttattttatgtaacgagtttatttggcatacataattttcaccatataatatttttttatcttctagataatatttacatccatattttaatgatatatcttttgcaagagtttgcctaacactaatgaataatatttttgatttatctttaatatattgatttatgacatttgatttaccactacccataggtgatttaatacaaactactctagtatcaggaatatcaatatttttcagaaatttttggtttatgtgtatatcaggtgtgtatttaagtgatgacaatattattttactttgtttttcttgtagaaatgctttaccatcttttgttttcaaatactcttgtaatatgtttatattttttgatgggtttggatgaaatataacaaaagggtttgtttcatacaaacaatatgaatattttgactttttttctgaaggcaaatttattgaataataaccaacatactcttttatatttccttttaacttagtttttatataatttaaacaccattctacttgtttattagaacagtttattgatgttgttttagattgtgattttggtagaattgaaaatgggatacctatatcgttttcattcttgtaaaatactgatacttttaaagatggtgcttgataactagaatgtcttgtggctgattcatctattgaacataatccttttaactgttctttaaagaataataaagtgtttctgatgttttcgtcagtagatttgtagtctatcttgcatataacttttaaattgaaattatcaacaaaattatatgaccttgaattacaaattaaacactcccattttgtattcttaaaatagtcaattattttttgaaaattacctttagtaactttatcaagatcgagtataatatacccacagtcgtgcaagtaatccatgttttctcgttttctttcaaacaatccatttgaatgaatagggcgacttagaataaaatttgactcaataagttgtgcaaatgagtttatagaagggcatataacatttctaaaattaactttattatcaatatcagtttttaatactttagtttttgatgtgttgtcaattactgtaaatatatacttcataaatgccccttctataaattgttattgtacaatattgtagcttagatttaacttaattatatattaacaactacctcgtctataacatattgattttcattataatattttaatctctcttcataatgtttaaacatatagtttttctttgcatatcttcctctagcgtcatcaactatatcatacaaatatacaatattatttttggtttcatgttttcgtagcattctccctatactttgattaattttaatataacttttaccaggcattgtggatacaagattttttaattttctaatattaaccccagtactcataatagaagtagtaccaaaaataatagcatcatcacaactttccataatctgtcttatagattctctatcactagcttttgtttcaccacttacaaaaaatatgttatatttgtttaattttcgtaattcactaatttcaacatcaacaccatgttttaatttacacacttttctagctaagttttcaccattagaaactcttgtaaataacactatactatttcctttttgtgaaactttgcatattagtttggctataatgtcatctctttcaggtattccaagaaaaaatgatacttcttgctggtaatttttaacggttctaactatagagcttgtagcatcattatattttagtattataggtttaatctccatttcagtagctaatcccatatcaattaactctcttggtgtaacatatgttttagcagtacctaaaacagccattaaagataatttatcacaataattttgaggtaatgtccccgtaaatccaaatctgtactttgcgtttgtagcggatggaaatattatactttcatgaacatcactggcagctgtatgacactcatcttcaactataacagttatatctttaaataatgaaacatttctgtataaactttgccatgttgatatatttaacttttttacaaaggatactactttgaaatcaccacccagtctatcaacatatttgtctatatctgtaaaaccatattctttaaaatcagaatacatttgatttaataacactactgatggaactattatcaaaattttgtcatctgtatctttatatttttcaatgaaccatctacataaaacgtaaatggttaatgatttaccactaccagttgccattacacatatattgtttccagtattaatactatcaaaagcagcttttaattgaaaatcataaggttcaaaaggtagtttaagtgattttacaaacttattaaactcttcttcagtaattttttctatttcatcatcaaaagataactcaagtttatatttttcatttaatcgttttataataccctttatgaaacctttagggacaattagataatctccacaatctttataaaaatatttaacaccatcagaatatcccatccttacagctggtaagaattgggcatttggtattttagctgagcatagttgttttatttcatctaaatataattgtgtttcagaaattattttgtaagctgattcgtttagtttttctatttttatcaattcaaatcctttcaattttaaataattatattctttaatttaccctttaccatttaaaaatttttctatttcaatataatttgataaatcatatcttgttttgtttaaattatctacacatttttcaatatattccattattaatatagctgttgatttttttacacgaatattacataattcattgtctttagaaattaaatctttaatttctgtaactgtgtaattaatattagagttttctctataatgtgaataaagtatcatatatttttcattatattcttcatctatttgtattataatatgttttaatctactccaataatttagatatttagcaattgtacctgataatgttgttaaatgatgctttatagttgatggattccagtttgaatccatgtcatattcttctattatttttttatgaaaatttttcaaatcatctattgtcatatcatttacctactagttcaactttacagtttgtgttaaaatacggtgttaaatcaccccatatttttcctttaactattaaaggttttttataatcttttatttcaaaattatatacaaattcattatcagaatttgttacttcacatataatattaatataatagttttcttttgtttgtgcatacaaatattttggtacttccacaaatgtttcgtgactatttttaatctgttcaggttttataataatattttctcttatttcgttttcaagattttgtctaatttcattttcaacttcattttttgtagatgtgtttttagttataaagccattaaaatatgattcatatttattatttacagatgttttaatatcatcatgttttattttatataaagctgttgctatatagcatccattagtagaagttggcacaaatgtaacaattggtttgttatattttacatttttacctttattgaaaacatattgttttcctctgtattgataaacttcagatttaacttgttgttgttctaaaccatcaatttgattattaaaatgatcgataatatattctttttctaaatcaagatccttagtacagaatgatagttctataacaatattacctttatcttcaattacagttgaatccatataattatatgcaaataaacttgaagctagagttactataaaacataatttttttagcatttttaatcctttaatttattagaggaattatatcataatgtatcttaagataaacttaactataacccatctttgaggtttgagctacgaggaagctcttaggtctataatcattctcgattacatttaccgttgtcttaactatcaatcccctcaaaaataggcaatattattaaaagtcatatcgttctttgtttatagtttcaaacattattttttcagggtttaaatcattagttaataaaccttttactattgaaggactaaaccctgatattaaacaagttccattttcatcttttcttacaggtatatttccacttctcccataaatattccaaaaaattaattcaggcattttataaccactgtttttaaaagaatctcttatatattcaaaatttgttttaccttgttgagcttcgtcaaattccatatcacttaaaataactaaagcatcaggtaaatcttcttgtgacaaattatcagcttttgctctatttaaaatcaaatcaaaagttttagcgaaattagtattcataccccaattagatttttttatggatttatatttttctcttaaatcatttccttctatctttaccatttcaggatttgcggaaaaagttataaaataatctttaaaatctttatcatttctttcacttaaatacatacctaaagaaattgctatatttaaagcagttgtacttccttgaacttctgtatccatacttccagaaacatcaattatagggaatagagttttcttagaaccttccatccaattcttttgatttttccacatttcatttgctaaaatatcatttttaaacattaatttaattatttcataaggatatattgcagaaatatttacttttgattcaccttttaccaatgattcttgataattttcaaatctttctttatcatttctttcaaaggcatcattatacttagccattgcttttgaaggaattttttcatattctattaaattccattctttagaacacattttattttcaacaacacaagtattagaagacaataactttctataatctttagcatttaattttaataatttcatcaattttttggctaatttagatttacttgatttttctctaggcatccacttagcacataattgattattaaaatctagtattttaattaattcatttcctactaagtctaattgtttatcagttattaaatcatcaaacctgcctaattcaggaacttttctaattattcttttataaatttccttatcattttctgcaataaaatctaaaaatcttttaaatacttctcttcttcctgcaccttctcttgcatctcttgtccataacaatattctagaagttaattccttatcaatattaaatgattcttttactttttcaaaaacattgtcaatattattttcattagttgttcctataataaaaaataaatctagagctacatttaatgaagagcttaatgttaaagcaccattttctgtataagataagtttgatagagaattaacaaatttcattttctttcctttataaaaatcagggtatttaaaattcagatatactgaaaatcactaagcacataaaattacaaaatattaatttgctgtaaatacccttttttaatcatggtactttttagagaattcatcattagcagtaatgtccttaaaactttgctgttagtaccatttacttgtgtttaagttacttttaaactcatttaaccatctttaaacacatttaaatcttcattgaaaacttaaatgtgtttaaaatggtgtagaaggatggatttgaaccatcaatgccaaaagacgccagatttacagtctggtggattaccaattatcctacttctacatttattataattataaatggctgcagatagaggattcgaacctctgacccatcgattaacagtcgattgcactaccgctgtgctaatctgcaataattattgtgtttattcactacaacttcaatagattagagttattgaagttgtggtatctaatcttatattgtgtgtttttactcaaaaacttcccaaactgccatttgggatcggaattaaaccgatactctcacaatataatcgaataaacacaattaaaacttccttaaaaaatcttaattgtgtttaaaaatggtgggcgaaataggaatcgaacctataaccaaccggttatgagccggttgctctaccattgagctactcgcccttacttaatttttatattcgtaatcgtatcataataaccttaaattaaccttaaaactattattgatacataagagataagacaagctctctctgttaggtttgactacctaagccgtcttatctcttatatatccaatttttataccgtaatcgtatcacaataaccttaagacttccttaattattgttttatttgaaatttaagaggataatatgtaccatcttcactaaatggtaaatctcttgttttaaacttcattttatctgtaacaaatactttattatttaagtataattctatttcaccaactttgttaaattgtgtttttttagtcttttcaagtaaaatataatgtccaaatacaaagtttcttatcattttgttaaaagtgaaagctatattccattctcttactttttttggtaaaatataaacttttatacctaatgtttcagtgatcttatttatctcagagatacttttatacctaaatacacaaaaatattcagcatcttttgcttttttaaatatatttggacttacatatctttcaaaatcactaggtgtttttggtattcttcttaaataattttcatcgctcggagttaattccttaattttaggaagcataaatcttaaatctgttgagttagcctcattaaactttaagaaaacaggtttatatttgtctgcaacttcataaaaccaataataaggtgatttcgataaaatatatgtgttaaagtttattttattttcttttaaattttttataaactcattactttcttttatatcatagtaaggatcaaatgttagtatcatcatgttccttatttaggtattcaaaatctccaccaccttgccattgtacttctttactaataccaccttgctcaccttctataacttttttaagtctttcttttgtgacagtttctatataatccatgtattctatgcctatccatttgcgtttcattttatgagcaacggctagagtagtaccacttcctgcaaaaaaatccattactatgtcgttttcatttgtagaaagatccaatattgtttttaataagtattcaggtttttgcccatttttaaaagttgttttcagtccttctctacatatgccaattgtagatatgtttgtccataaatcacctaaagaataatcaagattttcatttaaaaacaaaactttcataattacaccattattcatataataataatttgttttaccttttgaatttattattttttcaaaagtcccttcttccatattaatgttattaatgttattatcaggttttactaaatatatcaagtttttaaaataatcttgtttatttaattttggatcaaaatattttatttcccattctttataatcgtttccaatgtttggaatgtatttgttataatatttaatatatgatgataattcattttgtgtcttttttaatctaatttgttttaatatagatttattatcttgttttttataaagtagtatgtattctttatttttcggtaattttttatgacaattagcattttttaatcctttagattcgttcatcttaactacaatacaattgacaaaattctctcttccaaatatctcatccataagcacttttaaataggcttgttcattatcatcacattgtacaaagatcacaccatcatcacgcaaaaattctctagctacttctaatctttctttcataaattttaaccaaactttagaacctatgaatttatcttgtgattttatttttttagcttcttcttcatctacattaaaatattttataattaaatctatagattcaaaattatcattatactggaaatttttattcccagtattataaggaggatcaatataaattaattttactttacctttataaaaaggtaaaatactattcattacttctaagttgtcacctttaattaaatagtttttatcaatattcatataatttactccttattataactactatttttaaaactatcgcacattgatttaaattcacaccaattacataatatacttggcttagctataaatgctttttcattttcaatactcattatatcttgagcaaattgcttttttataggtatcaaatcatcacttgtataagtgtaagtgtgaaaatcattagtttcaacatacacaaactggcatattattttatctacatttaagactttttcagcccatattgcatataatgctaattgatttgcatctggtatatattttttatcttttgttttgcctgttttccaatctattattattgcacatctatttttaatggcaatataatcaatagtacctcttataacataatcattaccataataattagttgggtttagcttattatctaaagcccaatttacttcatttcctaaagctggtaagtcttttatgtttttgtatttttctgtttctttaaacttttcaaatatctcattatattctttatattgatctgcatttattaaaggattattatatgatttgcttacttcgataggttcttctttaaaactttgctctattaaccaatgtatataacttcctttaataagtgcagtttgatctttaggtacagatattttatcaatataagaatatttaaactttaatttacattgtctaaaacactctaatcttgaataagaatatctatacttcataattcacctttaatcgttaatttgatcttttaagttttgtaatagttctttatcggatactatcgagttatacatgcttatattagcacttaaactatcgatactcattttaagttcattttttaatgtagatagaaccctgttaaattctgttatatttataccatctttggataattttgctttaatatctcttatttcaacatcaatttctcttttttgtttctctaaatcaaaaatttgtttcatggcatttttgactagctcatcttcattaatactatttttttcaataaaatcagtaacatttagtttctgactttttaattctacaaactcattaatattttccattttcagtcctttcaattttgataccgttacggtatcaaaatatacttaatttaaacttaatctacaattttatagtcaaattctttgaaattaaggtttccatcttttaaaagctgccattcattatttgtatctaactgtttgaacataatctttttacctaatttatatgctttagtgatatgtctttcattacttatatcatcccttatagattttgaataatcagctttataccatttctttatttttatctgtttaccattaactaaaaaataccagaattccctatgatctccatcaagagtaatatcttcttttctacagttgtaatttttcactatttcatctagtgcttcttcataagtataagcacccacatgttttttaaactttctttcactttctgaatactcacctgttctttcttcaatttcttttaaacactcatccatacatatttttgggttgtatccatcttgatataaactgttaattaagaatacaatacaatcacatctccaatctatactttcatgttcactatccctttttttaataccttcatctatctcttcatgtagataacctaacaaagttaaatgatcatattcttttttatctaaatgtctttctttcaaccattcttctaatttctcaaatagtttcataattttaacctttcatttatagttttaatgtcgttttcatagtctttacaatttaatgtttcataatttcgtgcctcctaattatttttaatagaaatattacagtttttctttaatattttggaaattttcaaaaaatctaataattctttatccttaattttaggaaacaaaaagaaattgacaatttttagtcctttctttatgtacttttttatagttaaatcatcatttttccttttactatataaaaatgttgtaatattaactgatattacaactaatactgccacaattgctataagtgttcccacaacagatgtatttgtctccattttatttcctttctataattaaattataaccattcatctaatgtatttacaaaaatatttttataatcaaatcctatatgtttactcataatatctaatttttgtataaaatatttttcaaacatagtttcataatcaacgaattcactgatacttggtatttctcttacaatttcatcatcaggaatacatataacattatcaccagtaatggcatttggtgttttcagatagacaatatatactttttcaccttccattatttttttaagtttatacttgtttgtaagattattataatggattgaacctctagattgaataggacaaggattaccatttattgatgaaacccatttaccatttgatacaatatatgataagctacttacacttttattcatacaaatatcgcttagaagctgttgtttaaactcattctttatgttattaataaattgccttaacccatgtagatcactgtcaagtattaaatctaagcactcatttaattttagttttgtccattttggagttgttttatcaatcataggaaggccagttattttaaaccctttatttaatttctttttattaaaatatctcccaacatatcttttacgagcacaactaattaatctatcgcatattgtttcctgttccattccaagattactatttttatctaaaccattgatagctgttacagcttcacttatagcatcatctataacaggtgatattgtagtttcacaataacttttcaaaaatttggcattttcttgcaaatctttaggtgtttctagaaacttaaactcaaaatagttagagtctgtatcacattgaatacttaaaggcctactattaacatcaatatttaaattatatgtttcattacaaaacttattaactttatatgaaacccacatatttaaaaacctaccagttgttgtgattgattcactcatttttttaccaaaactaaaaggatttattgctagtgatgttgagccataagcagaattcataagaattttaaacatatattgcataagatcatggtaatctatttcagaagcagttaaattatcattttttaaaaaactcttatgatttaatctatctttgaaaaaattttctattaattcagcaaataatgaagtaccatttgaaaagtataaacatccatttggagtaacattaacaccatattttttacatatctgttttatttcatccttattgtcaataatatttttaaaataataaaactcctccatactatcattgttagttttatcataggtttctgaatagaaataaaaatatttgtttaacatatttttaaggtcttctggtaatgatgtagaaataacttcatttggtgcctcattcataaaccttgctctattttcttcaagtattttagctttctcatatgggatattgctaactggaatataattatccaaacctattttaaactcgataataatatttggatatagagatgtaaagtcatatgaacatacatttttgtgtaatccttcaataactctaacccatcctccagggtatggtggatcatagtttattatttttaattgccttaaaggtaatataacattttttgataaagcataattatacattaatgatgcccattgcataagggtgcctgaaacttcatcagcatttacaccacacttatatgctactaattgacatacttttaataattttaattttcgttctaattttataagtaactcaacatcctttaaaccataagaaacaaacttattaaaatctttatacaagtcttctattgaaccatcgtaatttactttagtgtcacctaattcaagtttggatatttcatccaatgaaaatctacttggtttttgagttgtgtattttatatataaatctctcaaatctaattgaattataccttctatcttaacaccatcatactctatatcatcattagttttcatttttttatgtgttatagcttttataggtgataactcaacatagtcatctatgccaagatggatcattctatttacaatataagggatatcaaataaattagagttgaaaccagctataatagtaggatttgttttaactacaaatgttaagtatttttttaacatttgtatttcattgtcacattttttgtaaattacttcccctatatctgattccaaattaatatctaaatctttagtaccaaaaattataaatttatttaaataattatcataaacttgtattaaagatatttcttctgttgggtttgatggttttgcataaccatttattgctctagtttctatatctagatattgtgttctgaattcatgattacaatctatatctttgaagttttcacgaatatatttttgaggtctgtttatattaccatacaatggtgtagaaggtgatacattttttaaatactgatatatctcatatgttgctttaaatgttttcttttttaaatacccatgtgtatagaagtccttatattctgttttttcattagttctaataaacaattctgggacatattcagttgatttgtattcttttataattgagttttttgtaacttcatcataaagtctagcatataacttaaaattatgttcaaaaacatattcatatttaaacatcaatacaataccccttatatctttttggggtattataccaaaagttatcttaaaggtgacttaaagtataggacctctttagcatactctttaccattaaaattaggtatacttttggtgtatatttcttgaagtccttctacatttgaagaatattcacttagaaatattggaaactgcttaaatttgtcaaacaaaagaggtaatgtattactatcaaaatcagtataattaccagatttagctgtatttttatatggtggatcaaaatataatacagtagtctcaggatcatacttggataaatcaagatcaaacgcatctttattgcttatttccatttttgaaaaatcaatatgtttatgatttcttaaaaatgttattttttcaatagggtatattctacacattttgccaccaccaacaaaaatcatcaaaatttccattagctaaatattttattgctctagcaactctttctgtcttttcattatataatgcatttaatcccatttgaatagcagtgatagatattgcacctgaccctccaaatgcatctactattgttttagtatttggatacatttcttttattttgcttacaatatcaacagctagggatcttttacacccaagataagttggataacaatcatacactttcatataactcctttaccttttaatggttctggttggatccatttatttttgcaataattagtataataattattagatttcaaaatatttatttcattagttagcatattcctgaaagttgtatattgaatgttatcataaaaagagttgttttcaacctttgttacaatgtcatcatcagttatccacattgatcccggtattagctcaaataacttattatctatttcccaattttcattgttaatatcttcagagttaagtaaaacattgttattttttgaatcaacaatttttaacttaccattatctttatatattttaatataatcattttctaaagataaagaaccgattgaattgttttctaataatatttgcatacattcaataaatttcatagtttattccatatatctttaaagaactttgcaagtggtttataaactataccataaattctaacccaagcccatacaacatatctttttacaacatttacaccaagtaatttcatagcatctaaaaatagttcatcagcaagagctctaggaatatcacctttatttgattttccacataaaaaatcatgtaatacataagctttagtaggttttccaactggtgatattattgattgaaacaattgtggaatactaccaaaatcagttctaaatccttttggtattcttataatattatttccaactaaatatttttctagtttaaatcctttagaagttacatcaaagtcaaaaataaaatgaaaatcattgtataattcaaagttgttaccatatctgtaaattgttataagatctttgtttatattttccatattaaccctttaattgtaatttgcaagtagaacataatattgtataatcatctccaacacatatttcacctgtatttgaaatgttatgattgccatattcagatccgcatttttcacaaattgagcttaacttataaattctatctgcatatggtaaaatatttataatgttttcaaataattttgattcataatttatgtttaatccacataatacccagtttttactgatgttatcagttataatattagtaattgagttatcaaaaaattgaaattcatccagtaatatataatcatactcatttacaattgcatttatgttatttgtttttattacatttaaattatgtaatgttttataacttcttgatataaattctctatcatcaatttctggtctaattaaaatgtatttttttctaccaaaatgaagtttttcagcttctctcaataactccaaacttttccctgatctcataggaccaattataagttttatcatgatataaacttttcaaatttatttgctaaacatatgcttataaacattaatataactgttactggtatacctattattaaatcataatataaaacccctaatgatattatcaaaaataatatgatataaacttttaacattattgctgatatcaacaatattaatatgcttttaaatgtatccatttaccacatcctcaatttgcattcagctattaatccatcaaaagtatgctcttttataaaattttcaatattaacaccactttgataaatttcgtttatatctttatattttttgaatttttcatcatcacaccatacaacaaatttatgatttggattatttgtatgttttagcatttcctttctaccagtttcatcattatcacaacaccatattatgtatggcatagttttcattttctttggtaaagtcgcacccaacatagctattttatttttaaatggggtacataacatatcaaataaaccttcaaacacatatacttcttttgatggatcaatattaaaatagttcataactttaaaaccatcatctgaattaaatatatagaatattttatcatttatactacgactataaaaactaaaagcattatcatttacagtatttaaatatattataaaatttggtaatttaaattctctatcatttattacaaatgactctttacaataataaaagtcatcagggtttccacctctttttaaaatatattcttttgcctcttttatacaactagctttaggtaagtttaaattaaaaaactctttaggtttttgtgattcttttttagtcagtgctatattttgaatatttaaatcatctatgtatttttcacctatttcatttaaataattattaaggtacattggatgaaaagttttaatgtaagaatacatagtagctgtataaccacaattaaaacattttatagaatcatctgtataggaatcttttctatacagatgtaatcttttcttatttttatattttgaatcaccgcaaacatcacatttgcagttataatcatcagatttatgtattcctaaatcttctttattatgaataatttcccaatattttacattaattggatttaacattaccaactcttctatctagttcatcaaataatgactcactatcatcattttttataatttctaataaattagtactatatgcttcaatttttacaaatagctcaccatcatctgcaacataagtatcaactacttttacattttttactaatgacgaactaacttgtactgaaacttggctattattagttttaacaatccctttattttggtaatattgtttgatcatactatcaacttttgaagataatttttgggttaagttcattttagctactgcaatagcttctgtttgttgttgaatataattttgacctatatacattgctgaaccaacagctgtattaatatctccatattctttaacccaactaggtaaatcatcatatttttctaacataggtttagcaaattgttgttgtggagtagttgttgaacaacctacaaacattaaacctgcaatcataaccgcactacataaaacttttttcattttctttcctttcattttgtggttttatataaaactcataatacaagttgaaaatttatcaggtattccgtcttcattatctgtatctgttacattaccttgtaaatctatatctgatttaccagtaggattgcttaacacaatatatatgtcattctcatcactattgtttgaaaaatatgagcaaaacacagttgtgtcagcttctgaaatatcatcatattcccaaacaccattttttgaattagttgatagaaactctaatgtttctttgagactaaaatacataattttcctttaaaagtttaatttgaaatattataccatatttatcttaattaatacttaaataaataatgtaaaaaggtgtaatatgaactttagaaatattgctttaaactcaaatatagtttttaggacattattattttctgatgatactcaatattattgtcaaaaagttaaattacctagaatatctttagaaggacaaaaagtagggcattcaactggtactttaacattaggtggtgaagtagcaaaatttgattcaataacattgacgctgttagtagatgaaaatttagaagtgtggaaaaactttgtcaatttaattaataagtataataaagtttctacaaatactggatgtggcattgaagctacatcatggttagaaatatatgattctaaaaataagtttttgtttaaagttgaattttacaaaagcaagttagatgaggtaagtgaattggaatattctacaactgataataatatcataaccttagatataacacttaattttgattatatgaaaatcatataatcatttttttaaatgtataaattctttaataagtgacattgctttatctatacctaagtatgtaattgcacctgctacacctatttttgtaagatatggcaattctagtgaagttaaaatacaataaattatagtacataaaacagcactgttaaaaatgtatttcaagatgcattttatatgttttccagtacaagtatcttcttcatcagacaaataattagataagccacaaattagtccaacaataaaaataggacttaactctaggaggtaattcatttaagtcctatcagctcacaccatgtataaatcacacagaatagaatgtttaaccataatattctgtgtgatattttataatactttttgtatctctgtggaatatcacagtgatatttgccaattaaaaaccatctaaatataaaaaaatagtattttattttatctgaaaaacttttcatgtattatcttttcttttgtgttgttttaactgaatcatcccattgtattttttccagttcctcaattgttttagctgcttctatttttgcttttaaaacattggctttaaaagtaatctcttgtgtgttatatgtaaccattgaggcaaactttaaaaattcctgtgggttaaaagttactttttcatcatttatgtcaatccaaatgatttcagaaactgaattagttccactttgtatatcaagcattaaattagttacagctccattaatatttagtttatctttttcccttgtttgaaaagtatgaccattatatacaattccattttctagagctttatctctatttgattggatctcataccttttcttctcttttaagatatctaatttattactttcctgagtagttgctattaaaaaatcataatatatatccataatattatttgatatacaatattctttaattgcttgttttccagcctcaatttcttcaggtgtaatgtcatcaatatattcaaccatcatgttttctgaattttgcctaactgtcataggcctatttagtaatgctaactctgatcctatatcaattgcccataatataacatttttgttcaattgaccttgatcagctagagtttttttagatattatcatgttttatagttctccttatttttatattatttataagtatttatttccaaacagttccatttgtagttggtgtattataacttatattacaatttgtagtattgccagcaaaagtaacaccttgtgctgcaacttctgaaccattataaacagatatgccagttccacaatttttaatatttacatgggcatctaaacaagtatctgatttcctaaatgcatataatccatattcacaattatctaaagttaatcctggggtaaataaatatgaacatgcatgtctaataccattataaaaattctttatagttaagttattttctacaattgcatgtgatgcaaatatggatccatgataattagcaaatgctacaccaaaactcctgttatttgtattttcaacagttagatttttaattacagggtaaatagacatatcaccataaaatacagtatcaagttgtgaattgcaatattttgatattgtaaatccattcccatcaattattaaatttctaaaatctgtctttgcaatgttaatagtataattaatagtaagattatttaataattttaaagttattgcataattaggataattaatatatcttttacagtaattaagtgcgtctagtatgtttgtaaaatttccaccattacctatagtgaactccaagttataagcaaattcaggagtattatctataatatctttaaatgttgtttgtccatatgttttcattaataattcctttaaatacaaatataaatacatttatatttgtatttaaaggaattatagtttcaatttcctatattttattatttgttgtaattgtttaaatttcagttttaatattatatattaaaactgaaaaatagatttttgtaatttgtatttaagctgaaatatatccatttttagtccaagtacccacaacttgagacttaccagttatgcttcctgaaaatgttgtattataattatctattattccagaagtttcaacactttggcttaacgctcctgaattttgagtaaatttacaagtatgaaaaaacaatttgcttcctatagatgatattccttttgaaaagtatccactgctacctgcacttaattcacaagttgaaccaaatacataagcttctgaattagtggataaagcaaatgcgttacccaaacaatttaatatccctttcatatcgtcaaaacaacaggatgaatttttttgtaataaaactgctgtattgatacttttattattacaatttatttttaatttattaatatttcctaagattgaattatacatagaaaatccaatatcataggaagcattatttaatgtaatagaataaccattaaaatctatatttaaaaatggggaatgtatattcacaatattaataaattcatttataactaaatcactaattaattttatagttatacttttatcactataattcatatacttattggcttcattgatagcagtttgcaagtcttcgaacttgccccccctgttccaactgtccattctaaattagaagttaaaagttttgcagagttatcaataatatcttttatactggaactaccatattctagcattataaatcctttataaattttgatagtatttataaatactatcaaaatttaagcatgaattattccattggctgtaacagtattggtagcaaatggtaattcatatttactccatgtacaattagttacatttctacctgttatatttgtatgagcaccattataacataataataaatttgctgcttttgaacctgtaaaattaggatattgtagattcatataagaattgttattatttaatatattagcagcagatttattatttgtaattgatgaattagttaatgtcattttagaaccatatccacaataatataaccatccattacagttttcactaccattattatctaattttaaatcaaatcccgttaattcaccttgatcattacaatataataatgattgctcttgtgttccatctaaattgttaccattgttggtaaagctatatttggatataacaattttagaagataatgataaaactgcatttttataacaatttttaataccatatttgtatgcattagatgttgaaggaaccatagtaacagaactttctctaaagtaccatccttttgctttagttcctatagcattaaccataattttaatattaggtgctttgcaaccataaaacataaagatatacttttcggtatcaaaattatcaagcaatatttcatcatcttctgataatatatttatatgatttgctaatgcatttcttaagataatttgttcgtttaatttatatcctgattttaatataatatttatgttgcaattatttttaactgaaatatattcgagtgcttttgctaaagcatctgataatttggagaacccccccccctcctactgtataagttttgctctctgttaatattttaacactaccattaattatttcttttatatttgaatttccataatttatcatatttttatgattcctttctaatataagtgtatataaccactagatgaaaaaacatttgcagtaatattagttttattaaaaccagatacaactatattactactacatgaaatattcccaccataagaaacacataaagcatatgaattactgtttgaaatatttttaaatataggggtattaaatcctaatttagatgcaacatgcgaaacaccacaattagcagctacattattatatgttccatcaaatgtaacatttccagcatatattttacttgaatcagcactccatagtatatttccactgcaagttttaaatgtattattttgccacacatttaatatactaccattgtctgctactacacccgattcagtacaattttcaaatgtactgttttgtactaatcctatacatccaacactaccaacaccccattttgcattatatacaccagaattattaagcttaaaattagtttgtaagaatccaaatgccatcgaaaacatagtaggtactgaactaaatctaagtttaaacgatattgttggagatattccaaatgtaaatgaaactgcaataggatttgctgcgtattgatttataaaagcgggattaggtgtcatagttccatcaaaatcaacataatcatcttctgatgttaaaacaacatgtcctagatttgcattattgatatgaagactttcagttaatttatacgatgacttcattgttatagtaattttataatttgtcacagatatatattttgaagcttcttgtaatgcatctactaaatttgaaaatgttccatttgtaccaacagtccattcaagattctctgttaatagtttaggtaaactacttaaacttaattgactgctttttgtttttgaataaattatcttttttataggaattgtatcattatcagtatatattactacattattatttttaataatgtagtcaaaaggtactgcatctattgatgagtttgcagtattttctatatataatcccagaacttgaattattgtatcaggttcaattgctattttgaacatttttttacctttactgatattatcagttgtggtaaattgtggatcatttattactttgatactactatcaactacacctaaattgccatcacttgataatgatacaatactattattaagaattgcttcatttacagttgatgtagctgtcaatccaccttcttgtttttttaaatataatttattttcactttttagcaatattattttattgactggaaccttgtctatgccagtttgtgaatcatttacaaatgaccatacattatctataccatatgccatttaactgatctccctttttaacattatttatattctatttcagaaaacttaccatcattaataatattaacagtagatgtaaaataatctaattgatttttaatttcactattatgacttataacatacatgctcattaagtcagtattctttgttaatatttttaataactcatttttacctacactatctaaagaactatctaaaacttcatcaagtataagtaaattacattttacatcaaacttatttctacaaatatctaaaaaagccaacattatagaaaatgttagtcttaaagcttcaccattactcatagatttatattcaaatggtttattatctttagtaattgtttcttttaagtttgaatctaacaaaaatgtaaaattaaactcatcaaacatatttatatatttgtttatggttttgtttataaatggtaagtgcatatttaaaaatgcaccttttaaattgttattattcaatagaatttcaagttgatttaaattagaaatatatgtattaatctcattatactcatttacaatttcttgtaattctttttcatttgaaataatatcatcattagctggtttttctatgtgttctactttgcttttttctaataaatcttcatatacttttttattttctattgatggttttaattctaacatttttgtatatatatcatctttgtttttaatatatacttcattttcattttgtaatacttctaattgttttaataaatcatcatgattagaaacatcaatattgcttggaataatttgttttaacttctcacaacctttacacattttatatttttccattaattgtaaagctgatttttgctcatttataatttttaacaaatcatttattttattagaagggtcctgtgttaatatactatcatattgtgtttttaattcttttagtttttcaacctttccagattcttctttaattttattttcaatttcattaatattattatttttattttctatatagtcattataagcttttaaatcatattcgtattttatttttgcttttgatataacatcttgcaaagtgtttattttaaataatgtatttgtttgtatagtagttttttctttttttaaaagttttattttttcagtaagttctaaaaatgtagcagtatcagaaagtatagcaaatacatcttctttttcttttttagataaccttacaaatgattgacttaacaaatctccacctaaatatataagatttctaaaagcttgttctgtaaattttaatatattattttctaaaaattcttgatacgctgaatttgtgcttaataatggtattaattcattatttttgtatatttcaaaaatgctaggattagtccctcttttaattgtgaactcatctccattaatattcatttcaacttcaacatacattccttttttattgatattattaacaagtgatcctattgtcttaccattatatgttttaccaaaaagacaataatgtaatgctaaaaataagcttgattttccagcaccatttttacctgttaccaaatgaataccattagtaaattcaaattttgtttttttgtttccatatttcataaaattttgcagtattatagatttaaaattaatgttattcaattctttcctttcaaaaataaaatgagtgattaatcactcattttagcttttaaatacataataatcatcatcttcatagactaagacaacatcatctatagctctttgttttgcatcatctagatctgaatcatcatcttccatatcaaaatatccaaggttttccaattcatcttttaactcatcttcaccttctgcaactgaaaaatcagacataatagcaattggatcaaattcaatctgttcaccaatatcatcttctagttgtgttatatagtcgaaaagaacatctgaagcaccataacttagcccttgtttttgcattctttcttggaacatatttttatcaacattaataatcattgtttctcctttagttttgatttataaaaattatatcacagttttcttaatttaagcttaattatttataacatcatttaatactgactctaaatgcctatgttctttcaaaatatattcttttataaaatctaatgactcggcaacagagttatttaaactaacagattcatataacttttcttcttcatatttgtagaataccttgcttattcttgccctagcaccaaaatattctaatattttatcttctttttcatttttttcttcaagtattattttccctactttacaaaaatcaggaaagttgccagtaaataactcaggttcatctttatactgcaagattattttatcttttaaaacagtaacagtaaaatgtcgcctatcccaagtattttctacaaactcttcttctaagttttcatttaacaaaattataccaggtacagaattaatctcattaaaagtcatctgataaggtgttcctatataaacattattttggttaaaatgataatgtcccatataaacttttttatattttgaattgtcaatgtttaatccttcttcagcaatacttgtatgattatatttaaatccttttaattcagcatgacctagtaatatatcacattcttttagtaactcttcatcaccacataaccatggagatattcctattttgtgtttgccaaaaacatgatatgatggttctttaatatattttattccaagtaaatcagcaaataactcacttgaaacaatatctctattatctctgttatacatatcatgatttccagcaaatgtataaaaatcaaacccttcaaatatagttttaaatctagttgataaagtatgtaataattttaaatcaattaattttctattatcaaacatatcacctaattgatatattgtactacaacctttttcttttaaaatgtctctatatttttctagagaatttaattgtacttcaagaatatcatgatcaaaatttttacacccaaaatgtaagtcccccattaaagctatcaattttcccatatatctaactcactttctactgtctttttctcttttttaggaaaactaggaacatatatatttctaaacttcatgatatctaatgttttaaagtttttcccagcaattttgttatactcatcagtttttaataaatagtcatgatgatatatcatttttactgttttattattgtcaatatctttcaaaatatcccatagtgtattagattgaataatattttcatttacaataaaatatctttttgaagtgtcaagatttaaatcagtttcaacttttttattaatatcttctacaatatacagtttattatctatagcaacaataggatatatttctacatcatattttatattttcatcatcagttttataacagcatgtatattctttctgttccaatcgtaattctaattctgtgtaatcagcataatagttttttaacagttcctgctcagcttttctttcatttataacttgtattatgctattaactattatttgagtacaatatgcaaaagctttaactggttctttggatatttttgaaactttattagcatcaaaattagggattacatataacattaacttttcagtagcatttgaataaaaatcatctttatatgtatatccactgaatttaggcatggttaatatgtgttttattagaagcaaacacatttcaccaaatcttgtttttttataatgttcagatatcccttcttctcttaatttctctatttgttgaatgtcatcatctgttttattttctatttttagtaattcttttaatttttcaaccttttgtaattttacaatttcatctcttaaatcttcttcctttaagtaatccatataattcctttttattttattataacatataataacttaaagtcatcttaataaatataaataatataatatacttaaataaaggaaagatatgagtaaggttataaatgaatcaaccacaacagttgatattgctggtgttgaattaaaacttgcaaaattaatatatcgtatatacaccgaatctttattaaatagaataggagcaagaataaatgtagcagttcctaatggcagtatttttgcttttaagggaaaatatttaacagattatactggaactgataaaagcagcaccccttatgctactgttttacctgattttgctggaaatagagctaataatcaggaaactgatgtaaaagctgaaatgaattatgaaattgtaaaaagagcaataaactgtcaaactaaaaaaataagatcaaaatggtcaatagaagctattaccgatttagttgctcttactggtaaaacaactgttgaagatatattagaaaaagaacttttaacagaaattattcaagaaattgacttttcagctttaaaaatgatgacaactaaagcaacaaaaacacaattaacattaaaagcacctaatgatccattagttggtatagaattatttaatgcagctcagaaaaaaatattggaaatggctgcttcaaccaaaagagctataactatgtgtattacagcaccatatgaaacttgcgctaaattgatgtcacatcctaattttaaagcaaatgaagatttcacaaactcatatttcatgggatccataggtgcaacagaaatatattgtgattattataattctttaaataaagaatatatgctaatttcttataagcatagaaataaagaagtcgaaatagctgatggttctacttgctttgcattttatagttataacataacaaaagcttttgacgctacaagtggtgctgaatcatattttcattttttaaggtatgatgtagttcaacatccactagataatactaatgatgggcaatctattttcttacattgtattgaaatacaataggtaaaatatggcttggaacttaaataatagacaaaatgagtatcaattatttggtactctatcagcagaaataatagatatgtatgggtttcaactaacatatataaaaacaaaaagattaggacacgataaagttctagatgatataataaattatgggaccgaagcaacatatcagatatttgcattaccagaaaatgcagaaatgtttgatgaaagaggggatatattaaataaatttggtatatttacaatggattctatgaatctttttattagtgctaatacaatgaaaaggatatttcaagatgagtctaaaataccatctgctgttggtgatatattattgcttccaagtgggaaatatattgaaataacaagtattgaacatcaagtgcctggtgctaataaccaatttacttattcaaattcaaaaaatgtttatatgctaagatgtaaatcatttaattataatcatgataatataccaactttagaagaagttaataatgaagaagttaatgaatctttagatgaaatttttaatttagttggtagtgcagaaaactcaaaagataaaataaaagaagagcaagataaagaaagtcctttagttaaaggaactgatagtgtgtttggttatttagatagttaatcttttatccaaacaccctgaccacaatcccacactctattatatccattaatactcatattctctgcttcagtcaggtttggattaaatttctctagtttatctttaagtttatgtttcataaattgttgtcttgaatatttgttgttacctttaatataaaaataacctggattagaataatggctaaactcgaatcctaattgtttataaattgatccatcagagtataatctatctgagtaacttattaatgagcctgggttatttttatgaaaatgttttaataacctagaggcaccacctattacatttgtgttcttcttagtacataatctaattaactcccagtcatacttatctgtaaatctaggttttccaaatgacattaagcaaactaacttatctttgtaatagagtccataacacacagttgatccagtaaatccttggagatgatttttttctaaaaattctttctcttctgctttagatacttcttttaaaatacattttctagccattattctctcagactttcctaatttattgtttataatactagtccatatttctttattgctgtaccatgaatgttcaaaaatgtgtagaagatgaatacctttattctcacattttagtgttttatccaaatgatagtctttaccttttccattactttctgaatgccagtagtctccattacattctatggctaagttatggtctggtaaatagaagtcaagttctttatcacttaacattgagtagtcattttctatatagttatctagtaattcagatatttctttttcaaatga

SEQ ID NO: 5 - DNA, 159905 bp, Camylobacter Phage CJLB-12
aatactaaaatattagctcttcagcttcaaatttcaaattttaatataataaaacaaaatcataaaaagatttataatgttaagcaaagaagaaataaaatattttcaaacacataaaaatgaaataacagacgaactcttagaaacaattagagctcaaggaaaactaggaaaagcacaagccttagaaatcttagatttacctaaagactctgataactattacttagatgcgtataatacgagaattagttataatgggtctcgtggtcttaaaaaagcttacacaaaattaaacttaagtccgatacatatcagcgagcttgaaaaatgtgcgaatgatccactttatttcttaagaaattatgtgcgaatgactacaccaaaaggttttgatttcgtagattctaggccataccaggatgaatttatacaattgctgagcgacgattctatcgaaaacgtgatatcaatgcagcctcgtcaatgcattgaagcaaatactaaaataaatgtaaatggtaatgaaactactattattgaattattcaagaaaagattattgaaagttatgaatgtaaagacaaatatgtagaaacgcctataggtaaagtcaaaattctcgaagtccataaaactattaaatacaatatttttgagatagaaaccgaaaatggattcaagttacaagcatctgaattacacgtattaatagacgaaaatgataacgaattatatgttagagattgtttaaataaggtaattaaaacaaaatcaggaccttctaaaataatatctaaaacatttataaaatatgatcattgttatgatttaactttagagcattatcacctttattacaccaatggtgttttaagtcataattcatctaaatcaactacaacaagtgtaaaacttgcgcatttatactgttttaagaaagatatcaacataggcatagttgcttacagtggtaactcggcacgagagttcttagacaaaacaaagaaaatgttgataggcttaccaatatggatgcagcccggaacagttacttggaataaaggttcaatagaatgtgaaaataatataaagattttaacggacgtaccaagttcggacgcattccgtggaacgtccacaaatataatcgttgtagatgaatgtgcatatttagatcctgcgggctggatagatttcactgacggtgttttaccatcacaagccggcttagctttcaaaaaattagtcattttatctacacctaaaggtaagaatcatttttacgatatttggcagggtgctggtgacactttagaaacttctattaatggatttgtaagacatagggtagattggagattagtaccaaggtttaaatctgacggtactaagtatgatcctgaagaattcaagcaacaacaaattaaaaccggtggtttagttgtttggaattctgcatacgaatgcaaatttgaaggttctgcgatgacattgatacctagtgaaatattagatacttataaaccacaagaaccaatagaagttgataatattaaggattctaaaatactaatatacgaagaaccaatacccggacataaatacgttatgggtgttgatactgctaaagaaggtgctgattttacaggagtccaaatatttgatactacagatttaaatttcagacaagtagcatcagcaaaacttaaaatagattatatgttattaccagagttactcaatgagtatggtttaaggttcaatcaagctttaataattgtagaaaataatgaaggctctggtcaagtggttgctgatattctcaaaagagattatgaatatgaaaacttatattatgacgtcaataaacaaaaacaaagattaaaatatcctgggttcagaactacaaaattatcaagggatgttattttacaaactgtatcaacgttagcacaagctaataaattattattagtggacaaagaaactattaaggagtttggggtatttacattaaatgataatggtaagtaccaagcagctgtgggatatcacgatgatttagtaatgtcttgttgtttatgttttggtatttttacaaatgttaagaactttgaagatatgaaagaaattgtagattctttaaaaagttccgaaggaaaaagttttgagtatctaacatttggagcttttgcagatggtctaggtacagagccagattctaatactgataataaggatttgaatctcagtaatttggaatattattaaaattttggattctaaatgaaagaatatattaaatacaacgatagaaaatttactttaacagcttacaaagttaaaactgaaagagatttattattaactgcaagctcagatgatactgtatgcagtaaagatctaaatgatttaaacttagacatttacttaagaatcttagaaccttatatagattctaatataaacatttatgatttatatccggaagaaaaattatttttactttatagattaagagcaacttcagtttctgaccaattatctttaaatactaggtgtgattgtggttgtacttttaaatctaacatagatttaggaaaaattggagatctccatagtattgatacaaatacatacccagatttgaaagacgtttatagcccaaatttaaccgacatatacagtgattcttacttagaatctaatattgtggattgtgattctgaattagatatgtatttagaagctaatactactaaatttaactttattaaagttgttaaatgttataattgtaagaaagatcttgaaattgatttaacaaacccagaaatatataaaaatatattttcagagaatcctataggtgagttctacaaaagtttgacaagattatcatttctaggtaagtttaccatagatggtattttaaatgatttatatccatttgaaagagaaatctttataagtttaataaatgatgaagtagaagaacaaaataaagcacttaaaaaacaatcttagtctttaagtgcttgtgtgagttactttgtatggtttttatctaatctactcttaatactttcattgatttcaacagttatttcagattttaagtcattcttgacttctgacttaacttcagattttacatcatccttaatatcattcttaatattttcagcaagtttagctaaatctttatttttttgtttttctttgagctgatcaataataacttctggttttttagaacaaccaattaaactaccattaagatcttgttgtggtgttacataatttcccgtcgataagtataaaacaccgtctacacaaacttgattaattctggaatccgaagttccacgaacttctttgcctgttttatcgctggaataatcagatccacaccctattataaacaaagctaacaaagctataacgaaacattttagattcttcatagaccctcttttaatattatttatgattttatgatttttgatttaaaactttagttttgaattaagaatgttttaagatattttataatataattactcaaaggagattgaaatgaaagaatttttttataatttaatagcacaaatcaaagggcttaaaattcataaaaatgaaaaagatacttggtatttaaaatgggatttacacaccgggtattatattgaaggtttaaatactaaacgtagattatattgtagtggttattctgatagtttaaacaaattaaaatatttgtattgaagctttgtattagtgtgaataataaaacgttaagatacttttaagatattttacaatataatatcataaaggagatataatgattaagaaactgactgatagagaacatattctaaaaagacctagtatgtatataggtgctatagattctacaaatacagaagattttattatagaatcaggtaaaattaaatacactactttgaattatgtacccggtttaattaaaataatcaatgagattatcgataattcagtagatgctgcaattagatctaaatttaaatctggcttaaatatcagtgttaaaatatctaatgatactgttagcattgaagatgatggaactggtataccagtaataaaatcaggtgaccactatatgccagaactagcttggaatcacgctaaagcaggttctaacttcgatgatgatgctaatcgtgtaacaataggtaccaacggagttggaagttattgtacaaatgtttggagtattaattttaaaggtattacagacgatggtaaaaatagatatatttttaaatctaaaaacaatgctgaaacttatagtgaaaatatagaagcttctaaaaaatcaggaactttagtagaatttaaaccagatttagaaagatttaatcttaaagaaatcgatgaaactcataagaatataatctatcaaagattattaaacttagctatttgttacccagaaattaattttaaatttaattctaagaaaatagattttaaatcttttaagaattatttaaatatgtttagttcagattttgaactatatgaaaatcaaaatattaaaattggtatcatcccaaatgaattggatgactttaaacaatttagttttgttaatggtttaaaaataccagacggtggtgttcacatagatactattatgaataacgtagttcagggtataagagacaaattagtcaaaaaatataaaagtattaaacctggcgatattaaaaataaattaatgattgtttgttttattaatggaatgccaaatcttaaatttaattcacaatctaaagaaaaaattacaaactcagtaaaagaatttaatgaattctctaacatagattatggattcatcaataaaattcttaaaaataaatctattatagatcctattatagacatatataaagttaaagaagctttaaatgcagataaagctcttaagagtgtagaaaaatctaagaagttaaaatctgaaaaatattttagagcaacaaaaagtcaaaaatatctttgtatttgtgaaggtttttccgcttatggtggtatatcacaagttcttggaaatgaacatacgagcttctatgttcttaaaggtaaaccattaaattcttgggatgtcactaatcaaaaatttgcagccaatcgcgaattatctgaattatatcaaatactttctgagaacgcagaatttgaagatctacaagatggtaaattctatgaagtcacaatagatggtaaaacatatattatgaatgaaaatgatacaattgaaattaataatattaaatataattttgaagatctacaaaaaggattgtaatgagaccagttagaatagcaatttcaggagctcaatgttctggtaaaactacattaattaatttaatgaagaaacatagttattttaagaattttgatttcatagaatcattttctaataaaatagctaaaacaaacaagaaacactcagaaaatacaaacttagcaacacagttgcaaatgttgtattatagtgttaatgctttaaaaaatataaatgcacccactgtgcacgataggtgtattttggatgttatagtatatacaggtattaacaaagacatcgatttaaaattattcacagattctttaataaaatattataaacagttcgattttatttttgttttagattctgaaaatataccattagaatcaaatggtgttagatcaatagatcctgaatttagatctaaaataaacaatatttttaagaaagtagacttagaaaacgtcattcacttagattctaaattagacccagattctaggatattaaaaataatcgaagctataaaatctaaaactaattaataggagaaataatggatttgaatctttatatacataaaacaaatgaagatgccgtaataccagaaattgcttataatggaacttcagcagcatttgatattacttgcaccgaaacaactgaaattaaaccaggagaatcaaaagttgttccaaatggattaagaatttcaattgatgaaaaagatcctttttatatgaccgttcatttaagaagttctttaggttttaaaaaagatctaattccacatattggtattattgacgctggatatactggagattttggagttaaaattaataatattggtaaagaaactatagttattgaaaaaggttcaagatatgcgcaagttttaattcatagaaaatatagttttaagttcgtcgaacttaataattctgaattcaaggattttgaagctaagcaagaaagagggtctaaaggatttggatcgagtggtaaatcttaaaagatttgcacattttaataattcttaataaggatttaagtatgaatacaataaaattttatcatagacaaaaggaatatgtagttcaatctcaaaatattaatcaacatacatttaataagaactataataaagttctagcattattaaatgaaaatgaaattaaatctattaatgaatgtgaattaataccagcgggtaaaactgatattttaaaattatctacaatgggtagtgatgggttaatacaagagtttgaattaagattagaaaacgtttactaataggagatataggtgttagactttgtagatattaagtattttaagttagcagttcctggaacttataaagaaagttctttggatattgctgttaaatgtccaatttgcggagactcaaaatataaaaaatctgttaaaagactacacctatatgaaaaacaaggagttactttagttcattgttttaatggtgattgtgaattaaatactcaaatgagtttaagtaatttcttaaagatttataaaccagaattattattgccgtataaatcagagaattttaaatttaaaattaattcaattgattctagtaccaaatctaacatagaaagtaataatgaaatagagactatgaagtcttgttttgattctagtgctagcaatactagcgattctaatgaatctagcaatacaagtattgaaaacattgctagctctactagcattgaaagctccaacaatgggttcaaatatattaacttaacttcagtgttagacactaatacaagtaaacaaatagagtttttaaaatctcgtgggtttaacgatgatactattaactttttagatttctataatggaactaaatcttttaatttaaatggtgtttattatggaatcaaagactatcttgtaattccattttctaaagactctaattattatgggttctatgcaagatctttaactgaaaaaagatttattaattttacattgaatcaaaattatggagtttggaatctatttaatgttgatttaaataaaccagtttttatatttgaagctattctcgatgctttgtcttttagacaaatatacagaactaatcaaataatagctttaaatacttccacaatagcaaagaatgttttagatttaataaagtgccctttcttttgtttagataacgacaaagttggaattgaaaaaatgataaaatataattcgataccaaatagtcattttatatgttatccaaatgatttaacacaaaaagattttaatgaaatgcttcaaaataatattaaaatagaacttgtttttaagaaaggcttcggtgctttattacatttaaaatctttattatgattttaattataaataaaaaggataataaaatggtaaaaagacaaaagagtatcgaaaatatagtacttaattttccatccaaaaattgtgtattaaaggaagttccgtcaaaaggtgagaaaaataatgagattttctttgataatattttaaataaaaatgaaatagacacacttttcagtccaaaagttttagggagttttgaattaattggcaacggtgaaaatctaaacaattattacaaagaattatagaatcaagtacaaacgaaaacgacatagtaatggacttttttgcaggaagtggcactaccctagctgtaattaattggcaacggtggtggaaattttgtttatgctgaacttatgcctttaaatgcaatttataaagaaaaaatacaaaatttaaatgatgaaaaagaattagataatatttatcaagagttaaaaactaaagcttttttagattatagagtagatataaataaaattttaaaagataaagaatttgaaaatttagacttagaaagcaaaaaagaaattttaaaacttgttttagattctaatatggattatgttttgtatggtgatataaaagatgaagattatgtcatatctgaagaaataataaaacttaataaaatattttatgaggtgtgctaaacattcttaagatataaaatctgtaaaaatttgtatcatttcatagatttgggtcgtatttaaatttaataatccactatggtgtaagtttatattaatgttataattttaaattaaattttaattttgtatcaagctaaaatatattataattaagaaaatattaaaaggagttcaatgacagtagatttaaaacacgatatttgggtagaaaaatatcgtcctcaaaaaattgatgacttaattttaccaaatgtttatttagataaatttagaaaatatattgaaaaaccgtcaaacattttattaagttcagtaaacccaggaacaggaaaaacaagcacagcacaagccattataaaagaaggtaattttgaatctttatatattaacgcttcattagaatctggtattgatactatgagaagtaaaatattacaatttgctagtactgaaagctttgatggaaaacctaaaattgttttagcagatgaatttgactactttggccaaaatggtcaagcagctgcaagagcacttattgaagaagttgctgctaattgtagattcatattaacttgtaattatgtttctaatataatgcctcctatagttaacagatttgaagtatttgattttgatgttgttcacgcttctaataaacaagaacttgttcaaaaagcttttaatttactaaaagaaatcttagataatgaaaaagtttcttatacaaatgaggatcttgttaatattattaagaactattatccaagtataagaggtatgattgcttgtttacaaaaatgtaatttcaataataaattagttcttgacattcaaaaagattctgattttgaaggtttaattaacttaattagatctcgcgatttcgataatttaatgaaagtagtttatggtttaacaaacccagatgctttttatgaatatgcatttaaaaaattagatattcaaaataataataaaccacaagctatcataatactagctaaatatcaataccaaagtgctttctcaagagatagaaacttaaatttagctgcttgtattatggaattagcaccattattgtaaggattatatatgattttatatgatttaagttctttgattcacagagctttacatactagtattaagcaaatgaatccacataaaaaagacggtaaatatattactgaagaattcataagtgggactatttttagaattatagaagaattattagaaaattatagactttatagaggtaaatataatactatggttatttgtatagatgatcatagtgttccatattggagaaaatctttatatccagattataaagctcaaagaaaaactcaaagagaagaatctgaagttaattttaaagaagtttataaacatattaatatactaattagaattctaaatgattatacaccatttaaagctattggtgtcccaggagctgaagctgatgatatcattggtgtattaactaggaagttctgcaaagcagaatctattttaattctaagtcccgataaagactttaaacaattgcataaattaggcgatataaaacaatattcagcaataactaataaatggatcattaatgatgatccagaaggttgggaaagaatacattgttgtttaggtgatgctgctgataatgtaccacgtgttgtggatttttcggaatttacacctgagtttaaagcttattatcaaggaaccgaattagatttctataagttagatgaaaacttaaaactaggtattattaataattttaatgaaatttatcctgatgttgaagtttataaaaaacaaagatttggtgaagctgctttaaataaaaagattaaagagtttggttctttagacgccttcttagattctaacgaaatatatagacttaattataatcgtaattataagttagttatggatagtgaaatacctattgatattgaattagaaatcttaaagaaatatacagaatctagtacagattttaatatggaaaatcttaataagtatttttcattttataatataactacttgtagtcaatggtttagtcaattatggaatgaaatgagtaaacctatagaaatgacaccttggaatgtggattttagtaagatctaaaatcccttcatatcttaacaaaaacagggtttaaatcaattttaaattaaaggagtgttatgatattcttaactggaggaaatggtcatttagccagtttattgggtagggtgccctagcagtacaaaagatatagatagctttgcatttgttataaattatattatagatcggaaataaatatccaaaaaaggctcagcagtgaacgtaagattacgtattattaataatcagcaagtaccagaattaccaagtttcacagattctaaagaagataacttaactacagatgttaaattagatgtcttaacacaccaagaagtagatagaaactttgctaatattattacgtggttaaaaactgttagtgataaaataattgagcaatctacagttctaaaacaattagatcccgaaaatatggagaaacttttaaaagctgctgaacaaatacaaaccattactgatgatattaaaagcttagaaactaaatacaaccaagttaataatgatttaacaaattataaaacttcaaatgatttagctttatctaagaaattagattctataaaaactataaatggaactgatatcacaggttcaggaaatgctgaaattaatataacaagaactcaattcacaaatcacttaactaatattggcattaatgaaattggcagtatagctatattagattcaaaaacaactttagtttttaataatttatatgcaggatctggtttatctacagacacttatgcatatatgcaaggtacttggaaatgtactggtaaaataagcgatactaaaggcttattcatcagagtatcgtaatcaaaaacttaagcagattttaagcatttatataatataatataataacaaataaggagatttaatggtattagaatataaccctatcaaattaggtaatagatctattaaagttcgtaattggaaagttaaagatagagaactctataaaagtaaattaaaaaatactagttccacagaagacgaacttaaagcaagatatgaatgttttgttacaaatgttttagaaaacccgacagctttaaataacgacgaattagaatatttgtttttattgttaagaattataaatcttggtgatgatttaaattacagttggtggtgcagaagttgtgaaaaaactactgattctaaaattaaattaagcaaactatttacaacaaaatcaggtaaaatccaagatattgatattggtgatatcaaaattgaactacaagatgttcaaaatatcgaactctataataacaaattaagaacttcagattcaccaagcacagatgatttgattttccatattaaatctatcaatggggataacacaaaaggcttccaagatattaaggactacttcaatgagttagatattaatataatggataagatttctgaagcatttgaaaaaatgatatttaaaattgaatctagggaacatacagtaacttgttcacgttgtggtgctagttcaacttttaatttcgatgtaataccagatattatacccccaaaatggttaaaacgttaagaaaggattaaattatgagtatgtatataacatatatagatcaaggtgcttataatatgattgtttccgcgcaaagagacaatgcttttttgttaccggggtctagcacattagaagtttttgatagtaaattatttacagcagttttggaagcattagcagataaaaaaacttgtaaattctataaagatattgatgtgttaactttagaaaacttggaaattgacgagagtgctaacttagttaagaattcatatattttccaattaacttctgcaattagtcagatttttacgagaataccacaatatacttattttagattccaatatcttaataatatatttgcttcacaaggttattttataactgatgataatcgtgaagagatgtatattaaaattcttgaaactgataatgataaattaatcgctagtcttgaagaatatcttaagattgtgaatcaattaaatcaatatgaaaaaatgtatcaagaattcttaaatggtttagatgaaatggaaatgacagatgatgaagcaactttagatcaaatcttacaagaagctttaaattattttacgaacgctcaaaagaatttcgtaactatggattataaaggatggttttcaacaattaaagcagattatgaaaatcgtcaaaattcagctcagccttcaaatcaaactaaaaataaagatctaagataacttagatctttctcactttaacatttaaatttctaaaattttaaatttctaaattcaaaaaactttaagttgttatattatataatatgaaaaaggagattaaatgattttcaaaacaagaactaaaaaagttccattctatgaattttttggtgacaccattcaaggtgaagggccaagattaaaatctgcagtatttgttagagttgctggttgtaataatacttgtaaaggttttggatgctctgcagtagctccagatggttcggtagtaacaggttgtgatactattcgtgcagtatctccaaaatttaaatcacaatggaaatactttgataatttcaaagatttaacatcaattattgacccattagtcacatttaaaaactctgaaattaaacataccaaagatattattttaactggcggtgaacctttattatattgggatactaatgttattcaagatttcttagcttattatatttcaagaaaacatcaaataacaatagagactaatgcaagtttggatattgagttctttaaagaataccaaaaagaaattatgttcagtatgtcagttaaattaagttgttcaggagaacctaaaaagaaaagaattaatataaaaacaatcagtaagattcttgaaaattgtcctaaatcttatcttaaatttgtagttaatccagaaacttgggatacggactacactgaaataaaagaaatactttatgatttacctatatatactgaagtatatctaatgcctatgggtgaaactcgtgaattacagattaagaatacaccatttgtgtttgaaaaatgtgctgagcacggatttagttttagtccaagagcacatattttagcttttgatactaaggagggtatataatgttaagtaattatgcacaatataatatattagaaacaactggtttaattattattaaatttttgttattattagttgaattaggcttctatgtgtcggctttatttttagcagttcttagcattatcagtgtgtttaaaataccaggagtattttataagttattcgtttttattgttttaggtttagcagcgtttgcttgtttaagtttaggctatactataggtttaactaatattgaatttatatttaagatttaaggagttaatatgaacttaataattggttttggtgtagtcggacaaagcttaggaaattattttgattctaaaggcattgaatataatataatagatccaagatttaatgataaagatcttaatgaaattggtttaaattgttatagcaagatttttatatgcattaatgtgttaaatgataatattgattcaaatcaagacacaaaaacattatacgaaattttaaataccatagaatcaaaagattttagtggtttagttgttattagatcaacattgttgcctagtaatgtagattttatagaatctgaatacaatttaaaatttgtaacctggccagaatttctaacagaagttgaatcattgaaacgagcaaaatatcacgtgataggcgctaataatattatgtatgctaaagaaattgctgaattaatagatacgccttatgatttttgtagtcttagagaagcaatggaagttaaatacgctagaaatgctttaggtgctttaaaggtattattctttcacgaattaaatgaagctgggttcaatgttagaaaaatagaattattattaaatgagttcgaagattttgattctcaaggattaatggctaagttatgtgtagatggtaaaaaaggttttggtggtaaatgttttcctaaagatgtccaagcactgacgtttgagtctaataaacaatctaaacaagctggagatttctttagaaatattttagaagctaataatcgacttagatattgttataaaaaatcataaatatattaaatttaaaggtgttaaatgaatatgaatgtacaaaatccaaaattttcttttactgaagatcaaacaaaacaagttcttatgacagcctatcatctaagtcaagcttcagaatatattcaagaaaccaatggtatgatgtctttaatgtttaattctatggctattgaattattagatcaagctggattatcccaagcatttttagatgaattaggatatactaaaacaactgagcctaagattcaacttaataagaaagaacaagcagaagtagactctttatttgatgagattttaaatggatctaaatctacaccaaatgtagaaactgaagttaaagattcaaaattaaagattcaaaaggaatataatggttcaacaagaattaagaaaaataatttttatattatttgatgaacgtttgctttcacaagttgtagaaatgttcgaaaaatacgaatatatcatagaaaataacccagagggtatagaaacaagaactgcgtatttaatttcgaaaatatatacaactgatgataaatctaaagttttagattatttaaaacaattgggtgaattagaagctactgatatttttccagatatcaaaatgctccaatgtaaattagctatgaattgttatgaaaacaatttaattgaatatagtaaattaatagcaacatttgataaaaatgatttggattacgcacaagcaaataacccagtagtttacaacacaccagcgttgtacagagtttctatcaatggtaaagattttgatgataatattaataatatcaataaatgtctgacttatttaggtgataaggttgtatttagacaaacaattgataaagtagatagaccaagttataaaaattatcttaagattagacattctttagaacttggtgattatgattatgggtttgatgctgttaaagcattacaagaattattttatcaagaaggtttagatgctaaaataaactctgttaattataaagaacttttaagtgattatattataataatggattttatgagtgctttccaattacttgggtataagtttaccgataaaccagaatataacaaattaaagcaaatgtttaaagatattattatagaattaagtgtagattctttattaattttagaaacttctcaagaaaatgttctcaaaattattgcagaaactaaaaaacgtcttataaatgatgtaaaatatgatgctagtgaagttgatgcttatttgggtccaattttacaaaggattaaagacagtggtaaaagatttaatagataaaaatcaagccgaagttcagttaaaaatacaagatttgcaagacatcagagtgggtataaaatatgctttgcgttgtgctaaaaagattagtttaaattctgaatctaactcaagtttagattcggatttaagccaagaagaactaaactttttagcttgtttaacttgcttacctaagaccaaaactaaaaacaaaggttaaaatggcaggtaaactaatagtagaatttagcttagatactaaatgtaacttagcttgtaaatattgttatagtgcgcatacgccaccaaaccctatgtctatagacacagctatgaaattctttgatagaattaattatatgttagattattatgataaagatagctatcatatttcatactttggtggggaacctttattaaactgggaagtgattgaagcaactttaccaaaattccaagaagatccaagatgtaccagctatgttgtgataactaatggtgcattattagaccctaaaaaagttcagttcttaaaggctcataattgtggaatttcactgagttttgatggtctatggcaaaatactaatcgaccagtggctgaaggtacttttgaaggaactttagattattttaagcaaaataaagcattaattcatagcattacagatacctgtaaagttatgatacaacccaagaacttcacaacaatgactgaaaattttgagttttttgttaacgattatgaattcttaagacccgatttttgtttagttcgtgataacatttatactaaaagtcaaatagaaacatttgctatagaagttgaaagattagcacataaagtacttgaatatcaacataaaggaataccagcaagtgtaggattatttgatttatatgctttagatattttagcaggtgctagatttggtaaaagagaccacggttgtttcgtaggaaataacggttgtttatatgcggtagatggtaaattctggccttgcgagcgatacagatcaactaataaaatggttctatatagtccagaatctggattaaatctaaagaatcttaagtttatgtctaaatacgctgacccaagaaaattcaagaaatgtatgaagtgcgaaattcgtgagtattgtaatgttgggtgtacacaccaagaaatgcgagaagctaaattcgaaggtagagaaccaatagattctgtatgtcatttatttaaacattcttttaagtgggctatgtttgtttttaagaactctactaaagaatacaaagattatctatatagaagacttgaagttggatcttgatacctttagtatatctaacactcgagtgttatttttaaaagcctttaatcaaaatttaaacaaaattaggatataattaattatggcaaatatattcgaacaatttacaaactgtctcaaagacaaagattataatgagagtttaggttttaatagctttatgttttgtagatttttagggtcaagccctagcactttacaattagctaatgatattaatatattatataaaagcttaccagatgaagcacaatataatttagtgagatacacaaaaaataaaccaaaatttataagatttgcgaaagcgttagctgaatcagaatctatcaaagaaatacaattaaaatataaggtaaataaagaagtagctaaattatatgcaagtattttagattctatgtgtaaatcttaatcaaaggagctatattagctccaataattaaaacattacactccattgaattctgaatgcaactgttgattcttttactttacctttaaaggttctcatagcaattaaatttgtaccactatacaaaccagcttcagtataaactacaccatcattagcacagttaaaagcatcttgcgcaatattaatagtataagttactacaggctctgcttgctcaataccagtaactgtaatatctactgtagagttattattagcaccatcctgaacgtttgtagcagcagtgttaaccatattaccacttggtgtaaaaattacttggttccaagttctattaatatcaccttgttcttgaccactgaaaatatcagtaacagacgcagtaaatccagtagtttcatcctttggtgttaaaatatcagaaccttggtgtcctttggtacccataacaaatctattaatagcattgctttcattgataccagcaatcaatttagcaaattcagctcttgctacatttgtaataagatttttctgttcgaatttatctataatattaccattagcatctaaactttcaatacaaaaataacctctggcaggtgttttttgaacttctttaaaattcatattagacctttatgattttttgatatatttatttagtaataaataaaacaaaaagtgaatacaatgcaaaaagatcaaattgatatatctatattaaatgcaaacaaatatttaactagccaagcaagaaaagaagcttttatctatgataaagttaaagtagaagaaaaatatgatggtattaaagtaactatagttcatatagataaaactggtgattataaacaagattttattgtttcatacaaatccaatattatatatcctgatgagtttgaatacgcagccaaatccaaaataagacctgaaagcattaataattcacaatttacatttattttcgatattcttaaaaaatgtgattcaaagagtttacctttaaattatgaattctttgtagaattcttgatgaaaaaacctacattacaacataagtataagaagatgggcgcaattttattagcttatagcccttgtacttatgaagtcaaatttgggagattattcacaaaaccaaaaggtttctatacagattcaagagaaacttatgctaagaaattaggatttgattacccaagaactatatttgaaggtaatttcgctaatttcgaacgtggtatcaaatcacaagaactcaatgatatttttagaacttataaaaatattcttaaaatagaaaacatagatttatatatacaacaaatatctgaaatgtttcttaaaatggaatctaagtatggtggtaaacctgaaggttatgttttaacttatcctggattcttattaaaaattcaacaaccttatcaagtggatcctaaagcaagagcagaaacacgttcacaatatcaaggagatcctgatactgaaaatgcttattgggctaacgttagattagcagctttaaatattattggagctagtaatattaaaggttctttaaatgaaatacttcaaaggtatggagaagctcttaagaaatataagttgaattttacacatcctaaaaagacacaatttcaaataaaagatgatattcaaggtaatatcaaaatgatcgttattaaaagacttaaaggaaataataactttttattcttaggcaagtttagaattttaactaaagctcattataatattattaaaaatggattaaaaaaatacgataatggtgtagtctgtttggtaacttcaaaagatactaaagaatttgaagatcttagattagaaatgttaaaatcttgttttcctgaaattgaaattatacaacatagtacaggaaatattattagtattatgaataaatctaaaatgaatataaatgctgttttatgtggtagtgatagatataatgactatgtaaaccaattaagagctaacccagatattcaagttgtcgaaacgcctagagatactggcgctatttctgcaactgcagtaattgagaatctaaattcagaaattttctttaaaagaaatacaccaagtgaaatacattctatgtataataaaatattaaaaagatttaaaagcttaggtttagtatcagatttgtctaaagaaccagaaaataaataacaaaaaatgacgggcaaggtttaaaatgactgagttaagattaaatgtagattctaaagatatcatagaagcgggagattataaatctacccaaagaggtatgttaacattttctaaaaatgccgtgtatttaggtgatggtaacaaagctaataaaattatagatgcagaaagcttaaaaaccgaaatagaaaaagttcaaaataatgtaaataacactataactcagcaaatacaaaatgtaaataacactataactcaagttcaaaacacacctgcagttcaatttttaaacatatgtgataatgcgactgatttagccacgttaaaatcaagtgttacattaaaaaatgtttttgataattgggtaagacattctattatgaattctgctagtggtcctaaattagatgatgatgctggtcaagcagaagctgctaaatggtcttacatagaagcagaagatgctatagcaagtaatataaattcaagttattataatatgtttttaagtaatggcgtcaaagatacttatagtgtgcaaatatcagctgtgggccaagataatgatgatgatgttttaagtattgttgtagcagctaaaatgatcaatggtaaattatatacattaagcgcagtgagatctttacaattaaacgctttaccaggtggtacttcgtggggtttattttttaattattgtggcaacaatgaagaaccttatacaacttataggttattagcttctaaaggcaatattacagataattatcctaaaacaatttggcgagcaggtaaacatttattaaaagtggctagaactaaaaatagagtacaatgttggacttcagatctaaaccaagcattggatgacaactcattaattgattatacattaccaacaacaaaacctagtgttttatccgataatgaatttaatatattgaaagaattattaaattcaccttgtcaaatgggttttggtaattggtctcaaaatattaaattttattttgattcacaatcaggtgtgtatgatgatactataatagatatatcaaacaatcaaaaatggacatataatagttctaataaaacttgggtgtcatctacgttagataactcaacaataccagaaaatgttttaattagttctaagaaaactaaaaaattgttttataataatggtattgaaatatcaagtttaaactaggatttaacacttgtcaaaccatttaattaaaactttcttaaatatggctatagctatatcagtgggtataatttgttttttaattgatttttatatgcatcatacattatcctggaaaatgttcttaatattttgtataataactatatattatgatattaaattaattcgtgatgttgttaatgaaccgtcaaatactaatataaaaacataaaatataaagactaaaaatgcaagatttaaaacctcgagaactaaaaacttatgaaatagaagaacttatagttctaaatacaaaaactgcaaaagaactcagagattctatggtagaatcaaacccaatttgtcctttatgcggttctaagatcttcaatcctgtacttgatcacaaacatagtaaaaaacaagaaaatttaggtgtgcaaggcgctggcttagtcagaaatgttatttgcagtacttgtaatattttcttaggtaaaatggaaaataattataaaagatatagaattcaaaacttggctgattttttaagaaatgctgcaaattatttggaaactgatacaacaccgtatgtatacccaagtgaagcaaaaaaattaaaagaaatttttccgaagtctttatataataaactgattaaagcaattcatttagaaactaaaaaagatattaattatattaaaaagaaaattaagtatacaaaatatcttagtcaaaaaacaaaagatttattaatatcttataatttgtattcttaaagtttaaagtataactaaagtttaaaagtttagtacataaatattaaaaaaaaaaggttaataatggggttattagaaagtataaaaaatagtattataggtgaaaaaatagatagaccattcttagaacaacctattaataaaatagatactacagttccattcggtagagtaataaacactttatctgatgatgaacctttaagattccaaaccttttttgataatgtaaatgacataacttatgttgataatctacaaaaagcatcagaacaagctcaaaaaattgatatctacagacaaactgctaagattgctgaatgttggagtggtttaacagaaattgtagacgaagtcgcatattgtagagatttcaaagatcctattaaattagaagttgatacttcgaataagaaaatagacatagcaatatctaatgcttttgaaaaaataatgaaattatttggaacccaaaaatatctacattcttttatcagacaatcttatatagacggccaaatgaatatattaattaaataccacgatgataagaaaaaaggtataaaagaattatattatttagatcctagatatctttggtatgatttaacagattctaaatacaaatacatagatataaattcttcagtagctcttaaaaataatttcttaggaaatcaaagatatatcaatatcaatggtaaagctccagttcgaatagatcaagcggctttagaatacgatatagaggaaatagttcatcaaaattttggtttattttcagattctggtatttgtttaagtgaattagaagcttccgttaaaacagctaatcaattaaaaacacttgaagatttgttaatacctttaagattttcaagatcaatttcaagacgtgtatttaatatagatttaagtgaattaccgaattctaaagcagaagcttatatgagggatttgactaataagttcaaatataaaaaacaatacaacccagaaactggtgaagtaactaataaccaacatattgtcactatggtcgaagattattggattggtaataaagctggtgctaaaggtatgcaagtagatatcttggatgaaactggtaatttaggagaacttggtgatattatgtttttttacaagttattatatagatctatgggaataccagttaatagaatctacttagatgaccaatcacaacaaccattatttgatttgcaagcagatgctatcacaaacgaggacatcaaattcttccaaaaaataactaggattcgccaagtatacacggaattctttatgcaaattctaaaaagagaattaatttgtactaaagtttgtactgaaaaacaatttcaagaacttaaagattctattaatatatactttagcgaagaaaatcaatttattgaaagaatgaatctaacattgtttatgaaacgtatagatgcattctcaacagctaaagattttggaggaacagttttacctgtagatacattatataaagaaatttttagatttaatgatgttgaaatcaaaaagaatcttaaagctattcaaaaagaatctaaaaatccattgtataaacaattttacagagattttgaaagtggggatgaattcagttcagattcagattctgattctggtgatgaacctaaatacaacgattctaataacaatgctaataatacagataccgaagaagaatatgataaaaccggtttatctattaaaaaagactcactgatttaaaactttagttacattcagaaacttttaagttattttatattataattatttcattaaaagataaaggagccataatgaataaaatagctaaagaccctaacaactatgcacacaatgttatgaacgatttaatagatcgcgttagaaatgaaaaattaatatttacattcaacggtaaaaaatattttttagatcatgtagattcttatcaacacggtgaagattttggtctattctttagagggttggattcagaatcagatcgatgttgtatggaagtacttggttgtgaactttttatattcaataagaaagattatataaatttagattcatttgaagtttatgaaggctggctatcattttaggttttaaattataatattaaaggagtttaaatgaaattaatagatggttattatgtagattctaacaacaataaatgggatgctgaattatattctgaggaccaagctaaaaaagcttcagaatctttagtaaattgtaaagactgtgttaattgttttaactgcgaagattgttatgattgtgaagactgtgaataatattgtaaaaactgtgttaattgtgtagaatgttgtggattcttagaacgagaaaatgcataattaataattttttaagttcaattatattataatatatcaaaaggagataaaatgcaaattataacagattttttaaatgaattaaatgcttcaaatagttctaattataaattagaagttcttaaaaaatataacaatgaaatcattaaagaatttctttcattggtttatgataaagtcaaatattcttacggaattaaaaaagtaccagaatttcaaaataataatgaaaccatagatttcaatacaattaaaaatacgttcatagcgttgcataatcgcgattttacagggaataaggcgattagtgttgttcagtcattacttaacaataaaacaccagaaataaccaggattattacttatattttggatagagatattcattcaggtatttcaactaaacaaatcaacaaagttcataaaaaacttataacagaatttccatatatgagatgttcattaatggataaatttaagaatattagatttccagcaatgattcaaataaaagcggatggaacttatagaacttttattaaaaaaggtgatagtgcccaagcattttcaagatctggtgaaagttatgatcaccctaaagtatattcagcattattgaatctgccagatggtgcttatattggtgaattaatttgtaatgaagttgaaggtactaattcaactgaaatcagatataaatctaatggtttacttaatagtttaacaccacctgaaaatgtaactttttatatgtgggattatttgactttagaagaatttgaaaatggaaatagtaaaacaccatataaagaaagatttgagtttgtttggagattaactgaatctttagaatctgatacattaactgttgttagaaccagagttattgacaatatagaagctgctaatgagtatttaaatacttggttaaaagaaggtgaagaaggtgctatcttaaaaaattgtgacgctgtatttaagaatggtactagtacagaacaaataaaattaaaaccagaaatagaagttgaagttcgttgtattgattttacagaaggtaatggtaagtttaaggatacttttggtgctattgtttttaaaacagatgatgaattaattcaaggtaaagtttctgggattagtgatactgaaagagctgaaatatttaaaaatagttctaagtatttaaataaagtttttacagttaaagcaacagcattgacaaaatctgaagattctgaaatatatgctttaatgcatccaagatttaatggatttagagaagataaagattatacagatactttagatagagtcaaaaatatgggattaaaattttaagaaatcaatttagaattcaactaggcaattcactagctgcttgaattctaaatacaacttcttcaattaaatacttaggtttataataaacatctacataaatgttattatcctgagtaggattattagaaatatcacaaactattttaaaatcttctatattattatctgcaacataacttctacaaatttcttttatttttgaagttaaatcatttcttgtatattcatcattattttcaaatacataatataatgcagcattttcacattctcgaactaaattgaaatatattattctatttgttaatttagatccttttaaggtattttcacttaaagcgtatataccggaatatccttttttaacaatattaatatttaaatcatataaatcttttatttgtgattctgttaaatatatatccaaatctattgtatttaagaaactataaattgttttacagtgagatactgataattcttgtgaattaattaatctggttcttaaaccaacaatatcgcctatacaattaacatatatattttgattattaaatggatttaattgtaatttagaaccatagtaaacaacagcattgtttgaaatttgtaattgtttaatatattcttcaggtttgatacctctgggtatgcctacgaaagcgcaacaatcaccacgagtatctgctaaattgatagcagaatttggactttgtgtattagcgattataaaatcaaacacataatcattagattcaccgacacttttatatgtttcatctatttgggctgcacttggtaaacttgcgtacccgttacttaatttaagactattagaaccataaaaaactgttttatctgagttaggttcatttccatcagctaagcgatttaagccatccacatagtggatattaccatcatataacttgtattttttaggatcgaaaacaatgaatatataattagaattttcattaatagtatctaccatatcctcagcttcttttaagatatatttttccattaatgtatcttttaagaacacacaaatacaatattgatttgaactcattgaattttgaatatcttttgctaaataattgctgtgtattagcatattattaagaacttcatattgtgtaaaaatacaaactgttaaatcatttccccactctcctgggtttctagcaaggattctcaagaaattattttcagaaattatacgtttacttctaaaatcatctaagttatctattctgacgtcaaagtcattaaatggatagctaatactagcattaactgaattttcaccaatagatctcgaaataactatttcattattatcatataaaaaataattataaatttgaaaccagtcatttatattatttttgtttggtttaccaaattttgttttaaaatctaatatagaataaacggatgttaaagtatctggtgaacctttatcgaaatatccagcatagaatactcttcttggttgtgaataatttgatgttgaactggtatcactatcaataaatctaacacttgggactggcatcataatccttcatataaaaatatataaaatgaatgtaactactaaaagtagtattaataaatctactattattaattgttcatattcttggccattatgtattaacatattttatactttagtgtttactaagccaactagttcagattctttagattctaaagctatgcctataaaatatttttcttcttttttgcttgggtttacacaggcataaccgtcatactcagcatataattcgtcgccggcttttacagaacctttaacaattactggtgtttgaccctttaaagctattaacacacctttacaatctttattaagaataaaccctggtttatctgaaactacacctaaaggtctattatgtttatagatgtcgaaatattcaatttctgaattttcattaatacccagaacagcaccaacttcaaactctttatcggtttcgtagacctcagctaagtcagcgtattttgcttttaaagcagttcctataaaatcttgagcgtacatagctttaaattgttgtgttgttgagccaattgtagatattaagtttaatcctggtaataatccagcttctgtggttaaccaagcttcttttttacttttacgagtttgtaattgtttagatttagaatcaacaaatacataatccgttaacaaatcatctatattagtaatgctttgttttacttcatctattaaattatctacatattttttagttgttacgtgagcgggttcagatacttctaaatctattttattatcttgtttaatatagatacctgcgagataaccatctaagaaatctttaaattgttctaaagcccatttaagatactttaagttaataacatcgtaatcgtcgttgatgggccaatctttatcattatcagttttagtaggataattatctacatctaaccaagggtataattcatttaaagtaacttttttccacatatcaggattagtatctggataatacccttgattttcgatatcactaggcaatgctaaataatatgaatttttaatggtttctacatctggattatcttctgttatataagaaactatttcacctgcttcataaattatgctagcatcccatctgatagattcttttgaagttaatattttaaattggccgattaattgattaacctctcttttgagtttattaaccgacttgtttagtgcgtctgcactagctctttggttatccataatattgaattcttgaacgaactctctaaaactagttaagttaaaattatagccttggtatctaaaatcagacattaaatctcctgcttatatttttagtatttatttttgatcagaggcttaaataatttaaatagattaattagtatttaaggttattgtataagtttcaaagcttgaagtttctactcctgtaaaattataattaatacttaatataaccctgttgaattctggttgtgaataaatgtctacactttgaactttgattctaggttcgtaaacttttagacatcttgtaatttcggtttgcatactattaatagtaatatggtcaatcatttcaaacaaataagcatataaattgcaaccaaattctggtttaccagctaaggaaccttttctagtagttaatatattaaaaatactttgttctatagctcgtttatctataactacagcattcaaagaatcattatgaaaatctttataagttgtcatttatatacctattatattattttaaggtataagccgatttaatatcgacttattaccttaattttcactatgttaatcttcagactcagttacttcaacacttaatttaacaactttttcagaaccacccttagctgtagcttttacagtaatttcagaagttcctttagttgcagcagttatagtgaatttacctgaaccttttttaactgtagcattggcattgttagactcaactgtgaaatcactagcatttgtagttacattaatatctttagtctgacccttctcaatagtttgtttatcagctggatttaaagataaagtagtttctactgacggtgattctggatcactttcttcattatcagccaagtttgcttcagttctttcagctataatagctttaacctccgcctgtgatttttcatagattgaaccatttatgtcaactttaactggatctgcagtaatatgttctaatgccataaaatacctttcataattattaattattaaatatttattttacattctaatgttatatgttttaaaactaacattaagtatatttaaaacattctaatgttatatgttttaaaactaacattaagtatatttaaaatatttgaatgtcacaatttagaatctttatctttgggagatatgttatctaataatctatcaattatactttgtattttttcatacccagcaaatgctataaaaatcgatacacctattctactcgaataagttaaatcaaaattatcagttattaaaaaagaagataacgctaaaataccagaggttgaagaggtttttataaaaagtttgaatctcgttaaaaaattggttttagatttagcagctttatctatatgcaagaattgtacagcacctataacagcacctataagtagtataggaagggagctaaacagcgcatcataaatattcaacattttactccctttaaaaaatttatgttatttattaacataaaatattgataagcaatgggttaatcaatataattaaaaaaactagctattgcatatattaatgaaaatgtaatgacaccccatatggttctattacatattttccaaacagttcttaatgaaatggtataatgttcaccaccagaacaatgatatctacctattaaaaaccatctgaaaacaaaccaataatattttagtttcttttttaaatcttctgattgaccactcattttaaaccttatttattgtcatatttttcttttaattcatcgtattcttttttaagagcttcataaagagcttcagcttttttagagccgttgacgcgaatacaataacctacagcaagaccgacaacgaatatagcaacgtaaatagcaatacttaacattgataatcctttaataattttttattatttattaaacaaaaaattggccgtaaaaatcaaataaatattacaaaaatcaggatttcaaatggctattataaaagaaacattaccttttacatatgatgaaatatatcaagatatagctaaaagattaattgaaaaaggctgggatggaggagcttatgaaggttctaatggagcaatcttagcatctgttttatcttatatcgtaagttctttgaacttcaatacagcagtaaatgttaatgagaatgttttaactttggcgaccaaacgtaaaaatgttatacaagatgctagggttttgtcttatgaaccttctcataaaaaatctacaatactcgaaataacattaagttttaccagaactggttattttaaaataccaaaatacagcacatttatcataaatggttttacttacaattatttaggcgatgatttagaattcaatatagataaaataggagctacaactacaatacaagtaaaagaaggtacattaattaaaaacgaagaatatcctgatattttaacttataaaatagatgaaaaatttgaatacatagatataccttggaatgatgtagaagatgatggtgtggaatgttatgttacttattatgatacttttggaaatttatcggataatgcaacttttgtaaaatcttcttttaatttaattgatattaaggatagtaccaataataagttctttagaaaagatgatgtggatactggcaatgctaggatatattttcaactagggactgctggtactaagttgccttctaatacgagagtttatattaatgttttaagaacttctggaatagacgcatattatgagagatgtgattcagcttccgttaacggtgatcttggctctttttgtaaaatattgacttctggtaaagatgtacctgtattagtttcccaagctcaggatgaagaaagtatagagtctattaaaacaaatgcaccaatgttttataatagtgcttcaagaacagtaactatacacgattataattcagttataaaaacacactctagtgttaaaaatgtagtgacttggggaggcgaagatgaatatccagttgctccaggtaatttgtatttttcagctgaaccccgaagaaaagaaccagaatttacaatctttaaaaaagttcaacaaagtgatggaacatatacttacaaaaaagaaaactctactttagcaaacggtgaattattgaatactactgaaatgagtaccaatcaatactacataaaagaatcttataatgatcctgacacattatatttaaatgatggtgaagttgtttctgcagaaaaagatgctaacggttataaaaacccaggtatttttgacttagtagatacatataatttaccagcacttaagaataatcttaaaaatccaacatatgttaatatagatttacaagttcttattaaacaatatccatttggtactccaaaatcagatattcgtaaaaaaatctatgcaaagattcgtgaaaaaatggcagaaattgaaaaatttgaaggtgaatttatccattctaacttagttaggcatttagacaatgaattgggtctgggtaatggtatagaagtaaatccatattttagtttattactaagtgaagaaaactgtgtaaaacaatttaaagaaaataaagactttagtaaagtaaattgtttttatgctaaatcatatgacaaattatctaagaatttagttcttagtgtttattttagtttattggctagtgtgggtgataaattagaagtttattttaataaagaaagtttgccgtttattttagacaatacagatcattatacttatgaattaacggatactgatatcaaccaatcttacaaatctttttattttaaggatgtgggatttgatgaagaatcattaaatgttagaataatatcatacgatggattgaccacctatgggggaaacgacattaatttatacaacttaaaaaataaaaccgtattttttaatgttaatataggtaatgaattatcagttattaaaatagcattgccaagatttgttagtgtaggtgatagttttaaagtttacggtttatatggttctcgcaaagcagaacaattaatatatgatttctatattactgaagagatactttcacaaggctatctacaatgtgatgatttacaaaggggtaaatatgcaggtcttgtaggagcaagtgattataaagttgtttatacttgtaatagagaatctttaaaaccaagtgatagtgaagaacctgatagcaatgggttaaaatctaatcaactattaggaactgccagtggttcttgggaatctgcagttaaccaaactgaaagtcaagataatgtttttggtgatatagaaacttctaatttatattataactggtatgaagattctgacggtcaaatagatattagagtttggataccaagctcagtaaaagccaatgatacattattaatagattatgctcaaaaaactacaagtattgttataacagacgctatgatagctcaaaggcagtttgatacaaaaatagatggtatattattagatgttacaaaaatttcatttggtagtgctgatggttctatcggtatatatcctacttacgtagaaagacaaaatgaattaacacctgtagaagatgatagaattcaatttgttgctaaacagtttgaaaatataacagaatatgcgcccacaaccacatttgatagagaagttcaattaaaatctaatgaaaaaattacattttatgttaattataataataaattcgacgtcaggaatttaattgcaaatcacgatgatgcattagattcatatacagtcagtataccggaaggttctccattaaaatacgaagcgccatacgtagtattaaataattatagaaaaacaggaacttttaattttaatttagacgttcaagtaaaacgtggtgatttattatatcaaaatcaaatagtatatgttaaagaagctgcggtagatttatcagtggatgaaggcccaggaggagcttatgtatatttagatttaccaattgaaggtatatatgataccaagggtcaaataataccagaaaatatacccacaatagaatgggctttatttgctaaagctaatcctgcagaaggtgaggataatgaacctatttgttttgaggaaatacaagaacctagcaaaacacataaagttatcccagcaaatttaacaaattatgtggcggaacaaaaaatagttgctaactatgttatagatgaagaatctgttaagactatgttaccattttatacaacagttgaagaatatattaatttggatctatctaaagttgcttatataagaatacctattaaattaatgaatagaagtgctgctacgccagaagaaggtgaacaaattgtaggttcttatacaatatttaattcaaggataccttatattagagttaaattccaaacaaaaatttttcaacctggatataattatgaatttatgttaaattatccatcacataattttaaattaataagaaattcaatatttagacttagatctgtagtttttgatgatttattggattatcaagaagttagagatagtttaagagctggtgatattgatatgagcactatgagtgtttaattatctaattaaatatattttaagttattttatgatataattatgcaaattaaaataacgaggctatgatgaagttttcagattttttagaagagcaagcaattgctaaatcaggtgattatgattttgggaatttaaactatataggcgctggaggtttgatatcaaagaaagttgtgaaagttctccataagttcaattttgatataaatggtgataatacagaattattcattattgaatgtaatgctaaccatcctaaacaaaaatattattgtgtagctaaagaagaaatagataaaagatttgaaccttatacaacaagatttaagatattagctgctatacttttggaatatacaacaaaatacagaggtttaggttatggtcctcttagaatagttaaaggtgtcgaaactttaagatcatacagaggtggtgggataggtaaaaaattatatactattttagtggatgattttaaatgggtattgatgggtgattctgaacaatatgaaggtgcaagaaacttatggactttcttgtctaaatcacctgggtttaacgttgatatagttgagttagcaacaggtaaaattattgctaaaaatgttaaattaaaagatgctttagatccaagaatttggaccgatgaagatttatttttaacaggaactaaagaagaaagaatacgtggtagatttaatagattggtattaactaaagttacaaattaaaggagctaaattgaagttttcagattttttagaagagcaagcaattgctaaatcaggtgattatgattttgggaatttaaactatattaataagtatggtctgacttcgatagaatatacatttgataaatcaccttttgtatataaagtttattataatggtaaagaatattttttttatcgtagagaatcttaccatattttagctactaaagtacctgaagattacccgactaaagataaccctaatggtaccaaagatagatttagtcctatagctatgattagattattgcctacagataaaattaaaagaatggattataaaaatgtttatacagttagtgctgtagaagttgatagagaccatagaggtatcagattaggcaaattattatattatctagcaactaccgttcttaaatatactttattaggtgattctgaacaatatgaaaatgctaggagaatatattattcttttagtaataacccaggatttacagtggatataattaaattagatcaaggtatcttagcaaagaatgtaaatctaaatgatcacaacgatgaaagagtttggagtacaacacccgataaagtaggaactttacatagagtggttcttaaaagtgttcatatggaatctaaggtagaagtcaaaaaattaaaataatttaatttaagactaagaaccaaataaatatactaaaagcataattaaaggtttgctgtgtttaaaagtatagctaaaaacttagtaccagaaaattacaaatctaataaatttattatggacgtccttgacgtttttgtagattatatctatgataattcaagcctagcgattgacatcaataatttatataattctaaaaatgaagttctatatgaagaaattattaaaacatatgctgcaaacttttataagactataaccgatggttcaaaaaatcataaacttgcagaagctgttagaaaagcgcacaaaaaatatggttttgattttagtgaaacgcaattagatataaatgtaatacacttattatcacaagaacaattagaattatttaaaaactttcaacaatctaaaggaactttaagatctattgagtttatatatcgtattatagaacaattaaatattgaaagttttgtattagaaaccgacggtcaattaacaatagagcccggtgaaaatatatttgaataccgcgtttacggatctatgttaccagaaatattcgaagcatttgttaagcctttagcacatccagtaggttggacttacttatttacaagaacttacgttcttaaattcgaagattatttcttatgcaaagaagtttacgatgtaaatgtttttagagtaacttgtgaagattctgattgtgaagataattttaaaacaaataccggatatctttttgaaactgacattaataataatataatatatgaaaataataaaccaaaaatgtataaagctgatggaaatccagtatttaatgttacaagatttggtgtcaattacccagaattaacattagaatctgaattaaaattagttaaagatcctactattagaactattgaaaaatccagcataaaaggtaatgacaaattaattgtatattttgaatctggtgaaagattagaacaaaattcaaaccctaagaatttaatattatattattataaaggtattaattcattaaatcaagaaattaaaaaagattatactgatttcttaagcaaatgtgctttggaacttaattatgttagaagagttgtaaccacagttaaagacaaatatcaatttcaagtagattttggtttagctagcactactggtaaatttgcagctattggcgctggtaatatgtatctaggttcagatacttgggttcttggtaaaaatagaatcaatgcaaatacaccagtaacttatggaactagagttcgtaataaagttttacaaacttctgactttaaagcattatataagaaaaatgataattctattagacaggtatttgataaagtttattctggttttgatgatcacgtaaaatcaagtacttgtaattttattttagaatctgacaatttatatcattatagattatataatccaaatgcaatattttttgaattaattaatacttacgggtatagagttcgcgctaaaataaaatataacgaagattcattagaagttatagctgaagatgaacttaaaaatacacaattattatatatagataaaacattattcagtaaatacaattcacaagtttacaaagattttaaagaatctatgaataagcctttaggtcaatattatacagtccttaaaaaaggtgttaattacttgaatattgtagattctaatggttatatagttaaaggtaattataggcttgtagattctgaatataggctttatttaaatataaaagatcctgtaactattcaatttattgatgatacttatgaatacgattcaagaccatttcaaattattgatgccgaattaagttataataaagattctaaattatatgaatatactacaccagaaaaagaatactattttgtcagcgtagctaatcgtattagcaatgtagatttggacattatgtatattgctggtttacaaaaaggttttaaaataacttcaagcactgctcaaaaaataagagtatatgttatagataatacttctaaaagatttccgataactatactgagtgcaactaatgaaactatacaagcaaaagaaaatagtatattcttaggtttaatcaatgctgataaccaatacgttgaaggacaaatagtttacgattctgaaggtaaattagcaacattagattgtaatgcaaaaacaaataatttaagtttattatacttagattattctgcaagtattaaaaatccaataactattaaatctacaacatttgatattgctggaaatttttcagaagttaatgataaaagaggtaaattcctttataattttagaatcgaaaatattatgattgttaatatattcgataaaaataatcaaagaatacaattagactatgatattgaaaatactggggtatctttttatactgatacaaatgaagctattacaatacaatactttgataatatagatgaaggtataccaagaacatatacaatagatgctgaatttaaattagatactagttacattaattataacgcaaaaatatttaaatataaagatatattattaaatatggatactagtacaaacaaatatgtttataagcacaacgaaatgaaaacttatcctttagttgttatggatactgatggaaatgttttagacgttgaaataggtattttaactactggatttaaaatatcttattctgaaggtataaaagtaagaatatattatttagatgatactaaaaatagggctgatgttacttataataaagctggagacccggactccacaaaattattatatgctgttaaaaatggtgtcatagttaaacaagatatcaatacagtgtctactgaagatttttattcattttcaagattaaaaactcttaaaattaagaaagctgatttaaaagctgtggaaagtaacgacccagattcaaaactaggtaaatataaatttattaaaaatattgaatatggtttgccagttatggccggttttaacaatgatttaaaattcaaagttaatgaagattctataacaatttacacagcaactaaaaaagatattaatattagatacgcagaaaaagttaacgaagaaagtttcttatatacttatagtataagaaaagatgatgatttatttatagatgcgcaaaaagattctataaaatatttaatagattatcaatatgattatttaaataatagaattatttttacaaaagaagacgatgatattgtcaaattgtttttcttaaagaataaacacaataagaaaacaatacttagtattaataacgcaaactttgaggatgttgattttccaattaaaatttatttaaatgacgactttgttgagtttgaaaataaggaatctatgcaattagatgttaatccattagatcttaaattcaatcaagatattaaaaatagaaattcaacaattagagctattaataaagatcttgaagtattggaacaaatagattttaatttggcaccacaatatacctttaaagcacttggtgattatctctatgagatagattttaataagattaaattcaaagaaaataaacttaatgaagaatccttgtggtatagagaaagttcagtttatcataatcattatgtaggatattttgcagctaataatgttcagccaactcaggtatttactggtacgtcgaacaaattagattatgaactcagagaaacaaacccttggggattaacagccatagatacatttgaattaacaggaactgctacaaatgatggatttgatgttaattttgaatttattgattcttggccaaaaatcacagaagtctataaaaatgattatacaggattctatcaaaataaatggggttggcaatcgggatatgttgacgtttataaaactactagggatcttgaaagatttaatgaaaaatacgaaagattagaacacgccagcgtataccaaatggatgattatattgttataggatctaatgatataacaaaagattatatgtttaaatggtatccaactagtaagtcaaatgattttagtgatagtttcttaagaaatggtcaagtctctgaaccagtggcacctaataaaatatatactggaaaatatgatagagaacccgacaatataattaataaaacaaatacttgattataaaggatttagatggctgatattattcaaaataaaatgaatcaagtgatgggtgatttagctcgccccactaagtttaaatgtcaaatatttccacctaaagaaattaagtgtgaattaagtattttaaatgaaggagcttctgcaacatccagtacttctgaaataggacaatatttagactatttttgtcacgctacaagttttccgggattgactgtagaaacaatagattttaaatatagaggtagaaccctaccagtcaaatcagtacaaacttatcaacaaaaatggacagcaactttttataatgatgaaaaacacgcagttagaaagttatttttagattggatgacttatgatcaagctcaccaatttgaggataaaactaaaggtaattttgaaggtatattaccaagcatttctatatatcaattagattttgaaatgtctaaagattgtgttgtgtatactatgatgaatgtatttccaacaaatgtaggagaaatttcagttcaatacgacgggttaaatcaaattgaaacttttacagttgagtttgcatatactcattttgaaattaatacaatttctagggaagggttaactagttctgaagtcacgagtttgatcaagaatactatacagaatactattaatagtgttaccaatactttaaaggatgctgtttttggcgctttggacgacctagtttcacctgtattggattctgtttcagattcatttgaaaattttataagtacaaaataaggttttttattatataatatatttttgatctttttaaattgtgttgttacgaactttttttgagtttttacagtttatactatagtattaaatctaaaacttaaaagcaatattaaaaagtataaaaaatgcttgagtttttacagtttatactatagtattaaatctaaaacttaaagcaatattaaaaagtataaaaaatgcttgagtttttacagtttatactatagtattaaatctaaaacttaaagcaatattaaaaagtataaaaaatgcttgagtttttacagtttatactatagtattaaatctaaaacttaaagcaatattaaaaagtataaaaaatgcttgagtttttacagtttatactatagtattaaatctaaaacttaaagcaatattaaaaagtataaaaaatgcttgagtttttacagtttatactataatatatgtaatttaagtttactttaagtttaaatatgcaagactaaagcttaataaatacttaaaaatgaagttcaaacaaggcatttatataccaaaaaacccagagaaatatatacatagttatacaaaaatgaatgaacacactgaatatcctgtttataggagttcttgggagcttagtttcttcaaattttgtgattattcaccctctattactaaatggtcttctgagccagtcggtataaagtactttaatcccgtcaaaaaacgacaatccacatattatcccgatgctatgattattcgtaacgatataacatttttaatagagattaagcctaaatctcaattaccaggttctaactcaaaatccagttatgataaactttcagcggcagttaacgaagccaagtataatgccgcaaaatcttattgtgaagcaaacaatatgcaattcataatcttaagtgattctttctttaaatcttgattttaaagttttaagctttttttggttttaaaacttaagttttttaagtttagtatttaaaaaatttttgcacttttaatatgatatattataatataaaaacttttttcaaaaattttagtagttttacagttgtttagaatttgttttaaaatctaaactagaatttgttttaaaatctaaactaaagtttcagtttaaaacttaaagcaatattaaaaagtataaaaaatgcttggctttttagtagtatatactatagtataatatctaaagcttaaagcaatattaaaaagtataaaaaatgcttggctttttagtagtatatactaatgctatatatcctatatatgtctaaaacttaaagcaatattaaaaagtataaaaaatgcttggctttttagtagtatataacaatgctatatatcctagcatatgcttaaatcttaaactaatattaaaaagtataaaaaatgcttggctttttagcagtatatactaatgctatatatcctagtatatgcttaaatcttaaagcaatattaaaaagtataaaaaatgcttggctttttagcagtatataacaatgctatatatcctagcatatgcttaaatcttaaactaatattaaaaagtataaaaaatgcttggctttttagcagtatatactaatgctatatatcctagcatatgcttaaatcttaaactaatattaaaaagtataaaaaatgcttggctttttgttagatcaacacagaagactgcaaatatttaaaccattctaataaatttaagaattttttaagcttatatattatataatataccaattgaaaggaaaataatgaaactgacttacaaacacaaattgtataccaaacatcaagatattattaacacatatctgcgtttaaaagtagagtttaatttattcaagctggattacaaacgacttagatattcaagtttattcacacaaaatacaagacttaaaactcaaaaacaaatagaagagcttgaaacgaaactaaccaaaaaaggtctcaatacacaaaaattacgcaagttatacactaaaattgttaacaaaaaacctttcaatgattttgaacaaatcatcattaataattttgtagaaaatggcaaaaaagcaccacaattattcaaacacgaacgtaaattcgataatagatttacaagcctactattagaacgtaaaaaacgtcgcgctaaagcagctaaagaagtatacacaagaagaccattatctccagaaaaacaaaaagctcagcaattagttccatatatttttcaattcattaaactcagaactatggaaaaatttggatataatgaagatttagcagttgaaataactggcagaatttttggacctgggtgtgaagaagctcttgatatgtatttaaaagaattcagagatttgtatggtaatacagaccaagctttagagcatttcaaaaaagctgaactattagctaattaaaaatatatttaatttatatttaatattaaaactaaagtttaaaatctaaaggtggtaaaatgagtgaaactcgtatgaaacacgattatactaacgaacttgaactaaaatcgctagctattcgtgaaaaaaacttcaaattaaatctaggctctgaagatcctgatggttctataaatgaagacttagacattaagataaaagaatatattaaaacaaaagatccagatcttaaagactatattattagtatatccgagggtgtaaaaatatcaccaaaatctcacgaatattttggtaacattgttattctaatgattaaaaaaatattaactaaacctaatttttccgggtatacttggcaagatgatttttatagtgatgcttgctatcgtgtatttaaatatattcataacttcgatcatacattaaaatctaaaattacaaaccaatcagtatcttgttttagttatatttcacaaataattcataatagtattttagctattatcaatgagaaaaacaaaaaagataaagaacttgaaaacttagcttgtatgtataattctgaatatgatatacataatgaatctaggaatgcttcaactatagatattgttaatgaattatatgtagattacacaatacccaattttaatttaaaaatgattgaaaatattttagataccactgaaatcaaatacaaaaatattaatattagatacaatgaaggttttatatcatttgatgattacgctgaacttaaaaacgttctaagtaattataaacattttaatgtaaatctaactaaaggtgattcaaaatgaatattagccaagatttaatagcaaaggaaattaaaacattaaataaattctacaagtttttaagagagcataaaaatgaatgtgttatggaaataatgcaagatttttgtgatttaaatgatatccctttagaagaacttggttttttgatatcagaggatgcatacttaaaagattatatagaagcaaatcttattaaatataaattctataaaagtcctaaaaaaactgtttttagtgatgatttttaattttatgtatataagcaatatcataaattacacgaagtgttaaaattgatatttgcttcgattctgccaatactaaatactactaatactactaacactactaacactacaaaaaataagcttaaaacaaaattaaaccgattttaataaatataaaaaaattcaaagaaaggtacctaaatgttagacaaagttttaagcaacgatagctttaaagatgttctaacagaatcagttaaatcagaaattgaatctgtgtttaatgaagctgttgaaattaaagctgttgaaatagctaatgaacaaatcgaactcgaaaaaatcaagttagtagaagagttcaaagaagctaaaaaagaacttgaatctaaaattactgaaaatatagattcattcattaatgaagaactttataaatttaaagacgaagttcttgaaaaattagacgctgttgttgagaatgaaaaggctgctactctagtaagtatatttgataacttagtagatgttgctggatcaaacatactcgaaaattatgcaaacaaagattctgaattaagtgatcaatttgataaattagttgttgaaaatagagaacttaaagctgaacttgcgattcttcaagaatctaaaaaaattgatgaattagctgctaatttaaatcttgtagaaagtgaaaaatttaaaaaattagctagcttggtagaacgaggtgaaggttttgaatctaaattagaagcgttatttgaagcttgtaaaaaaacaaacgaagatgattctgatggattctgatgattctgatgattcaaaggattcaaaggattcaaaggattcaaaggattcaaaggatatcaaagaaagttttaaaaacaaagcaggcgctgacattaactgggctaactactaagttcaactaacaagctcagttaaaattcagttaaaaaataaatatataaaaaattaaaaggttaaaaacaatggataaaaatgtaagtcttaatgaaaaagtagagtcttatattaaagattcaaaatacgctgctttaaatgaaagtgaagctgtattgatgagtacattgctcagcaacactgctttagcatctcaaggtgcacttgtaggtgaaagtgttatctctagtgatatcgctcaatttacaccaatcttaatgccaattgtaagaagggtttacccagcattagttgctaatcaacttttaggtattcaacctttaacaatgcctacaggttacatttatgcattagtcaatagatatacaggtaataaaaaagacggtgctatatctccagtttctaaagctcaaattcttgtgtttgaagctaatgtgactaaaggtgatactgttacaggtacaacttcaagtgcgacaggtaaaattatacacgttgaaaaagatggtaaaactgctttagttcagttaactagcgataaaaaattccaaaacgaagctgctaataaaggaactaaaatcgttaacgtttattctaacgaagctactttccataaaatcttagaaacttattcaggaccatatagtacagctgacggtgaaaaacttgctgaagatatgaacactgtaggttttggaattgaaaaagatactgttgaggcaaaaacaagaaaacttaaagctgaatatactttagaaatgtatgaagatttaaaaaatcaacacggtgtgcttgcagatggacatttagctaatcttattgctgctgaaatgcaaactgaaatagatcgtgagattatcaatttcgtaaacaatacagctaccgttgtcgctgatactttaagtccaggtgctgaacacaaagaagctggtagatgggaaattgaaagatatagatgtaatgctatcaaaatagatttagaagcaagaaacatcgggttaatgacaagacgcggttcaggtaatacattgcttgtatctccaaaagttgctactatgttagatcaaatcggtacatttaaatttgcttctagttcaagcaatatagctactgatgtatttactggtgatgtagggacttatgatggtagatataatgtaattgttgatcaatatgctaaatctgattatatcactgttctttataagggtacaaccgctcaagatagtctcggattcttctgtccatatgtaccattaagcttccaaaaagtaatgaatcaagaatcaggacaaccaggtatgattgcaagaacaagatatggcttagctactaatccacttgaaccagaaaattacgcaagaacattcggtgtagatttaacaggaactattttagcttaattgcttcaataatttggggatgttaaatccccaatctaatttttaatacataaactgaaaaaactcttaaaattcaatttttaaatccttaaataaataataagattccaatatactttagtcgttttagcctaaaggcatcgaaattggtttaagagctcaacaacgaagcttgatgcagttcgagagactttttgtaatatcaaatcatattaaaaggattaaaatggcaaatttacttagccctggtatccaggtttctgaagtagatcaatctcaaattacgcctgttgaaggtgactctgctgccgtttttggtggtgattttgagaaaggaccagttggtgtacatactttaatctcaagtgttcaagaactcagagataattacggtatgcctaatacaaagaattataatgattattatcaagttcaaaatttcttagcttacagtggtgcaatttatgtttctcgtgcagcagacatcaatggtacacccacacaattagatggcttacaatttgaagaaaatgcatataaaacaaatgttaacgctagtaaaatcgaaggtgttaaagttatcgaagctgactctgtagacgttaaattcgaaaaaactgataaattcgaagttggacaagttcttaaattcaacgattctaataaagaatataaaattaaatatgttagaaatgaagttaagcaaataccaaatccagattatcaaccattaactcaattagtagtggacccaagtcaagtaagtgcttatgttgatgaagttgttagctacgtaataacaaccgatgcagaatcttatactgtagaaacagatagacctgatgtggttcttgttaacaaatctaataaatctttgactgcattaaaagtagggactgctattgtaacttttaaagctaccaaagaaggttcgagaactaattcatttgaattaaaattcgacgttcaagaaaaagaacaaacaaaactgccgtaagatgcagatccaagtggtagagctaaccaaaaatctaaagctaagaaaggataataaatggcagatatctacgatataccagagtttataactcaagaagtaactattgttactttagacaaagaaccaggtgaactaaatgcagacacttcagtatacttaatggaaggtgaatctcaaccagattctaattatattttaagtcttagaggtgctaacactgaattaaaacgcggagatattatagcattttctgatgttttaactgatccaagattcagaatcttagcaatctctgacagtatagtcaatggtgaagctttcacaaatattacttatgaaggaactgaggattctgaagctattgttgaagcaactaaaggttttccagtttatttagttaaggctactaaatcgtcttgtgttgaagttcctgtagaaggttctgaaaccaaatacgatgcgtcagaatatgaactttatgatcataccattagtaacttcaatacatttgatgaagataaattatctaaaccatttgtttataaagatgcaaaattaaaaatatttgctaaaacaccgggagagtggggcaataaaattgatgtcgcaatcgcacaccctgatgatttcaacaaaggaaaatatatcactgatggtataccattagattctcaatttgattatattccttatggtgatcaatttgctgttattgttatctacgcaaacgaaattcaagaatcatttattgtaagcttaggcttaactgataaaaatgagaaaaatgaatttacttatatagaaacaatgattaatggcaagtcaagctatatcttagtttctgtaaatgaagcagttcaaggtaaaccaaaaacttgtttaggtgaagatttacttaaacttgaaaatggtatggattcagctccaggtattggcgatattatagacgcttatacaatttttgacaacaaagaagaaatcgatgttgatatcttaatttgtaacgaaacttatccaaaagcagctactgatattgcgattactcgtggtgactgtatagcatttatgggtgcaccaaaaagttgttcagtgggttataaatctacaattgctaatcaaaaaacacttgattttagaaaatctttaaatatagattctaaatatgtaactttgtgtagcaattacaaatatcaatactgtgctgagcttggtggttacagatggctgaacttagctgcagatattgcaggtcttaaagctcaaacaaattataatcaagctaactggtatgcagctgctggtcttaacagaggtctcattaaaaactgcgaggcgttggcatatagcccaactggtgcgatgcgagatttctatacaagaatggtataaatccagtagttatgtttccaaacactggtgcagttctttggggtcaaaaaacattacaaactaaagcttcaagcttcgatcgtgtaaacgttgttagcttgtttaaccatttggaaagatctttagggcgtatgtcgaagtatagtctatttgagttcaatgatagttttacaagaaattaccttgtaagtattatcaaacctttcttggcgcaagtaaaagctggccgcgggatccaagactaccttgtgatatgtgacgcatcaaacaatccagcaagtgtagttgcagcgaaccaactcgtcatagacgtatatattaagccgacttatgttgcagagttcattcatctcagattcacgaatgtcggttcaaacgacttcagcattgttgtaagctaaacccaaggttcaatttacaaaagattcaaggattttacgatccttggatccactgaaacttcatatttccacaatcgtatattattctataaccatttagcatcatattagcactttctgaaagactaggatcgaaaatctctaacttttcttttagcttatgtttttgaaattgatgtctagccagcaattttaaatctttgaaataaaaataattaggctcagtattctctacgaacttaaaacctaaggttttatatattgaccctttactaaatcttctattagcataacttactatactttttggtttataattgtctaagaaatacttaaataatttagaagctcctcctataaccgaacaatattttaaagtgcataatcttattaattcatattcatagtttttattaaatctaggcttaccaaatgtcataacttctactaattcgttattataaaataaacctaaattaatttttgaaactgtcgatttctgtaaatgattctcatttaaaaagtcaactacttcattataacttaattcttttataatacattttctagcataaatttttttatttaaacctagtttgttattaatcatagaaaaccatatatctaaatcatcagattcaaaaatatgaaataattgtatctccaaagcttcacacatttctgtcttttttaaatgatattttttatcataatcaggtgtattaaacattctatgtttatgtaaacctctactgtgaaaaaataaaccatcgtattcaattgctaagttataatcaggcaaaaatatatctaattcatccacactcataaccataacgttccaaattagtttgttttctttgatcagcgattctttgtatttcttcatcggatttagaatcccaggttttacgaacggattctttaaattcctttgtttgagaattacagataactccaaacttttttagatttgtttcaattgttttatttttaacaacttcactttgtgtcgcatattcagtattatatttacttaaattggtttcttttcttttattgtttatttcggtataatctgtattggctttggtgtttctaattttatcatttacttctggtatctgtgatacgttttctacattgtatttttcttttattgtttctttatgtttatctatattattgtagttagcatcaccatatctttctaattttgtagatttgattttagctatgcgtattttgttaaaatctggtgattttagacattctttacaatattgtgtccttgtcttagttccacaaattacacaaaaattaggattgttttgtaaatccttgtagtctttgtatattgaatgaaattccccattatatttagggtcttttaatagaatatcaataatttgttttctataaagtggatactgttttaattcaatgagtatttctttgaaagttttgtttagatctatcgttatatttttataagttactttcatttaaatcctatttttaaataatattattatataatattaaaacttaaaaatatattaaaatttttagatatattttaaaatattaagtaagttttaagctttaatatattataattacaaaaaggagataacaatgttgaacttaaaagatttaaatcacaaatatattgatgctttatatcgatgtttgaatggcactgaaaatacaccaaacaaataccacttagaaccgaacgttggtatacacaccgaaatggttatggccaaagtcaacgaattatataaagatgatcctgattataaagtattaatattaggagcagctttacacgatattggtaaaataataactagaacaccatctaaaaataacccagaaaaaatacattttttaaatcacgaaaatgctggtgtgttctttgcattagatgttttacacgatttggatttaaatctaaccaaacaagaaataatagatataattaaaatagtagcccatcacgacatttataaattcgatttagaaacacttaaaaaacgttatgtttatagagatttaaaattattatccaagttttcagttgctgatgctttaggtagaatcactgaagttccaaaagaacttcccgatttaaatattgaagcttatgatagatctaatgttgccaatgaaccagttttagaagtattagtaggattaccaggttctggtaaatcaacttatgtttatatgaatgataaagcagctatatcaagagacgatattttaatgagatacggttttaaaaaatacaatcaagttgaatattcagatatttggagaaacttaacagattctgatcaaaaagaaatcgattctttatttaatgataagtttttaagagcacttcaaaagaatcaaaatattttaatagataaaacgaatacttcgattaaatcgaggcgtagattatttgctacttcgagcttggttagaaattatcataagaaagcagtagtatttttaacaccatatacaatgatattaaatagacttgaaaaaagaaatgctacaggtaaaataattaataaaagtgttgtggatgctatgatgaaatcttttgtaatacctacttatgaagagttcgattcaatagagtttagactttggttctaaacttaaaagcttaaattttaaaataatttaaactagagttttagtttttaacataagattcatagaactttaagttcaattataatataataaacaaaaaggagttatatgcttgtttctcacgaagttccgttaagtcttttagaaaaatcaagaacgtttaatgattatgattatgctttagttcatttatttgaaatctacccagaatacaaacaattttacatagattcattaaaaaagcgtagaacagtttatttagataattctttatttgaattaggaacattatacgatcacgataagtttgctaaagaagcaaatgaattaggttctatcaatcctagtaatttctattatatagtccctgatgctttaggcaatgctagtgcaacaatacaatcttttagagacttttctaagtttagtatacctggtaagaaaataggcgttgttcaaggtaatactttagaagaattaacagattgctttaagtttatgaaagaaaatgcagatatggtagctatttgtttttcaggagactacttctatgaatacgaaggtgatactaaagaagctaaattaacacaagcaaggatagattttataaaacatttagataaattaaatctattaaaagattctaaaatacatttattgggttgtcaagttcctcaagaatttaaaaattataagaacattccagagattgtatctttagatacttctaacccaattgttcacggtatatataatgtaagatattctaaagatggtttaagaactaaaataagtactaaattagtagatcttatagattataaaggttccgccaatactattttattaaatattatggattttagaactattaatggcctttgatatggtttaaatagccaaaattaggttttaaaggggtttaaatgaaaataggatttacaggagtttcaggttctggaaagacgactatagccaaattattaaaagaacgatataatttggatattattccagggcctggaagaaaattaaaagaattgggttttaatataaatgaagatggtgatatggaaactcaaaaagcagctttgcaaattcatatagaagatcttaacaaagatggtatatacgaaagaacaatattagatgctgtagtttatactaagtatttagtagagattaaaaaatcaatacctgatgtatttttagatttagctgaaatagtttctattgaattaatgaaaaaatatgatatagttttttatattaaaccagaatttgatttagttccggatggtgtcagatctactgatttagaatttagaaatatttgtagtaattactacgattactatatagatacctacggtattaatgtagttaatttaagtggttctgtagacgaaagatttaaagcagctgtcaaaattatcgacaaaagatttgaaaatttaaggaacttttaaggatacttagtatataattataaatataaataaattagatcttttaaatatcattgttaaacagatttagaatataaccaaaattgtgagcatttcggatttcctgacagagaaaatcatcatagtgtgctcctttttctttagattgcaatgtaacttaattgaaagattaaaaaatttaaaaagtttaaaaatctgaacagagagatgctcacaattttggttatattttagttttaaattctaaacttagaatgttagaactataaagacttttatgtgcagaacatcatacatacttcttatttaatcgggaatttgttagtataaacttagcacaccggaagtctttatagttctaatcaatgttcagaatagtctctaccttgctaagataagcgaactgtggatacttctataatatttttatgaaggactgggaggtagaacactaccacaaactcaagacattctttagaactcgtatatcttttctatccttatatttttgaaggaccattacttgctcctatcagaagatttcacactatagtgtaaagtttaacactatagtgtcgtattttaattttagaacttaaaataatcttaaaccataaaaatcatcaaaataataaataaaacaaaagcaaaggaatggtttaacagttatgtctaacaaaattgaagaaattaaaaacgcactaaaatctggtgcaaaagctacaaaataccgtgttaaactttcatttccaacagaagtgcaacataaaatggaattacaaagcttgaactgcttagctaaagctactagttttccaggtgtaactattggacaaattgaagtatttaaccaaggaagaaagcttcctatacctggtgatacttcgtatgatacacaatggactgtgacattttatatggataatgcacaccaaactcgtaaagacttcttaagttggatgaaagcttgtgataacttccaagcaaatacacattctggtaatccaggaggtttatttacagaagtttcggtttgtcaattagattcattagaaaatgaagttgctgaatatactttaagaaactgctggccaagtggtgttggtgaaattagtgttggtgctgatcaattagatacattacaagaatgtgatatcacatttagcttctcagattggattatttctaatggatctgaatttaatatgccacaagatggtaaatcagctgctactaacgtagtttctgtagaccaataattcttaagagtctggaaatccagactcataaatacttcaaaacagtcagaaaatggatagtttaaagttagttaaaaatcttattaaaaccaaatcggttgaaaaaggacaaattttaaaacctggtaatttagtaatttttaaatataatcctaaagataccagtgttaaatatgatagaactccattgtgcctggtactcagaaaatctaaatcttataccttaggtataaattttcactggtgcccgataccaatgagaaaaatgcttttaaatgccatatttcgactaaataaaaagaatattaaagagaataaaccattagatatagattggtatagaattaagcctatgctcaaaaagtttggattttttccaataataagactttatattaatagcagaatatatagaagagcagtcaaaatacctaatgaaaatatgaaacaaattatagaaactaaaacagaaacttttataggtgtttctgcagaagctttgtataagaaagcgcttagggattcaaaagtttcaagtaaatctaaaaaatgaaacattttttaatttaaagcttataagattataatattataaacaatctaaactaaagttcaaagcttttaaaacacaaagctcataaataaaatcaaaagacaaaaggctccaatgaaaacttatgtcgttgataccaacatcattttagatgatgtaaataatctctcacgtttatacgatagtgaaaatcgtattataatccccgaaacagttattgatgaattagatgctaaaaaatcattattcgatgaagttggataccaagcccgtaattttgcaagacttttatcaaatcttgatgtcattgaacttaataaattcaatgactatactgagacaacactgggtgattctcttttaaaagtaactattactagtaaaaaagaatataaacacgcagatgaacctattaatattctaaatgatagaaaaattatagaagttgctaagttatatccagattgtatttttataacatatgatagtatgtgcaagataagagctatatctgaaggggtaaaaactgagacattcggtttaaaaaaagattttaatgaagttccagagttttttaaagttctcgatgttgagaaattaccagaaaatcttagcagcattttaagtgtagatccagattataaacacgaaaattataactacttaatacagagtaaagatggtaataaaaaactagcaaggatacaaaatcacagaattaattacatagacgaaaaacacttggaaaaacaagatgtcaaacctattaatatccgtcaaaaatatttcgtggatgctatgctagatactaatgtagatttacaagttgtttctgcagtttcaggatcaggtaaaagcttattagctattgcgactggtatcagattagttaaagaaaaacaatatagtaaaattgtttatatacgtaactcaattgaatctttagataaaggtgaagatattggatatcttgctggaaatgacgaaaagtttgcggtttttaatcacccactatatgattctttagaatatattgttagaaaaagacttgaaaaatctaatgataataaatcaagaaaagttaaaattgataatttaaaaatacaagaaggtattaaagaaattattgagttatctggtatcgaaactatgtggattggtgctttgcgtggtagaacaatttcggatgcgtttgttattgtggatgaataatccagaaattattaaaaattataacaatttaaaaatttgaaatctaaaaccatattataacaaaacataaaacaacaaaatatctctactaagtcaatgagcaccatattaacaagagttgacaaggattgtaaagttataataattggttcaaactcacaaatagacaatcaatatattaataagtataacaacgctttaacagttcttcaaaatgcagttaaaaatcctagcataattaatacttggggtggtgagttaattaatgtggttcgtggacctataactgagtttgctgaacaaatttttaataaagattcaaaacaagaaccagagactatgaaatcttttgtagattctggtattagcacacttgaagtgaatacaaatactgagaacttagaaataaaattagactctgctagctaatttaatattattttaagtttattactatataattacattgataaattaaatcaaaggagattaaaatgaaatttgaaatgatgataattaacgcagatgagttaaaaggcgttacagcagatgaagcttttgtaatttatgaaaacttgtataatacagagcaagaaaaattcataaatagttttttaaaaaatactgacaagatagaaattgtagaaaaaatactagaaaattgttccaaagaagaaaaagaagaaattaaaaaattgttagaagattaaaaatgaaaattggtttgataaagatggaaagaagattaaaagattttgattttagatttagtatatagattataatattggaaagaagtatattaatacataatttgtaataaataagtttattataaggttaatctgttataattatgtataaaattaaactattaaaaagggtaacaaatgacgtttacgaaatttattaatgaagccattattaatgaagctgctattgatgatatgctcaaggagattaatgtagccaataacaaatcaggtctggccttcaaaaaagattataaagatatagaatcgcttgggaagaaagctttaaaaattctacacaagcttgctgatggtccgcatagcaacaaacaatattataaactttataatgacttactgaacgaagtatggaatataaatcaatatctacttagctataaagacaagatgccttggtatagagaggaactccaatcacaagaattgaaaagatacaaagaaatcatcaaagattatatagatgaaatcaagcaagctatgaaagagttaaaatccgattatgtttctgtttctcacattagtaatagaaatctggaagctatcataaaatctattatagacgaatataaaagattatataaaatagttgaaaaaatggcaagacaagccaataaagccaataagtaaaattattagaaaataaacttattggagaactttatcgtattacaagagtaggttgcttatgaaacgttaaaaaattaaaagaatcgttagaaaggaggtaacaaatgaaactacaagattttgattttagagtttgggataagcatcacaagggttgtggtaataaggattgcaaatgccaaacaaaatatgtttatggtgaagaagccaaaacaaggttatctgagtttaaagaggattgtgaaatagagctttttacagggctttatgacaagaaaggtaaaaaagtatacgagaatgatattgttaatgcaaagaaagatgcagcttaagtatattttaagttttatgagtttattaagtataagagtagatttagaatgtgataatgagaataatgaaaggttgcttatgaaacgttaaaaaattaaaagaatcgttagaaggtaaagatcaaggaaaatatttctgtgagatattcaataataacgttgatatcttggttattgatggtggtatgaaaaaacacgaagctatagttcaagttttagaagatgtgaagatgttatacagaaatgattaagtaagaattaaaagtttaagggttaacatatagaataattaaaatttaaattaaaggagattgattgaaatcttatttagaagactacttagaatctatctatgaaaacgaggacaaaattcctaaatacaatgtaaatcaatattttagatcaagtgaagaaattgaatctttagatatagattatgaaactattcttatagctaaggatattttgagaaacccagatgcttatacagaagaagaaatagatttagttttaagtggtattttttatattgcaaataatttaaataaaatttgtgaaataataaacacctcagaaacaaattatctcttagacacagaacacttaattgatatgcttatgttaggtgaaaatagactacaaaaattagacgacgttactttaaaatttgcgttgaatgctatagtgggtgctactatcgatttggtagattctttgttatttggtttagaaactttagcttcaattaaagctgagtctaaaattgaatctaagactgaagctaaaactaaaaattaattttgttttaagtaattttaatatataataatgtaaatccattcaaggaatattaatgaaaacagaaaaagttattttaggtgtagacataggttacagctttgttaaagtttgtgtaggcactggtgatggtcaaataattaaaaagtttaaatttccaagtgttataggccaaaccaaaaaacttgaaggtgttcaaaatgataatatagttcattacaatgaacgttattatatggtaggtgaagatgccaaacatttaccaagttctaatatcatagatttagatacttataagaatttagaatattttggaccattgttattgaatcacgcagtgaaaattgctaaactcagtaaagtagatttaatagtttcaggattaagtattgcagaaattaaacaatctggatattttcaaaatgtactaagtcattttgtggttgatggtactgaatacaattataatgtaatgttgttacctcaaggagctggagctaagttaagttatgaaaaattcggaaatgattttccaaatcttcaaaaagaatacttaggtgattcaacatattgtattgtggatattggattcaatacattagatttagttcttgttaataaaggagttacttcaccagaattattcgaaggaatttcacaacacggattgatgaaaatagcttcgcaagttgctaaattagtaaatgaaaaacacaacagatctatttcattgccagaggctagagaaatcttagatacgggtgtttataaactaagaggccaaaaatatgattatactaaagaaattgaaggtattaaaaaagaatacttaagagaaattttagcattagtaaatgaaagatatagcaatatattggataaactagatttcttggttgtgctaggcggtggtgcacacattttcaaatcttcaagtgatggttatattcgttgtgttattaaagatactgagtattataatgctattggagaatttatatttggaactaataatatagattctattgaagtgaatgattaagacaaggagattttatgtttaatataagtaaaacatttgaatgttgttacggccatagggtttggaatcaatagctgggaaacaccaaaaatttcaaggagcttttacagctccttaattaatttttaagcttttttttatataataaaacaattttagattctagttctaagcatacgacactttagtgttatatgtctggctctaaaatataaaactagaatctaaatacggttataaccactcaaaaacacggttaaaatcgactttaatttttttgttatgtaaaaaaaaacatttaaaggagtttaaaaatgatttctgcaattgaattatctaatattgccgtcaacccaagtattcaaactattcgtttctttaaagactacgaagaaacaagtccgggtaagttcgaattatccgatgattttgatctaagtactgaattattttttatagatactaaagaatctattgataatattattaaattaattattttggatccagaattaacacaaagtgtaaagtttggttcaattaaatatgattttattataaacaataaaaatttatatagaaaaattgttattgactcaggctctattattgacaagtttagtactataccatttgaatatggttatgaagaaccatctaaggatacactaaaagaattcaatgaatttatagaattaactacacgcaattatttattcaatacaaagaacccaaagggtataattattacaaatacaaaagatttaaaattcgatgaacttaatgattttttaagaaattcaggatcgcaaacatttttcaataccgatgctagagattttgatattcttagacgcgaatcaactatggtaactccggataatattttctttaatcgtgagggtgaattagtttgtgttaatgattttattgacccattaaatgtttttaaacgtactacagcaatgctgttagcatcttaagtattttagtatttagaatgtgctagcagcttaaaatgttataaatatacataaaggtacctgatgaactagctgatataacagatttaaatttaagtacattttaaattaaaacttaaaatgttattaatttttagtaagcttaaaatgttataaatatacataaaggtacctgatgaataaatcagaatttagaatatatcgtggtattgttgttaataatgatgaccctaaaaaaggaggtagagttcaagttcgtatatttgaacttcacggaatgagtgaaaatgctactcctggccaatatccagtaacttctggagaaaaggacactaaatataatcaaatacaggaaagtgatttgccttgggcagaagttatgcaaagtattgattatattggttattacccagcaccttcagatggttctgatgaatatgccaacaatatagatggtaaaggttctaaatctggatacaaaactataacaagatctggaaaatatccaggatttggttataacgttatattaacaccaggaacttgggtattttgtgttttagacaataataacccaaacttacctattgttataggctgcattgcaagtgaaaacgaaatacacaaaaatacaaaacctaaaaatactagagtatatgatagtattacaggtcattacgaagaatggagtgacgaagatggtaatattatttttcaccacagaactggtactacaattactatgaataaagatggtgaaatgactatcaatactgtaaagaataaaaaagaatatacacaagaaaataatttattacatatcgatggtgaacaaaatgaatacgttaaaaaagacgttaatgagaaatatgacgctaaccacaatttaaatgttaagtcaaacgaaaagttagaggtaggttctgatagaacacgtaaagtaggaggtaatgaaaatgtaacaatttctggtaaccagaatataaatgtgtccggcagcgaaacaatttcagcaggacctagtattactatgtctgctggagtcatcaagctaaactaaactaaactaaattcaatgaaaggaattaaatgaaaatattcaaaaatattaagttctcattttatataatactaataatatcaattatttgtgatatagtgtctttaattacagcaggtaaggttgtcgtagagccagcaacttatgctttgattttagtagctatttgtatagaagaagttatatgcactcgcaataaaattatagaagaaattaaaggtattgacgttcatattaaattaaatgattatttaatatctactagtaatgccaaaactagatatttaaatacaaagtctgaaaccgaagccgggataactaaaactaaaactaaagtcaaagatgttaaaactgagtctaaagctaaagaaagtaagtctaaagcatcaaaagctaaaactaaatctaaaactgataaagagatattaaaagatatgttaaacggagctaaataatgcctcctttaactagagttggtgttgattttagtacagggcattcttcgtttccgcctaatacaatttcgagtggttctacgaatgtcttgactaattcaattagtacagttagacaaggtgatcctatgataccacacccaagtcctagcccgtcaccaccacacggtggaagcattgttacaggttctggtactgttatggtcaattcaaaacctgcttgtagaataggtgatgccattagttgtgggcaagctgtagcgcaaggatctggaaatgttatttgtggataaaaatttctaattaaggagtaatatatgtattttatttcttttagtgaaagtataagcaaagatgttgaattaacgttatttgataataattttcaacgtattgctaataatttttatataaacacttctcctaaaagtatggccgatacatataacttcctttctgaaaattattttgaaaatgtaaaaatatattatggtagacttggagatctttcagtttgtgaagatggtaatcttaaatttttagaagttgataatatatcaaagttctaacctatgcttgttatactaaaaaggctgaaaatactagacttataaagctatgaatacgaatgctattttaataggaccttgcaaatcgagaatccccatagatgggtcactttcgaatgcttttgaatatttttatttctcttggttatataataaaaatattattcttataatagatactacttttgaatctcttgagattgttaaaaaatatcttgaaattaaatataatattaataaagattgttttaagaatattataatatttaaaaaatgttttatgtctatcaataatttaattttatttgaaatgtactgtatagatcatttcgatagatataaaccatttttaaaatgcaagaatttatatgctttaagtggctcaaaaaatcatacactcgagtgtaattattttgtggaatacgagcatttaaaacctgtcggtaaatcagttaattatagaagtaaaatattttttgagatattgaataaacctagatttcaaaagaatcaaaaatttattaataccagagcaaaatacattaaaaaagaatctgaaataactagaagtgatttaaatattatgtctaatatattcgaacaatttaatgaaatgttatatatacaagatcctgtattttttgatgtaaaacctagattatttcaagaatgtcaatattttggtgtcccttatgagtttgttgaacataaagattgttttgatggtgctaatttgagagcatttgactatgatttagaatccagatttatgagccttgaagaccctataatatcattattagtggattccaatagtgctggtaatgttagttcataaatagttcataaatatatcaaaggagtttaatgaaacttatagattgttttaaagataataatgattctgcttatatttttaaaggttttatatattattatatttttaaatatagaatacaaatgcttcaaggtaaaagctatattatcataacttgttatcgtggtaaagataatgaatacgtagctataaaaccaaaaaaattcaaaaaaattattaataaattaatggaagaaaaacaagcagatatattcgtgatggaaggaactattaaattaaactcagtgaattctaaaaattttagatttactttagattctggaatgtatttgtatataagaaataaatcctagattaatctgggtacgaaagtactcaagattttcaaattacgaaccgtattcgcatttgctaatcgtaagctaatagtttaataaacttttaagttatttctttatataatataattttaataaaggattttagaatgaatttaaaaagtcgaatttgtaatattttcagtgagttttcttttgagaagttaatagaaagattttttacggggttatttgttttgcttatagctatatttgtagttgttttatatacgtttatgttctcgtatttagtcagtgtcataggttctataactattgctatattattgtgtgtagtttttacaattatagtgttgtttttaggatcactcttagctgtataatatataaataaattaaagttgtttatataatattgaatgtttataataggtcaaaatttgtttaaaacactagaagttaaaaattataataataatccagatttgaaaataacgttaaaacctacttataaatgtaaccaaatgtgttcgttttgttgtgaatacgacaatacattcccggaatgggatagatcgaccattacacgactcgtagataaattaaaagataccccagatagatttcaaaaaatatttgtgtactattatgggggtgaacccacattgtttaaacaccttgaagaacttaccgaaaatctttttgaagtttacaaagatagagatttgtttatacaatgtcaaacaaacttaagtatagataaaaatagactttataattttaaatataataattttgagttttgttcctcttatcatatgaataaacaaaaagttgaagattttattgaaaaacttaatatattaaaagaattaaatatattaggttattgttttatgaatacgtatttagatcaagaacaacaattcataaaagaatttaatgctttagcgcaagcaatacctgataaattaaaaatgagatttacagtagataatgctaacccaggttcaaaacatatgaattatgaaaaactaataaaaacttatccatttttaaataattatttggaaacacaatttacatttttaatagattctaaagaagttatttacgataaagcatataacgaaggattatataaacaatgtagattttgtaaatgtgaagttggatctaaaagcttggttatcaattatgatgaattgtgttaccattgtgatgatgaatctaataaatttaataataaagaaataaaaggtttacctttaaaagacttagatttaaataatttttttgtaccttataaaatttgtagagttaagcagtgccatagagggcttgaatttaaaaagtggagatgagatgatcgaaattttttgcacaaccaaatgtaattggaattgctattattgttgtgaaaatatacataattctaaaaaaacacctaattatgaagatattatattaaaagttaaacaaaatttggataaccctattatattaagtggtggtgaacctggtctgataccagaaaatataattaaaactatattcagtatacatagtgatgtttctgttaatacgaatggaacatttataaaaaaatataaaaattttgtagataaagcaactaaaatttattaccattgtactgtagatttggaacccattgaaaatacatacactgagaataacatagaatatttagttatcgtaactgatgataacattcataaattagataattttttaaaaacttataattatatatattttgatgttataccctgtaatataccacaagatattaaatattataaaaatttatcattagaaaatataaaattattgaaacaaattattaaaaataataaaaatgtttataaaaaatctttattgtatttaatgaataaaaatagatataatataaaaaaatttatataggatttagctttgattgatgttaattgtcacacaacttttggtgaccttaaaacagtaattgtcggcatagaaacaagtaaattagtaagagatttaacatctattggtgctaacttctatggtattaaatctaagctaataacacacccattaaatagagtgttaaaacgtatagaacaattagattcattaagtttaatcttagaacaaaatggcatagaagtattgagaccagattatataaatgatgatataattccttcaaatgttagagatatattattctgctttggtgatactctttataaaatggctttgccattaaaatacagagtaaatgaatttaaatgtcttgaaaatatttttaaaaatataaacaaaattgtagaatttaagcaaatacaaaatgaaccatctgtagaatctttaaattatataataaaagaaaataacaaggttgaagcttgtatggatggtgctaacataatacctttaggtaaagactggatagttaatgtagcatcagattctcaatacaatatgtttttagaattaaaaaaaattaatccagatattaatatgcatatagttactatggatactagtcatttagatggttcttttagaatagttagaccggggttaatatttgtaaaagatttatcttatatcactaataggataccgaaaatatttaagaactgggaaatagttaaaattgaacatataaaaggtcatcgtaaggatggtgtttgtctttgttctgaaatgggtatgaatcttaattttttaatgttgtctacaaataaatgtataatatcaaaaagtaacaattcgtataataaagttaaaatagaattagaaaaacgtggtatagaaactatagaagttgacttagaagattctgagttttttggcggtggtatacattgttctactttagacttgaatagagcggatgaattaataaaatatgtgtaaagtcatagttttaaatttaatagattattgtggttttaattgtgaatattgttcatcaagtcaagttaaaaaagtgaattcaaaccctctaactaaacttaattttttaatgttgataaagcaaattgaaaaaagtctaagtcgttttataataaaagttactggtggggagcctactttacaccctaattttttagaatttattgaaaaattaaataacgttaaaaatatacagcgggtgataataactactaatggtagttgtaataatttagaaaaattaaataattataaaaaagtacataccattattagttaccatcctaatcagattgatgaagatagttttataaacataataaataaacaaacaataaaacaactatatgtagcgttaccagttttaggttaccctacaaaaataattgattttctcagtacaaataattatcatttttttctaatttttttaacggataaaaaaggattgaaagttcctgttgaagaaaaatgttttaatttttttgaacaaatcttcttaaacaataaaaatattttaaccaatagatttaatctaactagggatgaacaatattttaatatttttaaaaataatctgaataaatcactgggttgtctatgcaaccccaaattgatatattatgataatggcatatttacgtctaaatgtcgtaacttaaaatctaataaattagaaacaatgttcggtgttgatataaattgtaaaaaaatagcttgtgaagattatgaaataatggagtaccgcaaatgaaattggtaagaggttttgaagaagttttacctataattagcataaacgtcacagacgcttgtaatttcaattgttcatattgtattggttatcacaataatattaataaatctaaatttataaaaatatcaactttgatgttatttttaaaaaaacatatccacagaccagttaatatacaattagttggtggggagcctactttacaccccaaattgaataaaattgtggaaatactagtgcataataattatataaatcagattgctctcataacaaatttaacagcacctctacattcatataattttaacaatagcaaagtttttatagttgcatcctaccacggcaaaaacttttttaaatttattttaaaatattataaaattaagactcgtaaaataatatcacttaacacggtaaaactcaaacttgtagaaaatgttgtagcgttgttcgataaacataatattaactattttataaatcctatacacgattgtaatggagtgccattggatagtattgcaaaaaaacatagcaaaattttatatatgtttgattggaatctcaaatacaaaacacacgacaatattttggatgataattttgaaatattacgactaaataccaaagatataaaatgcaaacctttaaattttttattagatattgatggcacttttatgaatgattgttttaagcatattaaaaatatagatgataatattgtagtaacctgcccacataaaaattgtaaatgtttagaactatgttggtatccaaaatatgagtaacattttaaatttctcagaacttgagaatattgaaagaaatattgttttttttaatgtttacgattattgtggtgtaaaaggtattcttaaatacttaaattttcgcaatcataatgtatatacatatagttatgatgatttgaaccaatcattttataataatgtatttgatactaagtttaatttaaaaaagtttaaaaaatactataatattttaaaaaatttacaagcaaaaaatgatttgtggttaaaaggattggctgagaagcgtggcaaatacgaagtattaaaatttgacataaaatattttaattattttgatgatgactggttaaaaatatgtgtgtggcgcgaccctgtgatagcaatatctttaaacttttttacagctgagagtgacgatcaatataacataaatataattaaaaaatttaagaagtttatggttgatatcaatgaatacgcaaatgttatttgttatgatgattttttaaatcatcttggtatagacaaatatacagacattgataaaagtgtggtgaccagagaagctttaaactactctataaatttatgtaaacaatatttaaatttgaattatgaggtttataatgaattactttaatgtgaataattatttagaaatgagagaatctttacacaaagaatcaaaaaattttgaagaaatagaaattaatatatcacgtaagtgcaaccgaacttgtacaatatgtccacacagtaatgttgaatatcaaaaatttttaaacaattttaataatttatttatggataaattaatttttaaacgtatagtagatgaaatatcaaacataaaagatttcagttttaatatcgatatcataggcagtggtgagcctacattacaccctaattttttagaatttattgaatatatattaaaaaaaactacaaattatataagaattacaaccaatggtgataaattactaaaagattttgattttcgtaaaaaattatacaacttaattgaaaatcaaaatgtaatattaaacatttcagtttatgattctaaacaagttgaaaaatatactggactaaaaacattagaaaatgttgtaataaaggatatgtttttagacaaaagtatcaatttaaaggataagcatataaacaaccgcgctggtagtgtagataattcatacataaccagagtaaacaaaacaacttgtaactaccccttttatgcgttatatgtagatatcgatggtgatatacaatattgtccacacgattgggaaaaacgtttagtgtttgctaatataaaggatatgagcttattaaaagcctggtctatcgaaactaaacacaggtcgctgatgttagctcacaaacgcagcgagatttatccttgttataaatgttcagtagatggatgtaaaataggcaataaaaaaaggaaaatgtttgaataatatactattaaatttaacttatgaaaaaaatgctagaaataatatgttaaaaacaatacataagcctagacattattataatgaattactacattgtattgattgttggcgcaacaatggtggatcactaaaaaacatagacatattggtttgcactgacgataccacactaaaattaccatttgataatattaaatatttatatgttaattttgacaacagcttatctgactatggcttcgtaaatatttacaaggcaggtcaagcagcaactaataattatccaaattttacacatatacatatagatttagatatgtatgttttaagagacccttctgagatattgctttttagaggaaatactgcattaggtgtatattcaattgaggatgaaaattatcaaagaaaaaaaatatttgggacaaggcttgctgagactgatctgataataacaaaaccgggttcaaatttttataatctttatttgaaagagtttaataaaatagcaaaaatattgagggctcgaaacacatccgagtatgacatagaagaatatgtcgcggattggatgttatttaaaaatgaatatgaaatgatagaggaatacgaatatggtgaaagtttcaaatgtaaaccagccaaccccctatttttacatcatcataaatattataattagattaaattaaaaggtctttatcaatcacactaaatcgtttataatacccaaaatccctagtgtcatatgtattaaaatccttagacagcgctaaaaaaggaccttcagtatcaaaaattaaaaaactacgaaacttatcaatgaaatattgttttgatttttttattgtatcggtgtgtttatctattatgggtttgttccataaactgtctatcaccaacttggaatggcttgtaatttgccagggttgagtgttattaaaaggttctaaattatttgtgttacaaaaacctacacgtaaaccaggaaggcctagtgtttttgaagggccataaataacaaaaaaacctttactttttaatttttctaccatatgctgaaaatctgtaaaatctctacattgggaggtatatatataataacttaaatcaattattttaattttattagttaattcccaaatattatatcgtggaaaatttaacgtacaaccattaggataagtcacatacaccacatctgcttgattaatattggttaatttcattttgaaaagattggcatagacgtcaatcattttataattgggtaaatcataatatattgataatcctcgaaaataattgaataaatctcttataataccatcagtaccaaaattaatgtaatcacaaccatataactccggatttatatcactacaatattggtaaatattataaaaattaatgttgacatcataatctaatataaatttagaagccggtacgttgttatcagttttaaacataatttgtatgctccttatatttttcaatatatttataatttttagtggtgtatttttttgttgaaaaataaatatataaaaagagtgataatggaattaagcaaaaagagattaaataaaataataaaaatatataatttagcaacaaagccgtacagcgactccaaatacacagatggttctaaatcatattggtattgtttggatataaagtttagacattttgcatttgctaaaatatttaaaatagaattaaataattatggtgatcaggaaatcatttatttttttataaggacacctgcatacgaatttattaacccacctttaaaaatgttagatttcaaatcgtatctttttaatgcattgaaaatgaataaaattgaaatgatttcaattgaggatgtgcaagatttgacaaatattgatggatatatcaattataaggataaacaaatacataagaggggtgttagagagtttaccagttattgttatatatgtctgttaaataattttttaaaataacacctaatacataaaaatatggatatatgtttgtgaaataaagccaaacaaagtaataactaatttatcaaataaaaccaaaggtttaaaaaatgaatataaattatggttcaatcaaaaagttttttgggttagatccagatgaaattgacgtaatccaagaagtaggtgatatttttcaatttggtactctttggatagctttattttttatagctttatatcctacgaatatgacaattacacctatggtgtggctttatgtagctgcaggacaattattggtatccgctagtctaaagaaattagtttctaaatactttcctaaattatcagttagacccaatggaggtaaagattcaatgccttcgggtcatacgtgtgctgcttacgctggttttggttgtttattttttggtataaatgaatataatacaattttaattatagctactgtgatattattagctttagctgtttttactggattttcgagaatagctgcgaaaaaacatcattttagagatgtttgtgcgggtgctgctataggtttaataagttcttggattattattaatatatataatattaaaaaaaggagaatacaatagctaactttaaagaatttttattgctgcaagagtctttgactaaaaagactaattatattaagctcggtgagaaatacattaatatgtttaatcaagttctggatgcaaagaaatatctgcaaatatctctttttaatgtagataataaacaatactattgcatcctaataatgaaggattcaaagttggaaccacattttggagtcttttatgaaaataaattcaatgagttggtagaagcttttaaaaataaagacacgaagagaatcagtgatttagtgaatagtgagctttttattcaaaaagatggttatctaaattctgatgtaaattttctaaaagtattatcatatgtgttttcagttttagtggattacctggcaataaagccgataggatttgtaaaaattatggggataccgagaaagttcaatctttatcaaaaggtagtaaaaaatatcatccaaaaaaatgagataccatatcatattgtagtagaagagcaagatgatagctattctggtaaaattactgggcaaacaaaccctgccaagtcaatgattttaaagtataattttgcttagtgtgaacaaaatgctaaaatatgctaaaatctactaaaacttcagtttaatttaagattattattatataattatattgataaaaacaaaggagataaaatgtacgttgctagatttaatgagtattttggttatgactaccaattaatggatgttgaaacagttgatattttagaaaatatctacgatagtttaggatatatgcctagagacccagaaccaattgatttagaaattgttttagaagaattctataatacagataaaatctatgttttatgtgaagctgatgatgaagaaattgaattttgttcttgtattgatgaagtagaaccagaagttatcatagattttttgaaatccaagggtcatacttttatggattcaaatgcttgattgcgttttaaaacccacaaaataaataatcacaaaaagagagattatggactacttaaacccgggatatgaagctcctaaaaaaggtaatattaaaattacattagcatctttggtagatagctttcaagaatttttaacaaaacgtaattattttttatataatataacaactaaaactcaaataaatgatatcaaacaaacgaaagtttatagtgatttgcacgaacagttgagatctataacttatagtcatttttatgacgattatactttttatgctaaagatacctttgatattgagcgtgttaaattaatttttatgacttgttatttagatttacttgaagaaaatgatattgatttatctaataatgaattagttacaaataacgacgtcaacatcgaacattttgatttagcttataaatggtgcgatttcaatactgaattgataagaacaaaagcatacgaaatgggtatatttaaatcttaagctaaaggttctaaatggatgaaatcaattatgatgtattagaatatatcattcaagatcatttaaattgttctttgactcgtgaaaaatctgtattagattacttgaatttagaagcaactaaaagaaaccaaaaaatcacgggtgagactgaatcatttgtagtctacaaattcaaaccatatatgttaagtgatgatattttaaaaccttttattctgtgtacaaataaaaataataaaggttcttaatgatttataatatcgacaaatacgatataaaactctacaatgaatttttgaataatttatctaaacataacgtagattacacagaatacgtgtgtacaagagataataagttctatttatcaactcaattagagccttttattctggattatatccctattcaaaatgcttctaaaatgtttttgatatctaaaacaaaaggagttaataaccaagatgtataccaatatagaagacaaaaagtgacagcttctaaagataatttaaaattatgcattaatgatgcttatcaatatttcatagatttaaatcaaaaacaaaaaaattctatattttactttgttaatatatcgaataaagaacgtgccgaagctttatctaaacaactaggtaggctttattattttgggttttattataataagtacagagtttatttgaccaataatcaatacacaacaaattacatagattctgaaaatattttagtaagttctaatgatttgtttgatgctgagatgcaattgaattataatatatttagattgcaggatagacttaaaaaatttagtcaaacaccctatagagaaaatggtactacagtgttaccaaaatatatagatccattttttagaactcaggttaaagttcaaactaattcaaatgctaaaaattaaaactttaaatataatatataatataaaatttaaaacacaaacattcaaaggagacaaaatgtctaaagaatcgagatatacaaaagttaaaaaagcaccaaaaatgatttcagatgaagactttgctgaattcttccaagcagctatagattctaatcttaatgaagattttaaaagaccactcatagaatctaaatataaacttaaatctaatattttatacttaacagatgcttgcaattttgattgtgattattgttatcaaaaaaatgatagagatcgtttaataaaaaacacgtatatctctgaaagagaaattaatgatttttttaaagatcttattaagagagaaccagataagcctagcactgtagttatatttgggggagaaccatttttaaacccagatattgtttattatatttttgatttaactgataaaataacatttcataccaagaagaaattcaatctatcattaactacaaatggtgcatattttaaaaatactaaaaatgctgattattttatagaaagaacccgcaaattattaaaccatttttctttggaaatatcttatgatttatcagggaactccagaagagtttacagaaatggtaaagattctacaaaagatactgagtttgttttaagttattttaaatctaaagactataaattaactatccgttacactgtacataaattaaattatatgaatgctttaaaagatttaataacattaagtttagattctaattataaaaaaattgtagttaatttctatgaaactgaattagaacaatatataaatgtatctgagtttaaagaaaccctgaaaaggcaaacttgtgaagtgtttaaaagaactaaaatgcctatttgtcatttaaattgtttggcttgtatgggttgtaattttgcagattttgatggtatatattaccaatataatgataaatcatttgaagtgcaagaaaatgcaaagatatttgaatcttttacagaacattcttgatttagcttttggttcacaataaataaactaaaagtatgaactaatgaaattatctgaattaatacttattttagaaggtggcaataccacaacaatcaataaaaaaacgggtgaatctaaaagtgctgaaaaaatagattttaatagattgtcaatagaatcttttagagctgaattcatagatttattcacaagtcttaatagattgtttttaaacaaatacaaagaaaaactttgggctaatgattctttgattaaaaaaggtcttgtttttaatggttccacgagttatattatgaaccctaaaatggatccaaaagaaatctttaaatataaacaaagttccggtgatattgatattgttatacctgctgaacaccaagaaaaactatgggatttattagattctttagaaggtaaaacaataggtaattttgaatatcacggatgcttttcacaaaatcgtgaaaaattaggagatcaattattaacaatattcgtgtataaacccgaaaacatagcttgccaaatagattttgaaaatgccgactttaaagatggaaaaccaacggaatttgcgagatttagtcacggttcaagtttcgaggatgccaaagaatctataaaagcatttgcacataagttattattaagagcgttagtaggagctatttcagcaaatccaaatatagttgtagctactaagagttctaaaccaggcaatatcaaattaaaagcagataaaagcacacctagaatggctcaattcagtgttacccggggtttgagatttggtttggttcctatgttagataaaggtgaacccgtttattacgaaggtaaacaagtatatcaagaacaagatactagtgattcagaatttataacagatttaaaagaaatatttaaatatatgtttaaatcaaacgtgggaataaaagatttgcatagttttattggtgttgttaaattaatgaaaaaatactgcgatgaaaaaactattaaattaacacaagaaagattctttgatatcatttttggaatgccagcacaattcatagagccaaatgatttgaaattagatagacaagttaaattaactgcttataattatttcttaaaagaattacgtttaagacatccaggattagaagcagatatagatagatattatgttgttaaaggttctaaagctaaagctaaagcttaaaagcttgaactaaaatagcttgactcagcaataaatatacaaaaagtagggttaaatggctgaaataaaaactggtattttattaagacgtaatcttaaaaaacattttgtaaatgacgcaaaaccaacacaaggtgaaatcgttcttgctatcgatacaaatgaaattggtatgcttgtaaatgatgaaatacaatggactcctatccaaggtgttgttaacacggttgcgggtaaacaaggtgacgttgaattaaacaaaaaagacgtaggtcttgaaaacgttgataacactgctgacattgacaagccaatttctaattctacaaaattagaatttcaaagacattatacagctgaaaacccacacaatataacaaagaaaacgcttggtttagaaaacgttgataacactgccgacatcgacaagccaatttctaacttgactcaaattgagttaaataagaaaatttcttgggatgatgctagaaagcaagccggtgggaaagacccagtttttacagatactacttatactattaaagatggtgaactttcagaatttaactttaattcatattataagaatttcatagatacttttaatactaattccagagttttaccaagcacacaagctcttactgccaatggtagaataataaccttaagaagagctgacggctcgagtgaaagcatagaaacgcaagatactttatatgatgattctgaacttagagcattaattgaacaagctaaaatagatttacatataaacatacaagataatttagaatcagattctactaaagatgctttaagtgctaatcaaggtaaagttcttaaaggtataatagacgaaataaagaaagtaattaatattacagatgatgattttaaaaatcttcaagatattattaattatatagaagaaaatcgcgaaaaatttgatgatttaacaattgctaatatcaaaggcttgcaagctgctttagattctaaattaaatagggatgattctacatatgttgcaccaaattcagcattattagaatcacacccagctagtgattttgtattaaatacaaattataatgctaagttaatagaaatacaagattctttaaattctattaattcacaaattaaattatttgaaacgcaatcaggtgtagattctaaaataaaccaagcaatcagagatttaaatttcactgaaactatacagagtattaatgaacaaatcgcaagattacaaggctctttagatggtattgatttggatgctataacagaaaatctccaaaaagttcaacaagatttaacaagcaagatagaacaattagaaaccaatacatctaaaaaaatagaagaatttgaagttattattaataattttgatatgtctgaaatacaaactaatattaataattttaaagatcaaattactcaaaatatcaatagtatacaaggtgttgttgattctgtttctgaatcattatcaaacgttgaaaataatgttcaaaccagtttagaaaacaaagtttcaaaggatgagttagctgctgaggttaaaactattaatgataacattactcgcttatcaagcatagcaaatgaagcaaaatggcaagataatttttatagtaaagttgaaagaaaacgacaatctttatggtcaattatatcaatttcaaaagactttttcaaaggttcatataaaaaaccaaatacttataattactgggaagcaaaatataaaaatcttaagtatatcaatgataattttgatagcttagaaacaatatctaatgcacctacatacgacgttgttactaatcaggttattaaattaacttttagtgatattgcggaagcatcatttttaattggaagtcctaagaataaaattcaaatagctaaaattatagcagtaaatgctaatactaaaaaagctgtgtttatatatgggtacccaagttttatgaccgacgatttgtcaaaaattatggtaactatagaaaaagattcaagttttggtaattatctatcaagagctaataaaacagatccagaaacttttcaaaaaattgtaaccacgcaagaatttgatttacctgacgatactgatgattattcatattttgaagctagttatgaaatatctggaaatataataacattgactatgccagaaactgtatttttagaattctatggtaatatgacagcagtagaaacgactgttacaggttctggtacttctcaagtttggtcatcaactttaaaatctacagattatgaaggtaataagctattctcaaatggtgtgttgataggaaaagatttaaccggagaaatcttaactatatatgataataaatctacatacataaataccttgggtgaagctagaaccaattataatgattttcaaataatacgcgaagaatacgaagatattatgtatacaagggattttttaccaggaactataggaccaggggatgatgagttagaatggtaataacttttaaactttaatttaaacattaaaagctctaagatttaagattttatcttaaataaatttaaactttaatttaaacattaaaagctctaagatttaagaattatttaagtaaaaatataatataattaatataattaaaacaaaaaaggaattatatgttagaattaagcaattttcttagatcaccattcttagatatgcctagcatatcatttaataacaaaaatcttcaagatttattaaaaaatgtttcagaaacaatggaaacatatccatcatcagttacttcgtatttaacaactgaaactagttcgggaattgatgttgttgtattggctccaggagttcaagaagatggttctaaaacaattgaattagactttaaacctgatgaaattgtagttagatataaagttatagatgatgctaaatcattttttataactggttataatacaatcagagttagtttggattctgttaataactttaaacttaaacaaaattcatttaaagctagaaatggcattataaccttttcgttagaatctattaaagaaactaaaaatacatacacattctaataacttaagcctttgggtaaatactaaaggcttattaaccacaattcataaataaatatacaaaaagcaaggattgtgatggcttttacacacaaaaatcaaaaaaccttttatactgattatgctattaaacacggtatggtacctactgaagatactataaatctatttcaagttcgtcttaaaaaagagacaactgatatctacaataaatttcaaatagtaaacggaaaatcaccactcgagtggaatcaatctgaaaactatgaggttaatgaaattgtaagatataatgaagtagattataaatgtgtgcaagaatgtgttaataaagttcctagtgaggaacctagtttttgggtcgttacaaaatatcaagaatatactgaatttcctgccagtaattacctagctaaagataatcaagatccttatgatcctagttcaatacaagattatgaagaatctaatacttttcacccaacaaccgttaaacacgttgaagatcgtctaaaacattggtttgataatgaaactgttacaaatgctgatagacttgatggtgaacacaaagattatttctgctctaaacaagagtttgatgattttgttagaatagcattgactgaagaatctgtcgttgatagtttagaatctgataatcgcagattaccgttaagcgcttaccaaggtaaggttcttaaaggattaatagatcatattaacacaattttaacttcaaatgacataaacttagatgaacttcaggaaattgttaactggattaaaacaaatagagatatgattgaatctttgggtattgattctattaaaggattaagagattatttaaatcgcatagattctgatctgaaaaaaagagttacttacgattattggaatgctgaatttctcaataaaattaaagaagtggatgggcatttatctggagttgatgctgatacattagatggtcaacacgcaggttatttcttaccagcaagtagatttacaccagaagaaattgctttattacttcaaaaagtaccaggatctttgggtaaaatagatgctgataaattagatggattagattctaaagatttcttgagacgttcaaccagtgatacccctactcaagataataaatttagtttaggatctacagctttaagatggtctaatatatatgctgttaattttcaaggaactgctttgcgagctaaatatgctgacttagctgagtattatgaagttccagaatctattaaatcgaatataaaagcaggtcatatattaggcatagatgcttgtggtgtaaatttatttaacccaggtatgaaattatttggtgttgtttcaaaaaatcctggtgtaattctgaataatgaatgtgatggtgttccaattgcattgaaaggtagaactccagtttattgcaaaaataaacctagtataggtgattatatctatgctgattctaatgggttgggtattgcaagtgaaactgaattagatttaccattagtgggtatttgtataggttctataataaattataaagatttttggatttgcgagatcaaaatctaatatcaaacgtaaggagtattataatgaaattaattatttaattactaaaaactcgagtttaatttttttttaaactcgagtttttaattcttatatataatattatattttaaatttaaatttttaagttttaaatttcgggtaataatatgcagcgagttccaaattcaacaccttgtgtatctttttggaattgaacacttgaataaaaactatctttaaaacttgaacctactataggaaatgttaaagtatctttatacgttggatttcctctccattgaaaagtttgtcttgtggtgtctacggtagcatcttgtaaaacactccattttggaataccgcaagaatctattttatactcagaagttgttcttacatttgtgttattgtacttggcaccaacatccttaaaataacctaatgggctatcagagtcactgtttatataagttataatctctgctggtaatgtagtttcatcataattattagtatctactaaagattctaaatctaaatctgttatattagtgctttctttgataacaccaaaataacttctatctaatatataaccatacatagcgcctatagccagattaaataacccgcctactaaatcaacaaccccgcacgcgtgaccattatgactaattttacccattttagaatctgaaacactacctgttctatacaacgcgttagtaccatccgtatacccagcagttttataatctaaattatgaatagcttgaatatctctttgcacactttgcatagtattcataccttgaataaatgcaaatctatctgttcttgatttagcaaactcaatattattgaaattatttgtattataagcattttgatatatacatttagacaacaaaatcaaataattataagcaaatatagttaatacttgaaattcagggcctctatttttaacagcttctaagaagcttgaatttctattcttaatagattttaaatcatcagaatctaaatcagaatcttctgtaattttattacccaaagcaacctttgcagaaactcctgagattaaagctacagagttaaatttagaatcacaggttaaaggcactgtattacgcctagaacctaaaatacccccttggttagatgctagatatttgtctataaaaaaacctggaatttctttaccattattaataaatgctctatggcaccaaaaaccttcttcttgagtagcggaaacttcaacttttaatccgcaatatggtgcagcgtctacatttgaagtcttaatataaagtttaggtatccaaaccataacattaccgtggatatcagtataatttccataattcatatgaccaggagtaaaagttcctagcataggatacatattatatttgttagtaatttctttaggtgcaatacccactccaaaaccaatatcaccaagatttggattacttggaagtgcaccagcaacttctccgtttccgtttatccagcgatttttattttttgttttatctatacaagtccaaataactccagtagctgtatttaaaaaagttgcactatcgattgtaggatttatagaagctgtgggatcatttgattgcttatagtttatagaataattatcaacttgtgtatgcaaagctttaacatcttctttaaccggatctaatttttgatctattaagaaattagcggtattggtatctatagaatttttaattttttcataattatctttaagttcatttatggctcctactgctgtagtttttgcttcggtttttaatgttgttacatcaccaatagtattgacttttttggttaaatctttttgcgtgtaagcaccaagagctaaatctctcattacgaaccttttatgttatttatttgaatctatataagaagcctttaagatattttataatataatatcccaaaggataaaaatgaaaggtaaaaattttagcttaaactcaaataaacgtaataaaaatgactattaccaaacaccttatagtatgactaaacaattattagaagttgaaaatttcgaaggaagtatactagaaccttcttgtggtgctggagcaatagtcaaagttctaaaagattataataaatctgtagattattgtgatttaaacaatgattttagtttaacaggtatcttcaaagatttcaaagatttcattaatgatgattttgatagatatgataatattataacaaatccgccatttagtttagcaaaagaatttatattaaaagctaaacaaatagcaaataataaaattgcaatgttattaccattgaattatttacacggggtttcaagatataatgaaatatacaaggatactgattttccattaaaaactgtttatgttttttgtagatatggtttacttgaagatactattagagaagatggaacttataaagctggtatgatggtatatgcttggtatatttgggataaatcttataaaggagaacctataataagatggctaaataacaacgattatatagtcaaatcaaataaaggatcttaatggctaagttcgttactcccgcagggaatttacttaattctttaaattctaagaaccttagaaatgttcaaaattatagccaaacgatagtttggtcttttgaaactaatgaagagtttatatctgctagaatagttgatgaaggtgtagaacacgtccctaaaggcctaaagaaaacttggacacccacttctttaactctttctggtctgccagatgatgttgatttgtatcatccaaaaatgatcacatatctttggagtggctttaagttagatggaactgaatttaaggatactaattatgaagaaaaagctactatagaagatattaaaaatcaagatatgcactatactggcaaatcctggggaactaaaggtattgctggatattatagggataataatatactaacatttccttttactgtagaagttacttattgggaatattctaattcgggttcaaactcaagttctggctctaaaaatactcgtgaatctggttctggtggacttaaggttcaaagaactatagctcaaaattattatattacagtagttcctaatatggatccagcattattttgtaaaaaatatggcgatgctcacggatttaaagggcctaaaggtgaagactttaattatgatcaatataaagcttatatggtttctttaggcttagatttcttaactatagatagaacccaagccacttaatatattgaaatatacttaaatatcactttaaatctaaaatcgatttaagccgatttttgagcctctatacatatatttaaatattactaaaaatacgcaaaaatatctgaaacttcaatttaatttaagattattattatataattatataaattaaaaaggagattcagatgttacaagacaaagttttaaaaaattacagggattctttaaatcaaagattatcaatcttgatcaaagacccagaaagtaacaaagatatcatatctgatattaaagttgaaataaaaaagatcaataatatattaaacagatcttacaaccgcggttaattcaaacaagactagtaatggttagacaaaggaaatataatggtagattttaaaaattttttaacagtaaacaaagtttatatcgataaatcagatataaaaccatcgcaaagaaatgtaaactcagttctttataagttgcttttaaaaggttataaaccaagccagacattgttagaagctattaataatgcttcagattctgatcttaaatcatttgaagaatctatagtattagctgcaggcacaacattctataaaaaatatactcataaattaagagatatttcagattatgaagatcaattctatcactatgtcttaagatatatttttaacttagatactcacgattatactctaagtattaattttagtgatctaataccaaacaaagaactagttgaattagatttaatacaagaatctgaaattgaaaaaattacaaaaaacatcctagaatctcaattcaatcctacggataatgaaaaagatatcataataaaatatggttttaaatatatgccaagtaagattccaaataagttagctttagaaactttgatttctaatttaaatcctagtgaagctctggaattctctaaaaaatacaaaccagaaaatgttaatgcggtcagaactattactaaatgcttaattaaatctgaatacgatttagatatagacaaattagatagaatttacacaaaagaattcaatttacctagatatattaaaacttttgttatgaattctattaatgaattaaaattggatcgtgaaactatattaaatgaaatgttaatatacaagaaattctggcaaaatatacagtatttaattgttacaacacaaaaaagatataaaaatctaatagttgcaaactatgtttttaacaaaatattaaaaagagattataaacaaacgggtacttatagaatcagaactttactaaataacccagtaaaatttaataatgcttttattgaaatttataagtataatataaatttagcttataaaaatgtttttaatttagcagctaaaactaataacaatgattttagtattttgttgtatcatagacctaaaacactcaaacaattattggatttagttcttaattataaaagaactggtaaagttcgtatgtctaatatcaaaggaaatattttatattttgatgaagctaaaaaaccaagcggtaatctttgggaagtcttaagtaaattattttcaattttattacaatctaaaaaagatttaattgattttggctcagctaaaagaatagcaatttctgatgatttagaaactatggttcctccaattaaacctaaagattctttaaaaactgatatattctttccaaaaggatccagccttagaatagattctaaatttcaagtattcgttgcttggaaaaggaaggataattctaaaggttggttagacttagatttatcttgtttattcagagatagttcaggttcactaaagaatgttttggattatacaaaacttgaaactagcatagatggtaagattcaaatacactctggtgattgggccagttcaagaagttttgatcctaaaaatccattaattacagcagagttttgtactttgactttagatcctaaatcagatttagaagtatatgtaaatgttcatagttacaacaaagtttcactcagtgaatatgatgtaattgttggtgttctaccaggtgatactaaaaataatgatggtgttataaatctccaagatgctatttttcaattcaatgttgatgtagatttcaaagatatgtgtgcgtttagaattcaaaatggttttctacaagttattggtgaaccatttaatatgagaggttctcactcaggaggttatggttttaatcaaattgctccaatatatgattattataaagtttataatcaaatgagtttaaaaagattatttgaattaattgtaattcataaaggtttaaaacttgtggatatcaacgacaatccagatttagtagttagttctaaactaagttctaaacaagttctaaatacagctctgaatataaagtttataatgtaagtgaaaacgcaaacgaactcaaagagttaatggtaaaagattaactctttgattctattaagtttgattctggatttataggttctaccattggctcaattggaataggtactgctggttcatttggtatactaggagtgttatcattaggattagaatcaaactctaaagattctacacctcttgggtctatataatatactttaaaatgtctatcatttttaactgcttcatttaaaacattaatcaaatctttattattttctattctatcgtctatcccatttttattaatatctttttctggtgcaaacttactagcttgataaacaattttttgaccagaaacatataagattatcgacccaccaaaagatactaacaaaggttctaatcctagatttgcatcaaaaaatctattaagaattaaagccaaagaacatataaaaaagttctgtattataatatgtctatttctttctgggttaccataattagcagaatctttagttcctttaaaagtggcaataacagaagttgttctgtcgacacccacatatacacaacatagggtagcatatagtgtggttagtgtttccattgggacttgaaagtttttattaaagatacccgaacctggtatataataatctatgatataatctaagcattgaaatattaaacaaactgctgtgaatataccaaagaatataacataaccagcagtgcctttaatatttttatgtaatttattagtaaaataatcagatttaatttcttttgctgtatacgtagattcgttagtttctttatttaaatacatatgaaccttttatattatttatgtcgttttagagtttaagtttatattaagtttcagatataatactatagtatatactactaaataagccaagcattttttatactttttaatattagtttaagctttgctttaagttttaagcatatactaggatatatagtatagtatatactactaaaaagccaagcattttttatactttttaatattgctttaagttttaagcatatgctaggatatatagcattgttatatactactaaaaagccaagcattttttatactttttaatattgctttaagttttaagcatatgctaggatatatagcattgttatatactactaaaaagccaagcattttttatactttttaatattgctttaagttttaagcatatgctaggatatatagcattgttatatactactaaaaagccaagcattttttatactttttaatattgctttaagatttaattatgatagctgtattagtatataaataaactaaaagaggaactatgcaaaaatatgtagctattgctttcattattgttgctatgctaggatatataggatggcttaaatatgataatgctcaattacaaacaactatttcgagcttagaagccaaaaacaaaggtttagaaacttctctaaatatccaggttaatttaaataaaatacaagaccaaaagaatcgagaacttgttaacaacattaaagaacttgaaaataaacctattaaaactgaaacaaaatatgtaacagtcaaggattgtaaagttcaaatatctaaagtagacaccaatattacctcagctaaaggtatacctttatttttaggaaatataggtaaaactcaaatatctaaccaaaaataaggaatctttatgaagtttaaaaagtttttattggccttaataccttttatttttataggctgtaccactgttagaactgagtttgtatacccaaaaataccggatattaaagaaccgcctataacacaagattataatctaactgtaataaaaataaataacatagaatattattcgttgagtgctgaagatgctaagattttgtcagagaactggatcaagtttaaatcctgggctgagacgaattatgaattattaaaaataattaaaaataaggacttaaaatgagtttcaaagacacattattaaacctagtttatgagaattctagctgtgaagtgctggatctggattataaagaccctgaaatcaaagaaactgattctggtgatatagatacaacacctaccactaaagcagatattgttaaacgcaaagattctaaaatcgatgaagatgattctggcgatgattcagagcttgaaccactatcaaaggaagaattcgacgatataattaattctttagatccagatacgattgcattaattataagtattcttaacgataatggatatatagttgcttccaaagaagaaattttatcagcagaagattttgaagatattggctatcttgttttagaagttctcgaagaaatttctgagtatgaagctaacaattatgaacaatatggtgcaactccagtagatgaatcatttgatgatgctgaagttcttaaagaagctgctatgattttagaagctaatgatttaagtgatttaagtgaacaattagtagatattgcacatactaaacaattaagacgtgatagaaaaagatcagcttggaaaagatcagcagttttaagagcaagatttagaaaaactggtgaaggtagaagagaacgcaaaaaagcgcttaaataccttaaaaaatatagaagacaacataaagctcgtatgaagagatattcacaaaaatatacacaagtttggaaaggtaatactaaaaactaatgatattttgtgaagatttagaaccaatatatgaggtggtaaaaaagctacctctttataaacagagagctaaggaagaagtgtttttaggtattttaaaatcaaaatctaagaaatgggtcggatggaaatacctaaaagaacttaaaaaagataaaagctttgacgacagcgctatttttattgagctttatgagcttgcattaaattactactggattaaatctcaaaacgactctatcaaatacgataacttaataaaaaactataaattttaaatttattaatattctaatttaatattaaagagtttgaaattttttaaaaaattttaccctttaatatgatattataatataaaaaacttttttaaaaatttttagtagttttattggtacttaaaaaatgcttggctttttagtagtatataacaatgctatatatcctagtatatgcttaaagcttaaagcaatattaaaaagtataaaaaatgcttggctttttagtagtatataacaatgctatatatcctagtatatgcttaaagcttaaagcaatattaaaaagtataaaaaatgcttggctttttagtagtatatactatagtatcatatctaaagcttaaagcaatattaaaaagtataaaaaatgcttggctttttagtagtatatactatagtatcatatctaaagcttaaagcaatattaaaaacattttaagttttaattttatataataacaatatttcaaatcaaaaggatttatatgaaagatacagttttaagcctaagtggtggtttagactcaagtgctttactatttgagtttaaagatcgtattaagattgctgtaagttttaaatacggttcaaatcatcaagaaaaagaactagcagctgctaaaaaagtcttggatgaagtaaataaattaggtgctgaaatcgaacatagaataatcgatttaacagaagcttttggaacttttaaaagtgctttattaagcggttctaaagcagttcccgaagctggttcaactgaagtttcaaatgtaattgttccgtttagaaatggtatattcttaagtatcttaacgggtatagcagaatcagaagattgtagatttattgctatagcaaaccacagtggtgattctaacgtatttccagattgtagatatgattttatcgatgctatgtttaaagccattggttcaggaaccgaagacagagttcaggtattcgcaccgtatacaaatattacaaaaactgatttgacaatccgtggtatatctaatggtttaaacccagattggacttacagctgctataaaggtggtaataaaccttgtaatgaatgttctgcttgtgttgatcgtaacaaagcagttcaagaagccgcaacagttctaaaacattttagttcttaatttatagactattaagttttaatatattataatattctaatcgtttacactaaagtgtaaagcaacaacactttagtgttaattttagaactttagtgtaagtcactaaaattagaaccaaaggagaaatatgaaactattcgaagcttgcttcaatttaggtaattttgaaacttatgaaagattctataatacagaaactaataagtctgaaattcaaaaagtctttcttaagaatcaagtttttattgaggatcctaaaggagaatatacatttttattagatccaaatattaaactaacaaaagttcaagctaatcaagctaaagatttagaaacttatggtaagactaatattgctgctgaacatattaggcagaactattggaaactcaatgattcaaaatataataaaaatataagtattttttatctggatatagaaactacggcacactcacctattgacaccgaagcttgtagagaaagaatagtttcaattcaagtatatcataacttaacgaatacaaattatatttttacaaatgagttctttgacaccgaagctcatactaaagattctaaatatattttcgatgataggacttatgattttaaacttaaatactatcaagtagaaggtgaacataatttattaattgctttatttaaacttatagaagctttaaaacctttattagtattagctcacaatggtgaaggttttgactttgcttatctttggagaagaactgaaaagttaggtttaactgaaggatttagtccatttggaaaatctgaatttcaaataaatgaattagataatggaactaaaaaatacagtataaaagcgcccggtgttttctatatggatactatagatatctataagaagtttagacttaaaccgagagaatcttattcattagattatattgcagaagttgaattaggtgaaagaaaagttaatcacgattgttttaaaacttttgatggttttagaaccggtgaaggatttattagaccagaagttgaacctagcaaagaatctattttagaatataaactttataatgctaaagattctgaagaaataaaaagaatttctaaagaatattttattcattatagtattatagatacatacttattatatagaatagataatgcaattaaattatctgatattatgattagtattgcttctattatgggtattcaattacctcaaacacttggaacaacaactccttggagtacatttatccgaaattatgcaatgcaagataaaatagtattaccaaatccaagtgaatttagtggtgatgtagaatttaaagggggctttgtagctgaaccattaattggtagatatgattgggttttttcagcggacgttaccagtatgtatcctagtcaaattatggcatttaatttaagttctgaaacatttataccattttataaattgccaaatgatttacaagaagctataaatgaattagatcttaatgaagatgaacaatatcatattaataattattataaaaatcccgaagcttataaaaaatacacggatttacttataaagtataattattgcggatcattaactggatctgtgtatgataaatctaaaaaaggtattctaccaatattaacagaattagttttcaatcttagaaaagcagctaaaaaagaaatgttaaaatatgagcaaatggctgaagatgctaaagaacctgaattaatacaaaaataccaagcattagcaactgaattggatgtcaatcaattgacatttaagattttaattaactcattatatggagcttgtggaaataaacattttattctatataataaagaaatcgctaaagctatcacaggaaattcaagattttatataaatcttatgagtaaaaatatcaataattttttgtgcgatttatgtggttctggaaattatataatttataatgatactgactccgtgttatgttcaagtacctaatattataaacgaaaaattaccaaaagacccacaattagcaacagatataattgataaatttatagaaactaaaatacaaccggtaattaacacaagctcacaagaattagggtctatttttaatgctttagatgcttcaagaatttctgcaaagcgtgaagcgattgcaagctctgctgtgtttgtagcaaagaaaagatattttatgaaagttatagattctgaaggtgttaggttcagtgaaccttatcttaaaacaatgggtatcgatattgtcagatccagtacaccagcattttctaaaaaatatcttaaaaaatccgtcaatattatattagaaagtacagaagaagaacttaaagaatggttaaaaaatattagatcattatacctgggtcaaaatctaatggatattgctaagatatcttcggtcagttctagcaaatataaacttggtgtggataaatccataccgattaattcaagagctttcttggtatcaaatcattatataaatagtctaaatacaggtgagtttcaaccattagaattaggcgaaaaggttcgtatgctatatcttagagaacctaacccattaaaatctaacatttttgcttttaataatgaaaaatttgcaaatgtatttaaagattatatagattgggatactaattttaataagttctttttaaaaccacttgaaataatgacagacccacttaattataatttacataaagaaactgaaactttggaggaatggtaatggatatactcggtgtttacaattatattaaatcttatattttaaaaggatacaattatttaaatcttatattttaaaaggatacaattatttaaaaagtaattattcttttattactataatgatattattatttggcactatttggttagcttataatttattatttgctgtaatttttattgttttctttttaataggttcgtttgttttatttgcatatcttgattctgcaatagacgacattaattttaaaaaataatgattaatagggctgttataactaggtgtttcaaatataatggctctatgttcgatgcttttgaatatttttatagactttgggaattagatcctgatactaaatttgtttcattgtacagtcatatcaataaagattttttaagcattaaatacaacgtagatccaaaatgttttgataattttatatataaagatccatatgatttagaatttaacaaagttttattattcgatactcacgatttctataatataaatcacccaaaatcccttaaattaaataagttatatgtaatcgctaacagcaccatagggttcaaagaaaatactgaatattttgatgaatattttttaaataaaaattatattaataaaatatattatcagattcacagaatatttaatcatttagataatgtatatgttaattgtatggataattgctgcaagagttatttaaatattcttaaaatgtatccgaaagcaattatcaaagatcctaaaaataattttcaacattacacaatgactaagaattttataccggatatttacaagtattttaataagtacatatatgttaaaactggtagaacttatgatagacacccaagacaatttacagaatgtgcttaccaaggcattgattgtgaatatatttctgaaggttctaaattcacaaaaaatgataattcatattatagattcgaagatagatatgattttgataagagatctatatacaacgatatagttatatctaaaatgctcgattaataccaaaaataaataagttaaaaggtttataatgagattcttagaatattatagattaaaagaagctgaagaatttagtagaaatgacattaaaaccatcgttaaacaatacaataaagtattcacaagaatcttgaatgcaaaattctatttagttaatgaggttgaacattgtacttcaaatggttcaaaattaataggtattagatttgccagtgctgatggctatatgataagatttaattacactacaaaaaacgctaaacaaattcagaaaattaacaaagctactaaagaatttcacgttgaaagtatagatttttggaatccaataactggacatttaaataaaccaagtatcagagtttctgtgatttcgagtttatctctcaaatattttatagaagacattacaacttctattaaaaagaatcttttaggaactttttattataaagatcttaaatttacagacgatataaaatcagaaaaatatgtgattaacccagatgaaatcatattcattaatactaaaggatttaaagaatccaatgattttacattaaattcacaagatcctaatattcaacttatacttaataacatcaaagaagtttatggagaagcttgatgaaaagaatcttaaccttatcagatcttaggcaatatatcaaggaagaactcggatatccacaattacaagttgaacttacagataatcaattagaccactgtattgaaaaaacagttcaaatgttttgtaatgttgcatatgatggagaattaacaagatatataaaatttgaatgtcagggccaaggcaattattttgtagatcctgaagttgaagaaatattacaaatatgccaaagtggtatttttgtaggttctgatttaaatggattaatagatcaaaatctatctaattatatactatctacttctggtgttgctttaagttacttagttactttaagttctacaagatccttagtcgacaaatactttggtcaacgtattaatttcgagtttaactctcataagggattattatcaatatatcaaaattaccacgggcctttgttaattgaagctaaatgtaaatacataccagatgaacacgataaaatatatgaccaagaatgggtcaaagcaatgtctgtggctcaagccagattgatgcaaagtgtagtcttaggaaaatattcagcacctttaattaatggttcgcaagttaattatagtgatattagacaattagcccaagatgaaatacaaagattaaacgaggaactttccaataaatttacagaacctgctgtatttatcgttggctaaataattttatatttaaggaactcttaagatattttatattataattatcaaaaggagataatatgagagtttctaaatacaaaatgttgagttccttaaaagactcagaatacaacttagttttaacaaattacaaatacccacaatctaaaatagatttagaagaatttaacgagtttggagaacgcttcttaaaagataatgcaattatcgatgttaaaaaactcaaagatcctgaattaaatcttagatatgattatgttttaatacttagaacaaaacttactgatactgctttagaaattataaaagaagcttatcctatgctaaaaactattgacgaatataaagcttcattaacaggagattttaatgaattatgataaactaaataaaattggaataattttgattattattttatcagttgtttattttatgcttgatattaataatacaaaagttaaaaatttagaatttaaaattcaagatctccaaacagaacttaataaaaccaaaaaagaattaaatgataccaaaattaatttaaatcatttaagttctaaagttcaagatttaaaaatatctttaatgaaagatatgtcgtcaatgtatcacttaagtgataaacaacaatctctaatacttgatgaaatatggaaacaatctaaaaaatacaaaataaatccagcattcttatacgcaatactgtggaaagaatcaagatttagaaacgacgttatccataaacctacttatgttagaacacttaaaaaagaaatacaagcccaaggtatgggtgctattgtttgggatttctggggagataaactcaaatctaatacaagtttaaaatctaaaaaagatcttaaaaattggaaaaagaatatagaaggaactgcatatatacttagttatttgaaatctttaccaaaggtatctaatacaaaaaataagtatgaatcagcggcttcaagatactatggaaaataccaagcaaattacgtgaataaaacaatgtcaaaatttaatgaactaaactcttaatgctgaaattaaagtgggtttaaataacgattttgaaccgatatgattgtctaataattaagtacattttaagtgctaatatgttataatattgttagatttcaatagaaaggagaactatgaatgaattaagttttgtaccaaaatcagaaattcttaataaatcacaagaaacttgtattaaagaatgccaagatattgtatttcaagaaacaaaagaagtttctaaagacctcatattagatacattattaggtatgatagattctgtcaagatttcagattctgcagttcatataaaattcaataaatctttaatcatacaaagtgaaaacattgttttaggtgcggataatttaaatatacaacttgcaggaaaccgagtagaattacaaccaagaatcaaacaaaatccaaaggagattaaatgatcacaaaagatttcattaaagaactttcaaaaatgtcgagtataactgataaagttattcttaagtatccaataacaacattaaattctgaagctatagatatgcttgtaaatatagatgcgtctaaattaggatgccaagaattcccagatactggtatatatgaattaaataagtttgttcatatgttcgcattatttgataatccagaaattacaagaacaaacaatgcaatagaatttgaaacaccgggtacaaaaagtgtttatacaatttcagatttgtctgtaatggaaaactttgatcaaaaagcttcaattattgaaagtttagataattttccagaagttgccagagttgacattagtattgaagtcataaaacaaattaaacaagcttcaagtatttacaacgaattaaatgttttaagtatagaaggtaaatcaaatgatttatatttgtatttagatgcacataatagatttaattcttctaataatacatttagcaaagagtttttaaatcattcaactatggattttaaactgaaaatcaatattgaaaattttgttaaactgccggtaacaaattatactttaaagattaaatataatgagagtaaaaacgcatttagaattctctttgaatctgagttttctaagattttgatctcaaaaattgcagattaaagattttacaccaaggaacaataaatggataatttaaaacaactttcagctacgtgtatgcaaatctttattaaattaaatggaatgcattacttagccaaaggcaatcaatttcacagacttcacgaaataacacaagaatattatgaattttttcaagagtcgtttgatacattcaatgaaagattggttcaattgagtttaacaccctgtgttaatatacaagaaatccacgatctgaaaaatccatatattttagatctacaagctacaaaacttgatttggataccatagctagcacattaataaatgattttaaattagttgacaattcagtagcagttcttattcaagaagctattaaaattgaagatactgttacagaagacatcttaagaacatttagaattcgtctccaaaaatatatttggatgctcgaatctatgcaaagttaaggaggtataatgttaaaagaagataaatttatttggagtttatttcagaaaaaatttccagaagtttcaagagaagcttatgaagattttgtagaagaatatttaaatatcaaaccatttaaagctagtgaaaatatatttgaaaccaatcaaagtatttcaaacgaagctcattttattatgagagcattagctactaaaaaattacaagaagtttttgaaatacttaaaattgatttagaagacccaaatgttaaagcagattttgaaaatggtaatttaggaacaccaggcagagtcattaagctaatggctggtgccaacactgatgatgatactgagtgtggctctggtagatttatgaaacctgttagaatagcaacttttccaaataaagacgcagctaagattccaattactaaaaggattaacatagcaagcaattgtagtcatcatttattaccatttaatacagattttgcggaagattcctatgcaatagttagttatatacctaaagattatgttctgggtatttctaagttacaaagattagcagatttcgtctcgaggcgttattggttgcaagaagatttgactaaagaaatctacaataaaattaaagaagcagcacaaactgaagatgtttatgttaagttatgtaatattaaacatacttgtgaatggattagaggtgcaagaaacactgaggggggatttacttcagaattctacgggggtgcttttggtgatcctgaattaagaaaacaggttcaaatccgagtttaatgttaatacactatagatcttagcatttaacactttagtgtaatttgctagatctttagtaaaaaatttaattaaattttaatcgttctttatatataatatcatattaaaaatttaaatttaaattttaaaagtctaaatcaaaggagtttaatttggataattttgaatcggttcttctaaaaaatattatagaatctaaagatttttttaataaagtaaggccaatcttaaaacctagtattttcacagattttggtaaccaaaaaatctatgaattaatagataatttttattctaattataatacaactcctagcattcaagaaatagcacttcaaattaaagatattcccaataaagaagcaagaacccagattgctactaaacttaatgatgctagaaactcagaaaatatcaataaagaattcttagatgatttaactgttaaattcattaaggaccaaatgttcacaaaagcattaatgttaggtgctgagttcattgataaaaaagatgaaacttataaacaaaaagccaaagatcttatagatgcttcacaacttgtgaatattcataaagatcttggtaatgaatataataatatagaagaacgcattgattattatcaaaatccaagaaaaggtatcaaatatttaagattcaatactttaaatgagtatatcggagaaggctttcttaacggaactttgaatatttttatggctcctgcaggtattggtaaaagtttattaatgagtaccagcattggtgattttcttaaacaaggtttaaatgtattattagtcagcttagaattatctaattttgagttcttaaaaagaatagatgctgacttattagatatacaaattaatgctttaaaagacgtagaccctagtgttatcagaactaagtttgaagaactaaaaagatctggtattggtagcttatatgttcaaaacttcccagctggttcttttagttcaaatgatttaaaatctttattagaaatgtataaagctaataatataaaattcgatgcaatattcttggattacttaggcttgatgaaatctgatagagtttctgcaagtgcaggtttatatagttatattaaggccattggtgaagaagttcgtgctattgcagtcacagaaaatattccgatattttcttgttctcaattaaatagatcagctgtaaataatacagattctaacaatgaagctatttcagattctatgggtactgctatgactgctgattggatttgtttcttattacaaactgaagatcttaaaaagaaaaatactattagatttaaaataactaagaatcgttataatggtagaacttcaagttttgatatgcatattaattataataatatgcgtatagaagatatagtttcaaatgatatacaaatgttaagtaatgctgatattaaaaacgttccacaattagaaatacaaaaacctaaaactgattggaactttaattagtctcataaagattgacactatagtgttaaatgttttaaatttaattaaactttaagtttatatattatataattatattgtttaaaaaatttgtttaaaaagtttttttttaaacggttagattctaatcaggattttcaaactgttaatgtaaaagttgcagtttgaatcctttttaaattaattaaactttaattataaatatgattgaaaatttataattttcggggtgtagcgcagtctggttagcgcacttggtttgggaccaaggggccgaaggttcgaatcctttcaccccgaccattctaacattagtaagcattcgggtaattggtaacccactagactgtaaacacatttaagatttcagtagaagttttaaatgtgtttatgatgtcagcgttatattatataactaaaactgatgattgtaaacacaattaaaaatcatttgtaagttttacccatgtttattaaattgtgatactatatgtttatataaccaataaatatatttaaatatattttggaggattaaaatgacatttaaagattatttaaacaatattgctttaaatgaagcgttgaaaacggatgtgtctgctatagaggaactcagaaatagatatcaagaagtagccaaaaaaaagatggaattgcaagccgaaataagtaaactagaagctgcacagactacagcttactttaaactaggtggcttagctgcacagattgcacccgataacgttgataatgaaaaactcaacaaaggtttagaacaatacgacagtgaaattgagaatattgagaaaaagttagaacctctttataaaaaacgagaatctttactagacgagcttaaaaaaataagcagagttgctaataacttagtaacaagaaatgcaaaaaaaagctggtgtaagccctttgaattatgtttttaaacataatttatcattttaataaagttaaagagtcatcgtatagaattaaactctatacaatgaccaaaccttataagtagacataaaccttataagacgtatagctttatatgacccacatttactaataaacttaattattcccatttaattttatcgacagatttaacagtttcagatgaattaattttttcttttaatgtattcgctttaaatattacttcctgagtatattcggttacttttgaaacaaatgttaaaaattcttgaggtgtaaaattaaccttttcatcattcaagtcaatccaagtaatctcagttattgaattagtaccactttgtatatctaacaatatattagcggccattccgttaatattaagtttatccttttccctagtttggaatgtatggtctttgaatacaaaaccagattctaaagctacgtccctttttgtttgtatttcaaacttcttcttttctttaattatattaagtttttcagattcacttgcagtatttagtacatattcataatacaaatccataagattattagctaagcagtattctttgactgcttgtgtacccgcttgaatttcttcaggtgtaatgtcatctatatgattgaaattacctccctctccgacagtccattctaatttttgtgttaataatgtagagtatctgttatccgcttgtgtcaacacatcttgcaatttagtatcgatttcagatttatcataaacattacttgtgttggctttagtatctaatttagaatctacttcagatttattataataattagataaatctacacttagaactgcatttttccattttttagtatttgaatcatattgtaaaatatgattgtttgtcgggtcaacaatacttgcatcaattaagttagcaatacttgttttatgtgggttattaaagtctgtcttatgagtattaattaaatctacattaaaattctttttggcgtaagctaaattaatagcgtgccaatcacttgttgggtctgcaacattaaatacttgcgtttcagaaccacccagatttgcttttgtatttaaattattattgatgctaagaatgttattttctatattttttttaaattgggtatactcactatacctagtatcttctaattctttatttgcagcaatggtattttcagcagttgtcactcttctttctaatttataatgtttatcttctatatctttttcattagtacctactgtagtttctaatttggtaagcctagaatcattagcttccttataagtttcaaaaattatttttcgaaggaaattatcttctatatatttagaactgtataataaatcttttgaagcttcttctggattttcagttgtatgtctaaaaattgcttgaagatctattaattcatctgatgcttccatagtctccttagtttcagaatccatacaaatccaatatttaccattaactatatcgtgaatattagcgatataactaatactaggatttgattctttgcttattttattaagttctgttagaactttttcttttaactgttcttttgtgagattttctgatattaaaacatcaacttttttaaattgcatttttcacctttaaactaaagattttataagtctatctattcttttatcctgaacgatattattactagtattatttatgatcttaccatcagagtttattaaaataactctaccttgatctacgtctgttactctaacatatactggtgcaccatcatttttagcaactaatccctgcatttcatcaacagcttcttttgtaatttgacttaatgttttagttgtttcgtatacgaaatctattatttttattttagatgcttctaatgccatttaattttccttgtatattttttaccatttagatactaaattttcaaaagtatcttgaactgcattctgcgctgcgcttaatccattttttaacatattactaaaatatgaacttgctttagattgtacactatcattcccggttgtgttggaagtgcttgctaattgaatatttttaatatctgtattatcgtgatttggttggttcattttaaaactaacattgaattctataatttcattgttatcttgagataattgtatttgtgaaacatctgtcaacaatgcatcctgcgtctccattactaagatgtttttagaaccattgcttaaataaacctgaattagccaagcacagacatcattgtagttaccttttgaaatttgaaaagcattgacaaatctacgatacatactagcattatcaaaatctctgaaggtcatatccacttggtatactgggtctgcaccacgtgctaaaacccaagtccctccaattaataattcttcaaatctaccggtatattgtggcaaattaatactttttaaacaaatatctatactattttgtgtttcggtagggtttccccagtttataagattttggaaagtagcattaataggtttcataataactataaaatcagaggttttactccatttgatagtattaataacactagcaagtttatttaaggtaacagttgccatttatcctacttttttgtatatttatttgaacatcttttagagaatacttatatgaacaagcttttagtaaagatgtaatgatctctaaatttactaacaattcagacaacatttttaatcatattttaaaagtcttagtatatgatgataatttaaataataaaaaacatttaagagagatgtcaggaatagtaagatctttacaaaacaaaactatcaaatcaaaaataacaccggaagacttgtatcatattttctatggaaatattgaagaagattcgaatctgaaacaatatatcttggatttagagattaattacggttctcttcaaaaatctaagctatcagaaaatgagatacatttcagactagctagaatctttaaaagattatcaagtgagatattaacaaagtcattcaagtcttttgaaaaatatccagaactaagggatagattttaaaacaacaggctttgatataatttatacccgattatatcaaagctttaaatacacaaatgattgaatcataaatatttaaccaacgattaaaggactcaatttgaatttagacactatacatattgttaaaaataacggagaacgtgaaatattcgatgctgaaaaaatacataaacacttacattttgcttgtcaaaacctcgatgtagatattattagcattattaaagatgctagattaaaaatatttgatggtgccaaaagtgtagacatacaagattctttaattaaatctgcacaagaaaaaatcagtgaagattctccagattatgagttagttgctggtagattattaaatcaaaaactcagaaaagaagtttataaacaatacacaccattagattttaaatcacaagttaaagaacgtattaaaaaaggtttctatactgaagatcttaatgcttatagtgatgaagagcttgactattttggatctttaattaattatgaattagataacgaactaccttacagcgcattaaatcaaatgtattctaagtacttgatcaaacataataaaaaatgcattgaggttcctcaagaagtttttatattgataccaatggctattttttataataccgatatagaatatagaaaaaaatatgttaaacttgggtatgaattattatcacagcgtaaaatttctttacctactcctattatgaatggagcaagaacaagttataagaaatttatatcttgtaatttattaaactttggtgattcagttgaaagctttgctaggggtttagaagctgttttaaaatgcaccagtgctaaaagtggtttaggtatcaatacaagtttcatcagaggtttaggagctccagtaggtaaaccttcaagattagatcatactggtatgctgccgatcgttaaagccattgaatctgctacgtctgcgctgattcagcacggcaggggcggtgcaagcaatctgtcaatgcctttctttcactacgaaatagaattattttcacaactaggtgattctaaaggatctttagaaaatagggctagacatactgatcaaactattatcatcaataaatggttcttagaaaaagctcttaataaagaggatatatttttattccatatgaatgctgtaggtaataaggatcccaaattagatttatatgatgccttaggtgattataaaagattcgatgaattatataaacattatagcgctaaagttcctaataaaagtaaaaagaaaattaatgcttatgatttattatctttaattataaatgagagaatgattactggtagagtttatattgtttttgcggataacttcgttaattcaagttttaaagaaaatctatatatgacaaatctttgttgtttagcaggtgatacaattgttgaaacttcacaagggcctaaatttctcaaagatattaaaaaaggagatcttgttttaagttataatcaagatacaaaaaaatatgaatacaaagaagtactagcagctgttttaacaaatccggaagctgaagtttttgaagtagaattcaatggtaaagtggtcatttgcactagtgatcataaattcttaacccaaaggggttatattgaagctcaacatcttttagaaagtgatacaatagtagaatgttcctcccgtatttagaagaaataacatatttagataaaccgaataaacataatcttaatttctttagaaaaacatatttaatggatttctttgaattaggattagtattcgacgaaaatgaagatttaattggtattaaaaatgaagatactacatcaggctatttaccactacattttaatagtatattagaactctcagagtttttatatgcttttaatggcgcgtgggtagcaaagaaagtattggatgattgccagaaaatggatatggtgattaagcaaatgtctgaagaactcggtataccagaagaggttattagaaatggcaagtttcaaagaatatggcaagtttcaaagaaagggctattttaagaatggctacatttagacacaataacttgttatattatgttataattgaaaggagaaggggtgtcaaaggtgaccatacttgtgtagaaccacattttggtgcttttgtaactgatatagaaaatatcttaaaaatttctgatactaagcaattgttgttacaactcaaacacagaaaggatattttaaagattttaaacccagataaaatagaaacaaattctcaattagttttatcctatgtattaagtgttctaagagattatattaaagaacattatacattgtttattaagcttgtgactaatgaagaattaatgaaaaaatatataaaattattaccttatgtttgtactgatttaaagtatactcctatagatatttcaaatgaaattagaacggattttgatggaactaggaagcgttttcttgtgctattgctcagaaaatcaaaagatttagacaaacaagatgtactaaaatcacttagtaatatcaatttaagtaattatatattataataacaataaaagaggtgctatgataaaaataactaaaaaaactgaaaaaatacctgtatacgatatagaagttaaggataatcataacttttttgcaaatggattgtgtgttcacaattgtgaaatatctgtgcctagtcatagtttagataattataggggtataccaggagaactaggaacttgtatcttaggtaatataaattttggacattctaaagaatctgacatcccaaaagttgctgatttcttagttaggttcttagataatatgattgatatttctgattttgctatgccagaaattgaatactcagctacaaaacgtagaacattaggtattggtgtttctaacttatttggatatcttgctaaatcgaaattattttacaatacaaaagaagcacgcgaacatattaatgatttaatggaattattttattttaacttagttaaaacttcaatagatttagcaaaagaacgaggtgcttgtgaattatataatgaatctttttatagtgataataagtttatattcgaaagatatttagaagctgggattaaacctgaatttaaaacaaaattagattgggagtcacttcgtgaagaattatctaaatacggtatgcgccattcaagcttgtcagctgtaccgcccgctgggaaatacttgtaatagagaatcaacagttcaaagccaagctcagcaacacctggtatcgaacctccaagagaattagtaactattaaaacagaaaaaagttctactgtaaaacagttggttcctttctataaaacagccaaaaaatattatacgactgcttggggtgttgactttaataataaagattatcttaaattagtgagtacaatacaaagatatgtagatcaaagtattagtacaaatcaatattataatatcgtagaaactaaaaaagttaatattgaagatgttatagaagaatttatagaatgcttcaatttaggtgtcaaatcattgtattatgctaattttagaactacagatgatgcagatggtgatcaagtaattgaaggttgtgggtctggaggttgtagcgtttaaaaacttttaggtttaagcttttaagactttttaagcttaaactttaagattcggtttgtatttcagaaacttttaagttattttatattataattatttcattaaaagataaaggagataaaatgaaacacattacaaaaatatttttaggatataaaaacgacaaagcatatttcaatagaacacaaagacaaattacgtgtgctatcaaaaatcttgaacgtttaaaaccttcatttaatattaacgaagctagatttgaagaaatctacgaagctaaacaaattgaaacaaacccaaatatactttatattgctgttacagacaaacaatatgtaattgtagccaatagtgattggcgcggtaatatcacattagattataaaaatattgattttggtgtagaaagaagtctacaaatatcaaggcttaaaagattatttagagctggtgttagaatatggaaatgtaatacttacttatatgatagaaaacgtaaatccataggtttgaagaaacctagtcttgaagatcgtttagcagaatataaaaaatctaaaatcaatgattttaacaaatattgcttaaataaattaaaaagtgttagtaatttaaatctaaatgtaaacaatattgaagatttagattttaataatttagaaaaacaaattgattttatgaaagagttgttatattatactaaaaaatatattgcgaatgaaaaatataaattttgtgatgaaccttattttgaaagcacaaaaagaaaaactatgaatgctattataaatttaaagatttgaaatacattcataatcacacaaaaactgggattaaacgatgatattagatactaaagcagatatattagtaactcatagttttcactttaataatactaaaatgcacggattatcaggacatttatttgaagtattagattattactggtattttaaaaataaaggtgttaatgttaaatgtttaattccagaagtagtaactaaagaaacttttaatgatttcgtaaaaggacactatagtgtagattttgatttaaatgatatatattttttagatactaagatattagcaattaaagctagaaatatactagtaaccgatggtgggtattggtttttaaatcaatataagtctaaattactaggtaaagtattttcgtttgcttgtggtcctagttttttagaatccgaagataaaccagaatatgtgacttttttagcagatcataaaatatatcctggtttgggaataaattatactaagaaggtgttaccccatttaaatcatataccaggagataaaccttttgctcatattactaaaaattgtagggcattatcagaatctcaaataaaagatctaataagagattatcctgatattgtaatgtatagtgattatttgaatatacagaattcgacaaacaaacctatcaagaattttaattttagtaagtatgtgtatacgcctattatgagacattttgattgttcacctagacttataatagaatgtagaatattaggtatagattttgatttatggaatatcaattataaagatcctggtttagaaagacgtttagaaacagatctggatcaatttatattggatgggtccgacacaattataaattatttagtttaaagtttaaacattactatagaaaaagaaaatattctaaaaagagacttaatatggcttttataaatgataaaaaagcacacaaaggtttaaaatgaataaaatagacttctcgggttctgaatgttcatatgaaaaactactaaatggaacattagagtttgaaggtattcgagctgcgataatgacaaccgataaatgttgttttagttgtgaatattgttgtaattcaggttttacagattttaatgctgctaaaaatactaaaagcgaagcagatttaaaatgttttaatttggttaaagctatatttcctagattaaaatccgcagttttatgtggtggtgaaccactaatgtgtgattatctttatgattatttagacttatttaaggatctaaaagacgtaacaattttaacaaatctattatatataaaagatcattataaacgtctaaaagaatatagaaacctagatttagttacaacttatcacgcttctcaaattaattctaatcaatatattgaaagacttaaatatttcttagacatagatttaccaaaagaagttaaattattttttaaccataaaaaaccagatttaatagaaagaactcaaaatgttaaagatttcttagaatctcaaggatttactaatattatttgtactcatatttcaggatttggttttagtaatccaaataaaaatgtagcaggcgttgaccttaatgcagatagagactacgtaatgatttctcaaggaactaagaaatatatgaatgaatctgagtttgcgagtcaaaattatctcggtatggtctgcaatggtttgagacttcacgtttacccagatagaatcattgaaaattgttcaagaaaaactttgactgtagaagaagttctaaagttaaaagattatcaagtttgtaaattcaaaagttgtaatgttggtatgtgtttgaattattttaataaatacaatgttaaatacttaaagaatatatcgtaaaataaacttgttttaaataagcttaaatttaatcttattttaagattattattatataataacagaaataaaaaaggagataaaatgattaaaaacacaaaaatacaagaaataaaagattttaacaatgatttaatatctaaaatgttaaaaaataatccacattttgacttaaaagtagactatagaactcaatttgtagtttttaaagacaactcgataatagaaagtgcttattatcctactaaaatagctacttgtgaatatggtgtaattgaagtagatgaagatgcttcagatggcatctcaatatctcacaataaaatagaattttttagaaatggtgtacctaatggtttggcaatagaacttattgaggataatgaaaccagaatcaaaattagatttgatttgcgagatcgtaatattttctatgaaaactattacgcttgggattgttttggaaaaagagctttcacttttagaaatgatttaaatcgttttaatgatcgttttatgactaagattaaacttaagaattttttaacaaaaaactttgatttatttaaagattttatcaaaagttctaatgaatatttagattttattaataaaagtttataattaattatagtcaaaggagcttaaaatggaaataattaaatctgcaacttcaggtttcattaaatacacaataacgttatttttattaggatttttttcaggtatagcttttacattttttatgactaaatggtatttcgaagatcgtggatcaactataggttatgaaattcaaagagccaatatgataaaaaattgtataaaagaagttgacgtttccttagaaataatgaaagaagaaaactcggttatagatgcaacacaaccattaaactaaatataggatttaagatgattattgaaataaaagattttccattaaatgttaagagagtagttttagaatttgatgattctggtgcttgtacgatagaaccagaaacaaaagttaaaaaaaatctaagatttctaaacctattaaagaagttgaaaatgattcagctgatatgactgaaactgaacctgttttagatattaattttggttctaaaccagtaaaagcatcaaacacagaacctattgataaagttgtaatcccggatatagaaagagaagctaacgtttcagctacaatgcaaaacttgaaactataaagtgttatgtgttaacactatagtgtaaaacttagaagcttaagaatctcttaagcttccgtaattgcaaacttatataacatcggagtagttgcagaatgtaaagggtgtattgtatatgcatttcttgtaaatatacctacagttctttcacctgatttataattataagcagttgttaagttcatacaatatgggctataaatcaacgaattaacacccttttctttatgagattttaaacccacataagcattattatcatcaggatttggatttaaataatatcttgtattattaatcttacctaagaaataatcattcgctctattttcatctgttgagtcatctattcttgaataagtaaaacttaatgataatataccacctacaccagtttgtggaagtatacaaaaactatcgtatgttctaaaattaggtgaattcattttaataactaaatcatttacctttttagatatatgaaataagtttgtttcggcattttgtttagaatcgttgttatcatctaacgtaataccttctgattcaactgcattttctttaataagatttataattttttcagtttctttgtgtgctgcagaagacttgacccagttaatgaataattctggtgtttgttcatttccggctttattaagattacttaaatttaataaatcttcccaagcttcctgtgatattttgataatagatttattagtatcaacatcaatttgttttttaataattttaaatgtatcttgagtttcttgtcttgcgaaaacatatccagatggttgcatcataggttgaacttcagcaatgtgatgacctataaacgatttgattttatcttttaagatatcacctaacataacttggtaaaaatctgcatctataccttcgctaattaagtttgtagtctccttaagagaattttctaataatagtttatacattttggcctctatgtatttttaagttattaaacattttaatagtttttcttgcttcatagttcttctcagactttatctgagctttctaagaactccacaagctttgattttttaaagtggttccagctgttgtatctgtagccactgtattttttaaagtctcaagataaaattatattttaatttgaattcttcaaaatcttataaatacttttagttttagacatatcaatcctatgtttaaaattagagaaataaagaaattggtagtttctttatttctcgttttattatatttaaatttcaaaactttcaatttttgaaaattctaaaataatttctatatttatttagtttaatatacttttaagtccagaatatataatatttgatataaattatatagtttttctcaatttcttaaggttgccttagtaacacctataattttagaaaattctccaataatatacatttaaagtctttttaagaaaacttataatataattatagatatttatatattcttatatatttcacaaattatattttttaagttattttatattataattatttcatcaaaagataaaggagattaaatgaaaaactttaaatcaaaattaggtgataatagatttacatttgacttagtttacacagttgtagccgtagtaatgatgatagcatacccagcttattttatttggggttaaaatgaacttcgtaaccaaagattatatgttaactgcagaaatagcggataaattaaatataagtatgactaatatttcaaaatggtatgtaaaatttccagagtctgttactaataaacatttagtaagaataggtaattgtgtgtttgttcacagagactttcctaatttaactaagaatatgaaaattatttttaatgaacccagaatagattggagtaataaattaccattgaattatatgattaaaaattttaaaattaatgttgcttattgtgaaaaatataatataggtcataaaacaagttatatttttaaaacacatagaaatcgtgtaattcaaaaagatttttttgcatttgaccctagtattttaaaattattaaaagctactgaattagaatcaaggaaggttgctagcttaaattcaattcaagtttcaaagaattacttcatttgtttttgattatttaaaggagtaaaaatggattcaaaaagctttattaaaaaacaagttctaaaaatcttaaaagtaactaatatagaagaagaaattcttcataaaatgttcgtagatgaaggtgttgatgccgatttcttgatacaagttctgaaagatctacataaagaatctaaaattaaagttctaattaaatctgataattgcttgtttgaatgggattctcacaagccttatattaaaggtgtttattatataactagtaaaatgtaaacaaaggttctaaatgacaatatatagtttttcgaaaatagatacatataaaaaatgcccaaaacaatattattatagatatattgaaaaggttccagaaactcaaaagaacccagcattaaaaaaaggttctgatatacacgaaatacttgagtttcataacactgaaaaatacaatgaagttcttaattcaaaagatccagaaatacaaaatattacattaagatttattgattctgaattaggaaaagaaatactatccagaaaatctttaagagaatatgaattattcttagattctaattatgaaccttgtagcaaagatactgctatttttgtaggctatattgatagaattaatacgactgaaaatggattagagcttatagattataaaacaggtaaatataaagaaccatcttatcaagattttacacaattaattttatatagtttatatatatttaaaagacttaaactaaatgaaataaaaataagatatgtttatgttgaacatcttttagaaaatactttaagtttgtctcaagattctgcaatttattggcaagataatcttaataatcaaataaaatctattgaaaattctattgaatctaatacttggaatagcaaaccaaataaattatgtccttggtgtccttatgcaggattatgtccagattttaaaggtaaacctaaatgttaaaaaataattttaaaaaattaaacgaatcatttagtttaatatctttaactgatgaccaaaaagctaaattaatatttaagaaagatattcgttataatatatgggctcaaatgaatccaaaattagcttatgaatacttctataaagatttcaacaaccaacaaattgtaccaaacggtgttttagaatacctgggtataacaactaaaccagaaattaatgaaaaattagattcgcaattggaaataattataaaacatttagaaccatttccagtttatgattatcaaaaacaagctataaaagatgctatgcaatttcataagttattcattagagcagccacaggtgctggtaaaagcgtcattattggattaattgctaagattctaatattaaaaaaattaaaaggtttgatactcgttcccaacatttcactaacaaatcaatttaataatgatttaataaattataaattggatatagaaacaagattaataggtggtgaaaataatattaaatcttttgataaaccattaacaattagtacttggcaatctgttaaaaactttaaagaagccttaaatgatttagattttattattgtagatgaagcacatacagccaaagcagatcaaatatttgatatttgtaataagtgtattaatgctaagtataagataggtttgacagggactattccagataatgaaatagatgctatgagattaataagtatttttggtttaccaagaacatatattacacccagaggtttaatagatagaggtctggctacaaatgctattattaatataatagatcttaaatataaatttaattttgaaggtgaatattcaagccaattgaaacaattaaaagaatacgatccaagaaataatttaattcaaagaataggcgatactgtagtcagcaaaggtaacactttagtattattttctcatactgaacacggtctaactttattttataagttcttgaaatccagaggattaaactacgataaaaagacttataaagatttggcgtttcaacaaagaaataatgtattttttattaacggaatgatagaaggttcgcaaagggaaactattagacaattaatagattcagtaaacaatgctatcgtagttgctaattatgcgacaacttcaaccggagtaaatattaagaatttacataatttagtgcttgctagtccactcaaaagttatgtcacaataactcaaagtattggtagattattaagacttcacgattctaaagatattgttaatatatatgatattgctgatcacaatggtttttttaagaaacaaataaatgctagaataacaaaatcttatgaacctgaaggttatgaaataaaaagatttacttacaatatataatattatattttaattttaaactaaagttctaaaatttcagcaagaattaagttcaaatatattataattctacatagctgtttaaaaggggattgatagtcacggtgacggtaaatacaataagggtattgtagacctaagagcttcctagcagctcaaaccttttttacggcttagattaattttaaacttagatctaaacttgctgctatagtgttaaatctttaattagttctaaagattgacactatagtgttaaatatgtactttaggtttaaacttagaattaattttaaaaggagatacaatgttaatacaagttaacgaaaatacaactgttaaattatcagcagtttgtaatattaatgttttgaaagacaaacaagttttcaatatgtgttatactttcacagataaaaaaggagcaatgagtggttattattatgtagataatagtaatataaactatcaaaattctaaatacttcaaagaaaaattcatagcagttcgtggtattgatagattaatatatattaacacagattttgtaagctttattaaaaaagattacgcaaattacccaaaagtggtaattggttttagtcatagtgtattaagacacaatgtcgaatcttttgcatttgcacccgaatatatgtatattagaaccaaacctgaagatttagattctacttatgaacaaatcttagaagctattacaaatatttcaaaataaggaggtaaaaatgagagatgaatttgatgatttgttagcaagcttgtcaatagaacctgttaagaaacctgaaatagaatatcaagaaccattagttgttaaacctgcaagcaacatagaagttaatggagtaaacgagcaaaacgcagatttaaatgattttggtgatgttcttaacagcatcgaatcaggtgttagtaataccagcaataataacgaaaatatggtagctagctcagattcagaagcttttaaggaatatatagatctcagaaatattaaaaatgaatcagatattgaagttcctgatttagtggatacaatgcatttagaagaagcgccaagtttaataccagaagcacctagtgaacatacaaatcaaacacaagaatcaaaaccaagtggttacgaagtcccagatatcaagggaactatcaaaagggtaccagatgttgacgattctgaaaataatgtttataaattagaaactgaatatattgatattatattaagttatgaagaagaattaaaagatcttaaacgtcgttttaaacttaatacattagaatatcaagcaaaaggtgttcagactaggttagttattaaagcagttaaacaagcagccaaagacgctaaaaaagaaggttatattattaaagatgaaaatagaatccaagaaagaattaataatgattctaatttattaggaagaatttgttcaattattaattcatcaatctaaaagtttaataatattttaagatattttatattataatacactaaagtttaaaaggagatatatggttcacaaaagtgttcaagattattttctaaatgaattaactaattattcttgttatagtactttaagaatgatagctagttctattgatggtttaaaaaattcaagcagaaaaatcattaacacagcattagacaaaaaattaaatacagaaactaaagttagtatatttgataatatggttcaaagttatacacaatacttgcacggttcgtgttcaggtgttattcaaaatatggctgcaagctatactggttctaataatattccattgcttgaaggtaaaggtaattttggttcgaggtttattaatgagccagcagcaccaagatatgtttatgttaaaaataaaaaatatattaatgatttatttgatattaaagatgtcttgatttctcagaattttgaaggttcagaaatagaaccagtattttacgttccaagtttgcctatactagttttaaatggttcaatgaatggtcttgctagtggttttaaacagaatattttaccaagatctttggattcagtaataaaatatattaagacaggtaataaagttgatttaaagccgtatattgcaggttttaaaggggctgttgaattagtagaagataccagttctaataatacacaatggaactttataggtgttgtcgaagtcaataaaaataaagcaattataacagaaataccaccatttatcgagtatacaaaatatctcgaaatattagataatcttgtagagactaaaaagattaaaaattataaagacttgtcagaccaaagaaaccaagaatttaaattcgaagttatatttttcgataatatctctaaagagaaagctatcgatatattaaaattatctaaaagagaaacagaaatatataatgctttggatgaaaataatcaagtcagaacttttgaaaatattgaatctataattgattattacatagacgttagaaaaagatttttggttaaacaaaaagattttgatttaaaagttcttgaaaatgatttaaatattaatattcaaaaattaagatttgttaaattaatcattgattcagagttacaaattatgaaaagatctaaaaaggatattgaattggatcttgaaagtaaagagtttattaagtttgagaatagttatgattatttgcttaagttaccaatacattcgtttacaaacgaaacttttgaaaaattagtacaaaatgctaaagaaatcaaagctaaatttgaaacattaaaaaatctggatacatttaaaaattatgtcgaatctttagattctattaagaacatattaactaaagcttaagaggagttaaaatgagatacgaagctataaacaataaaacaaaaattgaggattctgaattggatattatatctacaaaagatacgaggcattcattatacaaaaaaagttttaattatactaattatactttaaatatcaattcatttgatcacgaagaaggtgaattagaaaatatttttgctgatcttaatgacgctaatgaaggtgattctatacaaatctttatagccagtgtgggtggttttgctaatgaacttaatagatttacaaatataattagaacaaagttctatggtaatgtaacaacagtattaaacccatttggatattcttgtggtgctatgatgttcttaattggtaattcacgtgtaatttatgagaactcaagtattatgttccattcagtaagttttggagtttctggtaaacattcggatgttaaaacgcaatttgatttttctaataagtattggaatgaatatatgaagtcattattaaatccatatcttaccaagaaagaaattgaattattaatagatggtgttgagttttggttcgatgcttatgaaatgtgtaaacgtggtattgctactcatattaatgtttttggtttaagtatgaaagcagatgcttattgtgagtacatagataatttagattatagaatagagtttcttgaatatattattaaagaaggtgaccttgattctattgatttacaaagggctgaaattgagttagaacaagctaaaaaagatgctaagaaagccagcactactaaaactactaaaactctaaaactactaaaactactaaaaccactactaataatgaaattgagtctaaagatcttagctaagatctttaggctttaagaatctttttagttcagctatattataatcatatataacacctaaggtaataaaatatgaaaataacaatctttggaactgcaagtaaaaatgaaaagtttgctaagtcgccatacgatgacaattcttttatttttgaaacaattgaagtccaaacgacttaccaagcatttcaactacttgttaataatttttgtttaaatattgccttagacttaaaaggacctggcaaatccagaagattaaaaacagatttagaacctcatataattaaaacatttgatcatttattatttgattttgaatgcaaatcagagtttaataaaaatatggcattagactattttaagagcacacaatgcactatcggtcaatccagatcttatgatggtgttaataattttaatttaaaaggtattattaaaacagctccaatgagcttaaaagaactaaaagttttgcaagctaaaattcaaaaagaactttctgagtatggtaaatatactactgatacattaagaataacttattatacagcgcctttgaataaagataatatactcttggataacccaaacggttctatgttaatgcctataggtacgaatgttacagattactataataacatagatttagattgtaaatttaatattacctctaaagaaactactgaaatatgcaaaacaatttttaagaacctgggttttatcttagtagatatcaatgctaatggttctataaaatacacaaaagattctgaaaattatatttggtacccaaataatccatatattatgaatcatactgaaagttatatgtcagtaaatatttggaaagaagctataaaatatgaacctacttttgatataactccttatatagattataaagcagatattgtagttgatagaaactttacagaaattaagtctgaattagattcaattgtagaagcttttttgtttaagcataatggtgctctgactttgagagctcctatgggttcgggtaaaacaacttttatagatagaattatagaagcagcactagagagagattttaaggttgcaattataactaatagagttacgttagcagaagattacaaaagaaaatataagaagtttttatattataaagattatactgatgctattaaagccaaaaataacaaaaaaccaaaaatagttagatcaaaaggtaaatccttaatttgtcaatacgacagttttagacattttgatttagatgactacgacctaattatactcgatgagtttatgagtttattaatgcatacaagatctgcattgaatagtaaaacagagaacttaataaaattctatactgctttaaataaaaaagttgttgtagctgatgcatttttaagtaaatacattgtggacaatatgtttactaaacctttaaatgttgttagctatacaaaaaataatacagaactttatagttgcaatgacagcaataccttttatacattaattaaaaatgctttagattctaataaaaaaataactatttctacaactagtataaaagttgttgatattattaaacaaatgtgttatatactaaataaaaaaataattatttttaataaagaaaccggctcagtatcaaaaaatattatatatgataaaattaggtctaaagaagcgctagattgtgatgtctttatttacactccagtgttaactgtaggagttaacattctgaatgatgttgatatacattttcattatgatagtgcaagttctacagacgttattagttctttacaaatgttaggcagagcaagattttccaaaaagataatttactatgttatgaacaaaaaatataatgcttgtattaattatgatttattaaaaactactgtagaaaaaaagcctaaggagcatactgatgattctaaagacagagatgttgaatataagaggggaactgttaaaaatcttttatatcattttcacgtaccacctggcaaagattatcaagaattaagccatattggtaaagcttgtctaaaagtagacgtttttaacaatatgactttatgtgactataaaaaatcttttgatgttttattaagttttaatttcagtaagatacctattgaattaagaaaaataggtggtgatattttgaaattaatgaatattaaaatacaggattcgaaagattccgagctttagtttaagtttaaagctttagtttaagtttaaaattagtccaaatatattataattaaaaaatcaaataaaggagttgaaatgcaattaatagatggctattacacagattctaataacaataaatgggattcttctatgtatactgaagaacaagcgaaagaagcttctgagtctttagtagtttgtaaagattgtttaaattgtttcaattgtattgattgttataaatgtattgattgtattgattgttataaatgccgcgtttctaaagattgtattgattgtaaatcttgtattgattgtattgattgttataaatgccaaggttgctttaaatgccataaatgcgtttattgtttggattgtcacgaatgtgtggattgcaagaggtgtcgagcttctatagattgtttgaattgcattgagtgtgcgaatacttcgaatgaatcacatactcgaaaatcacatacagtattaaaaatatataaaatcttaaatgcataaaatcacagattcataaataaactaaaaggtgataatgatttatattacaagtgatttacatatatctcatcaaaatattataaaatatactggtaggtatattgatgatgctttagaatattcaaaagaagttcataagtattttaaatctgttttaaaagattctgatattttaatgtttttaggagatttagattgtggtcctaataaaaatatagaattcttaagacactttattagttcattaccaagcaaaaaaatttttgtaagaggtaaccacgacaagtggttagatactgaaagtattttatatattggatttagtgcagtttctgatatcattagatataaagatactttgttttgtcattatccgttagattcaaaatcagtaatacctaaagaagctccagagtttttaaaatcatatgatttaactggtattaaaaaaatatatcacggccatactcacaataattggatagtggattctaaagatggtattgaaagaattaattgttgtatagacagaaatccagaagttattggtgctttgataccattcgagcctaagacttaaaagcttaaaataaaaggatattaaatgaataaagtttctgaagttaaaaaagttacaagagttttccaaggaaaatctgtgtatgattgtttagttcgttggaatgatgctaataaatttgtgccttgtacagttgatattcaaaatccaggtgacctgaagccattagcagattacttacttaaacataatcttatctctggtctttaataaaagaccttaccaaggttcgtgatgcatagtgatgttatccaaactctaagttcagcaggcgcttacttacctaatgacactatatgtcctagagcaaaactagacactggcacatactgcaactatcgttgttatttttgctattaccaaaatgagttagataaaaagacaccatttgaagtcattaaaaaaagaatagatactttgtatagtataggttgtagagattttgatttaagtggaggcgaatcttccatacacccagatttctttaaaatcctagaatatattaaatctttgaatccagataataaaatatcttgtttgacaaatggatctaaatttcagaataaagattttcttaaaaaagcaaaagatcttgggttatctgaaatattattttcattacatagtgttaatgaaactcacgataaaataactgggataaaaaattcttataattatataattaaagctattcataatgcaaaggatcttgatattgttgttagattaaattcaactattactgatgtaaattataaattagttgatactgaatatttcgaagttgttgaaaaattagaaccacttgaaatgaattttctaccattgaattattttagtcagaattcaaaatcaaaaggtgttaattattctgagattttagaacctataaaaagatttgtagattcatcaagtatacctttgatcaatgtccgatatgtcccgttttgttatatgactgggtatgagaaatacgttgtaggatattatcagcacatctatgatatttacgattggaatattgctatgtatgaatacttagaacctaatttagtaaatttagcaaaacaagctgcatctaatagacaaaaaagttataggaaatgtgatgcttgtagaacttgtaagtatttttatatctgtgatggtattgagcctcaagttcttaaagcaggttgtgaatttaaacctattcaaggttctaaaataaaagatgttaatacatttagaaaatcattctttaatttttatagtttatagtttttgaccttaaactttagatttttaaactatagttttattttttttaacattttaaaaggagtgtaatggatatttcattaattataggacctatgagatctgggaaatcacttgaattgttaagacaagcagagaaacttcattttagtgacaaaccttatgttttatatagacccaaaactgacacaagggattttatatcaagaagttttagacctagtttagacttaaatatacaatactatagcaatgaaaacttcagtgaatctaaatatgattatatattattagatgaatttcaattttttgaacctgaaattattaataatatattagaatctaataaaacatttgttttatgtgctttacaaagtggtactaataatatcaatgaaccttataatgtagaagtctttagaaatgtcaatagaattatgccattttgtagtgatattagattgttaactagtatatgtgaaaattgtggcagttcttgtgctacacacagttataccgatgttatcactgtttctgataattataagattctttgtaataattgtttagattttaagatttcaaatgctggtatttttaagagattaaaaacttgaagcaaaacttaaatactaaaaagcataaaaaatgcttaagtttttagtaggtatatactatagtataagtctaaaacttaaagcaatattaaaaagtataaaaaatgcttaagtttttagtaggtatatactatagtataagtctaaaacttaaagcaatattaaaaagtataaaaaatgcttaagtttttagtaggtatatactatagtataagtctaaaacttaaagcaatattaaaaagtataaaaaatgcttggctttttaatagtatatactatagtattatatctaaaacttaaagcaatattaaaaagtataaaaaatgcttgcgttttagtagtatatactatatatactgctatatatactatagtattatatctgaaacttaaagcaatattaaaaagtataaaaaatgcttggatatttcatagtatatagcatatgcttaaaacttaaagcaatattaaaaagtataaaaaatgcttggatatttcatagtatatactatagtattaatattcgcttaaaattttaagtatattttaagtattttcataatataatactatcaatagaataaacaaaggttaaaaacaatgaataaaaccgataaaatgattgaagctatcgaggatacactattaagtccggaaaatttaggaacacatttctatgttttagaaactataaaaggatttaatttcagtattaagttcgataaaataaatagctctattaaatattttactaaaagtaaaccaattaattttgaatctaataaaagtccaaaaattaaagcacttaatgatactattgatgaagttagtttaattaacaaattggttgaattgattaatattaaatacccagaagatgaccatattgagttctttttgacattatttcctattggagtaagcaagtctaatgattctgataccgcaggatatgcagtcataatgtatgacattttagtcgaatccaaatatgaagattttgataatgttttagattattgcactttagctggtatcaaaacgaatccaattattagaattgcaactgatttagattctgctttaagtgttcctgtaaatggtgattctatgattccatatcttttcaataatagttcggagtcgatacctatgtatggcatcaccatcagaccttataaggaattgcaatacaaattaagatctaaaactcatagacttattattgatcttgatgagtctaatatgccagtaggttctaaaactgaagattcagaatttcttaaatttttaaacatagaatcattaaatgttgtaaaatctcaaaatccaaaaaatttagaaacagagctaatatattatataatagaaaaaataaatgaaataaaacacttaagtgtagaagaaattaaaaatctaaaatcaaagtactcacaaagagttaaagatttcatctctgtgaactaaaacactaaaatgttaagtttaaagaactaaaatataaatcgaagaacgaaaggtgtaaaaattgtctatgaaattttttgtaaccggatccagtggtttcctaggatctaactttattaaaatactatattcattggattcaaatccaagagtaattggcttagatgtaaatccaggcgaatatactgatagtacacaaggtattaaaaatgctaagaaatctgggttgcttaaaaacttaattaaaaatagtgatatagttgttcattttgcaagccatttaggcgttcaaaatattgtagacaacccaaacttaccttttaaatcttttaaaaatgataaaattgttgtagacttagccactaaatacaataaaaagattgtatatttttctacttctgaagtatatggtgattctaaagattactcagaatccagtgatttaattataagttctaaattaagatctaattatgctttagaaaaactttttatggaaagatatatccaatcaaaaacaaataattatttaataataagaccttttaatgtttacggtcctggtcaaaatccaaataatggattcattgctaaagtattagcagcagctttcaatcctaaagaagtgattaaaatcagagtcgatgctgagccaaaaacagggactgaaagatgctattgttatgtagatgactttaataaaattctttataaattaattaaacaaaatgtcagcggtgtgtttaacataggaaatcctatggctagagcaaatccattaaatatcataaaaatattcaatgattttgggtataatataaaatataaattcgaaactattgaaaatgaaaatgattatgaaatacaaagacgagttcctagtattgttaaattaagcgaagttgttcatatcgattttacaaatttaaaaactggtattaaaaatattttgtattatattgacccaccattttgagataaaatttaaaacctaaaatcaacaaggagtaaatatgctaaaacatttaataattgcaggtcatccagatgatgaggtaattggttgtagttctatactactagaagattctgttggtgttctatacatcacaaatgattatagtactgctaacacagaacgtaataaagtcaaagataaattagctttggattatcaaaaatgtttaaaatattcattttttaaaatgcctgatattaatgaattagctgataatattaaagacgttttagactccattaaaccagaaaatgtttatgttcaccatccaaaagatttgcatcaagatcataatactattacaaaagcaaccctaatagctgctagaatgaatagaaatgattatattaaatctttaagttattattatgttgaaaatccatttgaattaaaagcttgtgaatttaaaaaaatagataaagatgaaaaacttaagtttttatctaaatataaaaagtatataccagaaaatcatatcaaaactattttagcttttaatgagttcgtagggatttatagcaatttaggttttgcggagccgtttgaagttgtttataagcgttcttaattacattaaatctaagaaaaccaaggaaaataatgagtgaaattataatgattcacgaagtaaatgataaagttctcaaagctgtagaatctttagacccagacagcataatcacatttgatgatggtttatatacacaatttcattatagaagtcattttgcgttatttaaacgtgttatattctttgtaaatccgtccataatttgcgaatcttccgagaaacaatctaaagagtatatacagtgctataacgcccataaaaaggcatttaaaggctgttttgaaaattatatgacattagatcaaattcagcaaatttcaagggaaaatatgtataattttgaaataggttcacattcttataatcataaatattttaaagattctaaatctttaataaaagatattcaagattctttagatttttttgagaatcataatatacctattaaatcattttgttttccgtataatcaagattcgagaaacccacattttacccaagcagttaaactaaagtttaaagatttggatatttttggtaataacagagtacctatcgaatctaagttctaaatattaaatattagactaaagtcttagattttagactttaacaatacagcaaattaaggagcttaagtgaaaaatattaaagttaaattaatagcagattctggtatcaatgtttttattgacgctgtcagaacttgctgggatagtcatagtaaatgtgatactaatggtgataatgtaggagaaaatgataaagcattaatagatagaatagtacacaaacataaacaccattctacattagaacatttgttttataattttgaaatcacaggaatttcaagactttgtttgcaagagttggcaagacacagaatggcttcattcagtgttaagagtacaagatatacactaaaagaacttagaggtgctgatatttctacattagaagatgcaagtaagtttattgttttaactgataatgaattagtagatgctgcaagccacaaaaacttaaaagaacttcataacatagtcaatacaaacggtattacccaagactacgccaagtattgtttaccagaatgttacagaacttcattaagattttctttaaatgctagaagtttaagaaatctattagaactaagattatctaaaggtgctcatttcgagattcggtatttggctaaattgttgtttgatgcattaccagatctacacaaagaattaattttcaatgatttagaatattcagaataaacataaggagttaaaatgtatgttacaaaagaagtagacgtagaagttgaagttgaattagatgaatttaaagacaatgacgtcttaagatatgctagggatttaattgaagtcgataaatctaaaatagtattttttgagggtcttatagaaccagaatttaattttgattttttaaatgatttatataatatagaatacaaaaaaaattattttgaatcatttcctaagcataaaaaattaattgatttcataaaagatagatatataaataattataaaaaattataaataaaagaaaggagtttagaatgttatctagaaagataagaattgatagttttatatctgatgcagaaaaatcagaaatatttcaatattctaaatccctttctgctgtctataacgtatgtcttgatacgctcaaagaaaatttaaattttaaagatttatctaaaatcacaaaaggtaggtctaaaacaacaggcttgcattcaaaacatatacagaatacctctagagaggttataaatgctgtaaaatcttatctagcaaaaaagaaaacagataaaactgttagatttccaaaattatatagagaatatagtcctatcattatggatataaatctttcttctaagattgtagaggttgttaattctgaaacaggagaggtaactcttgtaaagaaatattgtccaggcgggggatttaaactagaaggtaagaaaataaactttacttcaataggatttgaattagatttaagtaaatgcccttactatgatatagaacttatcaactatgagactttaaaacagatagtcatcaagattgatgagaataagagaatagattgtatttttgttttctcagagaaaaaacaagaaaaagcactaaatcaaaattttctttctatagatctaggaataagcagtacagcatcttgctactcaaataagattgattgtctgaagatacaaactaagagatttaaaggtttagaaagagctataaatgaacttaagtctaaaagagataagaagaagaaaggttcaagagcatataagaaacttaacaaaacaatcagaagaaagcaagcaaaactaactaataaaagaaaagactatctccataagacctcaaaaactatggtagatctctgcattcttaatggtatagataacatcatttgtggagatatcaagactaaaaaattaaagaaagactataaaacaagtttaaacaaatcaactcaaaatgaaggactattgagtagatttaagggtttcttaaagtataaagcagagaataaagggttgaactttttacttgtgaatgaagcatatacttctcagactaactgtcttacaggaaaaagagaactagactcgaatcttagtattagagaggtagaattaagtccaggtttcaaagttgatagagatataaattcagctgtcaatatagccaaaatatgtggggatttatggttatcccatatctttgagaagaatagacttctcaagatacaaaaaatgaatattactttgtaatatttgattaaattcttgtagatttctataagaatttaaaaatcataaaagctaattattgattttaaaccaaggattttaatgaacgttttatataataatgaatatattgattttacaaaagaacctttattttttggaacaggtaaaaactcacaaagatatgatgttataaaatatcctatctttgaaactttgtttaagaaaatggctggttttgattggcaagaagatgaagtacagtgcactaaagatcaagcagatttcaatatcttaaatgaagcaatgaaacattcttatactagagtgttaaacaagttaattttcttagattctattcaaggcaggggtttattacaaactattggatctattgttactaacccagaactagaagtttgtatgacagaatggcaaagatttgaaatttcaagacattcaagaagttacactcatattcttagatctgtttatgctaacccaagtaagatatttgatgaatcttttgaaataccagaattattagaacttgcagatagtatttcaaaaccatatgaagaagcttttgaagctgtaacaaagtatcatttaggattaatagatactgaagaagttaaagtaaaagttcttaatatgttagtcgaaattaatatattagaaggtgttagattttattctggttttgcgacaatttggagtatgcattatagccaagggttaatggaaagaactggcaagattttacaattaatttgtagagatgaaaacctacacttagcaataactcaaaatctaattaagatattgtcaagatctcctgaagaaggctttataaatgcttggaattctattaaagataatataactgatagatatttagaagctgctgatcaagagtttaagtggattgattatttgtttagtaaaggtgctttcttaggtatgacaccagaattagccaagaattatattaaatatcttattaataaaagattaaaagctattggattcaaagaagtttttgctgggtttaataagaaccctataccttgggtggaaacatatattaattatgataaaaatgaagttctcccgcaagaatctgaaataacaaattataaaatggatattttagacactgaaattaaagattctgcttttgaaagacttaagaagaaattaaaaatctaaatttaatgctttgatgatatttactagatctgtagtattaaacttagttcgtttgtactttagatctaaatttaacactaagtgtaaacttctaagcttgataaatgtataaaatatttaaaaaaataattttattttaagtttattattataaaattatataaaattaaaaggagcaaaaatgaaagatttaacaacaaagtttattaatattatgttgaataacagctacgatgaagctctacacaacaaaatacaagaaaaattatttagttccgatttacaatgttcaaattgtgacacaggttttgaatcatttagacttgaactcaattgttcaattgatgaactcaaatcaaaattattaggttgtggatatcttgacgacactgacgaggatttgtgggacttttttaagttaaaagattctgatggtgattcacaatgggataattacgtttacagtttaccttcatctataagagagttaagcagcactacatttagaattaaagacggaaatactattgttttctacgatatggtttggggtaacgaacaaacttgccatttgacttttaagaactagtaaatattacactttagtgttaacgaacttaaacgacactaaagtgtaaacttctaagtttgctagtactattgaatatcagtatccttgaatcttgataaaatcaattttgtaatataaaattgtgaactttctattttatctataaacccagttaaaatatactcaccagaaattttagtgtctccttcttgtgtttcattagtattttcgttagatttaaataatactttgtattttgtgaatatttctggtgccttaacaactccaggtactactaattctaacttagaataatctaaaaacgatttataagtatcagcaaaaatattatcatcgtacaaatattcttgagcttgatattcaaaaccatcgtgatcttgagattctactggaacatcgaaatctaaatcttcaagattaattttcataactttcattgttttagtagctttatcaaatgcgattatttgtgatttcggtaatttcagagcttggtttgtgtttataatcttcctagataaaatatcataagggttgttaggatcttttttaaaatcatcatattgtatattttgaagttttaaattatttggtttgagttctttataaggtttcataataattttttgtttatcttgaaataatatcaatccttgtctatcacattcttcaaatatgaaatccaatacagattttcgtgaagttaaaacgaagttttcaattacgatgttgctagataattccaatttaacagaatctggattatattttaattttggtttaatataagtatcatatatatctttaaaaatatctgaaagttttttatttttatatgttttagctatatataatttactaaacaaataagatattaaatcttgaccttgtattgtaaaactggatttatcagttgtttgagttttattatttttaacaacttgaaactctcttctatagtaaccttcactagcatctaatataaaaggaataaatcgcatatcgccggattgatctaaatagtattgtaaatccgtggtaccattgactgtaaaataagacaagatgataaaaccattgaatgagatttcaccagattttgtttctccagtttttaattcaagtgatttacttgatttattattaagaatagataaagtaaaatctttgacatcacaagcgtgagaaaatagactttgagttcccggattcattagaacctaccaaatacatcatcagaatttgtataaaaatcttttgtttcttgttgttgtttatctttaatagaactcaattcatcgaaatatttttcaagctcgttatgcatatctgtattaggtgtttgcttgtctaataattcgtcagatctaataacaaaatcactttcaagttcatcagattttttaaatacataagttttacatttaaatttataaacatttttatattgattataaagaaatacgttatttaacccaaaacaatctaacgtaatttcggtaatttcaagaatctttccacttggaacgattattaaagatcctattaaatcgtgaattctggaatctggtaaagttacatcgtattcattcttagaattcattgaagattgaactaaattaaatgtggaaattttagaaacatataaacctatacttgtatctaatgggacaccaaattgtgtttgcaatctttcatattggtcaaactcttctgaattttctggcataccaaatatttcaaaacaagctctattgtccgctttaaaatgactaaaatcaccaaatgttaaatccctgttaatttttttggtaatgattaatttaagtggagcaccataaagtctaatgagttcttcggtaacagatccactcagatcatattcattagtatgctggttaaaattcaattttaaagcctcatttttgatatatttattttaagtaatcaaaataaataaaatcaaaaggttcaagatggacagcacagataattctaaagttacaagtattgaaacaaatcaatatataaaaaatccaaaatatactacaaaggaagctattgataaatttgttcacctattgatcctgggtagatacactgaaaaagatttatcagatgctttgaactattgcttaatacgtagtacagaaagttttgacagcatagattctataaaaaaagctatagaagaacttaagaaagattcagaagcttttaaaatattcatagataatacaaataaacttttagatgctatccaagatattaataaagaacaaactgctgaaattgataaaattaatgaattcttaaaaacagcagtaactttagatactgaacagactattgtaggaactaaaacatttaataagatttatgttccaaatcctacagaatctaaacaagctgctaacgctcagtatgttatagattatgttaaagatcaattaagtaaaactattggagatttaaataatttaaaaactgaatctaaagatttaattattaatgctattaacgaagttcttgacaatttaaatgcttataaagaaactataaatgaaactgctattaatcaaatgattgatactaagttaaatccattaatagaaagaatcacgacaattgaatctactgcggattacaccaaagaattagcagaagctaataagcaagctattgaagatttaaatacaaaagtagttgataatactagtgatataacggatatcaatagaagacttgaagaagctgttttctatagtaaaattgatgatactcgcaaaactatacaacttaaaaattatgatagcatttccggtgttagtactactggtgaaggtatcaatattgctatggtttctaaatgggataaagtagatttaggatctacccaaattcctattaacttaaatgggtcagaaaccagaccaacttataacgattctaaagaaatagctttaatggatgatgttaagttgaaagcagatgctagcaatgtttataataaatctgaaattgatactaaattagatactaaagcagattcaaatacagtttataataaagaagattctgacgctagatttgttagtttaactgagaatcaaaacattcaaggcaataaagttatagaaggtatttgggaatttaatggaatattgtctaaaccaaaacaattagcaactaccgaatatgtggtaaattatgctaaaacatatgctaaccaaaaagtcggagatttggcaagtcttaaaacagaagctaaagatacagcagtgtctgctatcaacgaattatttgataagattgaatctggtaatacagataatgtctcttataaaatactaaaaatataagacttaaaatatatgcaaaaactgatagctctagttactccactggagatacagttgtagtaagtaatcttaaagttaaacttaaaggagatactgagtttcttaaacctgttggagttgaagttactgacagaagtaatcaaaaagtaggataaaacttaaacaaaaccttcaggatttaatatctcaagtattgatttatctagtggtagtaatgctgtagctacagtaaaaacaaatggtgtatacgattatagtggagtatatgagatttgtaatcctttcagagagtataataaaaaatattgcgtatttttaagttctgatggattaaaaaatccttactatcaagtaactttagaaagctctaaagaagtagaaaatatacaattacaattatatggaacaagtgctacaaatcctttattatactctaaagaatgtataatagaataaagtttataatataatagaatcaataggaaaaccttcattttcactaaaccctaataaaataggctctctatactctgatacaacaaataaagctgtatatatgtgtatagacaatacttttggtgctaataaatgggtgaatatagtaacaggtgatgaaattaaaccaaaccttagaaaaatagaaatcacttgtaatgtaaacttaagaagtggatagtatggcggttgtatgagcggtgttaaaataggatttgataacgggtatgcttctacaaaacaaatagttaaaggattaaataatggtcagatattatggtcattagacggtttaggtaatctagctagttattctgaagtaggttctttatctcctagtggtaatgatatcaaaggtgatgttactactactggaatatataacgacccttcatatcattgtgttactaatatattcaaagagtatcttggaaatgctgaccagtgttcattatggtctgacgctagcactaaacaattaaaaataacattaatatctgaaaaagtccctaataaaattacttatgtaggtaacggacattatggtcagacttctgtatctgatgtaaaagctatatggtattatgtaaatgatgacggtatgaaagtagaagagtctgtagataatgaacttgaagttagtgttaatagttcagaaacaaacgatagttcttatatatatgcgttcaatataaattagatatgtaaggctgtattaatgatagtgccaactaaagactttttaaaagatattatttggaaacatcattattattttttgattcattttattaaagaaaacagagatatttatattgtctttataattataaataaagttcgataaataatttatatctaatagatatatcataagaataatttaaatttaatttagtagaacattttaatttaggtgtttctacaaatatgatcaaatgaggtattgaagccgaggattcttaatggctttctttcattttaataccctaagaaaatatactggagctttgatacatttattttctaatttagaaatacaaactattcaaagtaatggtaaaccattgtattctatagttcctattcagtatgctaacagggaaagatttgatatttatagtcaattatcttataatcaaatgtttaatggtaatactcaagttttacccagaggtatacttttgtttactggtatgaatgctaatatcaacagagcaaaaaataaatttgctaagatatatagaaaatcacaaataattaaaggtgaaactaaaaaattaaattatcaattcaattcagttccttatgattttacttatcaagtaattatacaatgtcgtggaatgaatgaagctagtatgatattagaacaagtcgctagttattttaatcctagttattgtttaagaattaaagaagtagatttaccagattttggagatacctcttgtatattagaattaaactcgactagtgtagatcaagaatctatggatgaattaagtactaatattgtaacttgcacttttgatttaaccttaagaggtaatatatacccagcaataaaagaacaacatttaatagaattagttcaattgtttatgagtactgatttaccagaatctactgaagctaatccagtagtcacgagagtttattccgaaggttctaaagaaacagaatctggtattcaaacttttataaatcaatacaaagcggttattaaggatatagaattcaaccaagattatttactctgtaaaatagattctgaatgtgagaaacttattaaatttaaatttaattggtgggtcaatggcatcaaacaagacagcgaaattgaaaaattacattatgcaccacgagatggtgatattgtaaaagttcaagcatttactgatattgttgagagtgatatctttgaaaaagaattctattctgatgaaccaagatatgatttaattattaatgatttaattagggatgaaaaattcttagaatgtgattttactgacagtaatccatcaaatattaaatatacatttgaatggtttataaacggtgaaaaattagatttaacacaacgaattattaaatataaatctaaagttagctttgattgtgaatgtattattagaagctctgatggtagagaagctaaatattttaaacattttcataataatgaaataatttttaaagattcttttaaaataaaagattctatgaaactcgagctcaaaacagagttgaaatctatagccattggctacaacgattcaatgggtttcgatactaataatgattcaaatgatgattcaaatgataattaaggtttagaatgggtactttttcattttcattatcggatataaagaaacaattaggtcctggtttaggagttagatcaaatgcttacttactagaagttgctgtagtaggtgctgtttctaaaaaattagcagttctttgccaaagcacagcattacctgaaagaaatattggaaccactgacatattctacaaaggtagaaaatataaaatgcgtggtgaaacagacttaagtggtacttacactattaatataactgatgattctgaaatgaaacttagaagaatgttcgatagctggatgagagaagtagataataccacacctaaagggactaatgctttagcaggcttatttggtggtgctatgggtgacttaatggaggtagctaatggaactttgaaagcggttaatgaaattaaatctgcttgggagtttgatggtggtgtttcttggcttaaaaatatgattatgggcaagccactaccagcaaattatcaaacaaccgtaaacatttggcaattaaccaaagtcaaagaaaaactatatgggtatgctttgactaatgcttttcctattgaagtaggtgcagtagaagtttctgatgaaaatgaaaatcagttatctatgtttagtgtaacttttgcatattcagattttgaacctattgaagataaaggtgtaattggacaaatagttgatactgtaataggccaagaaggtcaagaaattgtacaaggtgttgaaaatctattggattaaatattctttagatttaaaaatttttaagttttaatattatataatatgtgaaaaatttaaatttaaaagatttaacactgtagtgttaattattgaatatactaaaactgctaaaatcactaaaaatttaagaatattttaaggattaatacattataataacattgtaaaggagatcaaatggatatttcaattaaagaaatacaaccaagtcctgaacaattgaagcaatacaaagctcaaagaataacacaaagaaaacgcatcgtaaaaggtgggtttgagcacgttctcgtaacttcggattctgacttagatggtattcatataggcgctttattgatggggtttatagaaagatttaggccggaatacaaaggtagatttggtcggtttaacacgcctgttaaaatggttttaaaaggcgaaactcctattaaatggacttatgacatcacagaagagttaccggttaaatccggtgaaaatgcgaagtatttcaaaggtttaggatcttggcaaaaagaattattagattttgttattaagaaggatggattagaaaatatgatcgatgtctatgatttcgataatattaatataattaatgacttcttaggctctgaagagagtgataaaagaaagaattatattagaaatcattcttttagtatagcaagtctgtaattatttgattgttttacattttggtgatttaatttgattctaagttttaaactttagtttataatttaaagtttataatataatagaatcaatattaaattaagttttttaattttttataattggttttaactgattaatttttttaaaggatatttatggacattaattttgattggaattcaatgaatgcgggagctaacccattcgaatctaaaagttatgaaagtgatactcgtttttataccctagcaaaagatgaaaatggtaatggtgcagctttaattagattcttacctagtgaagttcacgaaaatggctcaatgagtaccattatgaaagtattcaaatacaatgttagatctaaaacttctaaaagatttatagctgagtggagtccaagtacaattggtttacctgacccaattcaagaaaagtgggcgtctctttggaatgctggcaaacaagatgaagcaagaagatatgcaaggtctacaagatacattgctaatattaaagttattaaagatccaaaaaacccagcaaatgaaggtaaaattttcttacttgatatgtcacaaacacttggtgagaaaattaaatctattttaacaccaaatgaacaagaattagcactaggtgctgttgctaaaaatctttttgatcctataaaaggatttaactttaaattgattgcaactaaaggtgccaatgggtttatagaatattcaaaaagtgatgctgaagcaaatccaagtgcaatttataatagtgtagaagaagcagtagcagatattaaaaataatgcttataaattgtcagattggcaaaaaccagaaagctacaaatcttacgaagcattaaaagaattgctagatggtttggatacaccagtagaatctaacaatttagattcaatggttcaagcagcgccagtaacaagttttgctgaaccggaagcaccaacagtacgcattaaaacagcaccagtacgcattaaaacagcaccagatgcaccagaagctaaagcgccaagtgctaaccaagcagataatcttgatgatttgatggctgacttattaaagtaacttatagaagctctgatgggcttcttaagctctgataggcttcttctcaaaggaagaattatgatcgatatcgaaaactttaaaccacttcaagattttgttctaataaaaacagaacctgttaaatttgaaactgaatctggcatcattacaaaaatacaaaaatcaaatctttatgaccgaccaaccaaaggtgttgtaattaaacaagggcctaaatgtcaatatgatttggttaataaaacagttcaatgggatatcacaaaaggtcaagatattgaagaaaattatattcttttgactgaggattcaatactaggaattatagagtaaatgagagctcagctttttgaattgcaccaagaactcaacaatatcaaggataatataatcttgttacattgtgatatgtttccttatgcaggaaagaacatcataaatttacgtatacaagaacaaactatgattaatgtagcagctggtattgcatatactggcaaaccagttataatctatggagttcttggatttgtttttcttaaagctctggagcaaattaagtttagtatattagattttagtgcgaaatatgctccaataattatgtataatgctggatatactgggtgttatgaaatgtatggcaaaggccacattttcaaagaagaattagatctttgtaaagtttataatattgaatatttcaaacctaataaagaaaattttaaaggtttgataaaagattgtttaaaaacaaatggtttcaaatatattttgatatattaaatcattaaacttttaaatttgatattttaaagcgttaagcttttaagctttagcttatagttattaaacattttaagctttagctttattttttaaaacttttatagctttaaattaaaaataaataatttaaaactcaggaattttaatgaaagaattagtagcatcgtggctagcacgcagatttacagataatgactttagaagtgttctcaaaaatgtcgttctaaaagatggtataggtaaaggcaccaaacgcccagataatgctaccaattttgtgaatacaaaaactggtgaattaatagaacctactaaaattcgtgaatttatcaaagctatgaatgtggaggttcaaactcgcaataatttctataaaggtaataccgattatcaaaatgtttcacaagttccacaaaatggtgttttgcagggttctgtagttttaagcacaccttatactgctatgcaggttgttttagaatcatttgtaggtgatggaattataaattttggaaccgcagtccaagcagattttaatcaagttaaattaaatcaaaaatctttatttttagcacacggtaattattttgcaagattagaatttacagcaagtgcgattgctaatatttctggtggtgtaagattaacttataatcagtctcaactttggtatgatcaaggtagatcagaagttaatattaattatgatgctttaacaaaaatattagctcttgaagattttactgacgtagaaattggtatagcagattttagttctaagaaaattaaatggtttaataacgttaaacttaaagcaagtacattaaaattcacagtttctcaaaatacagaaaacgctaataaaacagttcaaaaacgtatagtttctgggtatttagattttacaattgatcaaactattgaagatacaatatctgagaaattaaaaggtgctttgatcacagctgctagattcaataaattcaaacaattattaaataaagctgaagttgcttgtttatgtgattgtaattattgtacttgtgattgtaattattgtacttgtgattgtaattattgtacttgtaattgcaattattgtacttgtgattgtaattattgtacttgtgattgtaattattgtacttgtaataataataaagaatacactgatagggttaattattggcatggtgttgtttgtacttgtaatgcgaatattacttgccaaactcaaggtcctggatatacaccagtttatgaaaacaaatatatgactgagtgttcttgccaaggggatagaagtgttccgcaatacaaccaatacggtcaaatatatggttatgcgtgtagatgtaatgctaactggattaattctgttagacaacacgctaccgtaactcaagtatgttcttgtaacgttgataaacaatggactaaaaatattacaggtaaaccaatttgggataaaaaatctacaggtcaaatcgataatattgtcaacaacaatacttcaaattcacaaacaagtactactgtaagagtttgtgtttgtgatacaaacgtcacaatagctgcacaatgtgctacaaatagaacaatggcttatgttgatgggtcaactggaagtcaaggcggttacagatgtgtttgcgatatcaacacaaatagacaaattgcttgttctgctaatagagaatataaatatgtcactgactatactcaatttcaaaacaaacaatacaattaaaactcaattaacatataatcagcttgaagttcttaaaaagagcttcaatgctttttaaaaatttaagatcagagatttaaaactaaagtttaaattttaaaatatttttaagtcaaaatatattataattattttatcaaagctgtatataaaggagatataatgaattatttagaacttaaaaatatggcggagaatttaaaagattctaattataggtcaacaaaattaaacgattttaaattctatacttatatattgtcagattataaaaacttcaaagaaaataatacttttttcataagaggtttaatgatagattctaaatctatattaaacaaagatactttagcacctggtatatcgataccaataccaaaattctttaatattaatgaaaatgaagattggatattaccagattctacaaatcttgaagatttcactatagtgacaaaatacgatggttctttaatgataccttatgaatatgatggtataaaatttagaactaaaatgtctattgacaacgatcaaactaaattagctaataagtatatcaaaaataatccagatatattagatctaataaaaaataatccaggtacccagtactttttcgagttgatatcacctttaaatagaatagtggtagactataataaaactgaattaaaattaatagctgaattaaatcttagaacattagaatttaaaattcacgaaactaacgagtttaattttaaagatttaaatattaggactctaaaagatcttaaagattatataaacaccatatctaattacgaaggtgttatattgcagcataaagtaactaaaaaagtctacaagttaaaaacacaagaatatttagacttacataatactgtaactaatttagatttaaaagtgatatacaaaatgatattagaagaaactatagatgatgtgttaccaaaattatcgccagaagctgtggcttatgttgattctgtatctaattcagtaaaagttaagttaaatgaaatattagattctatagattctaattatattaaagctaaagatcttgaagctccagctttatatataaaagatttgaatatagatcctatagccaaagattgtttatttaaattatgtagaaataaacttaatttagacaacgtcttagatcaagttaaaaaatctatgttaaaatataacaaattgcgagatattaaggtttttttaaagctataaattatataatattaaaatcaagtctttaaaaggtttttcttaaatgaattcatttatatattatattgcagtttacggcgggataagtgcgattttgagtgtttttgcagtatatatttctcataagttttaaaggtataaaatgaacacaattaaactaacttggaatgatgttcaccaagctttgcataatcttacaaatgaagtagatcttaaaaattttgattgtataataactcccaatagaggcggattaataataactagtatgttgcaatacacccagggtgttaaattacctgtttatgtaattaataattctgatgtaatcaatattcaaaattataaaaaagttttatttttagatgatattaacgatacaagtaaaacaatatttaaaatccaaaaagttttcaatggtctcataacatttaaaacattatttgaaagatataatagtccatttaaaactgagactatcaatatcatcttgaatgatgtttggttaatttttccttgggatattaacccagaagttttaaatctaagaaagtgagtaattaatatgctagtaccaaaaataatcagaaattcaaaagtttatagatttataaaaaatatcattaaattcagaaatgaattaataatttggagaccttatgagccaatatttgatttaaaattgatttataaaatgcttaaaatcaaaagagaatattggcttgatgattgtggtggggcagcttatgaaggtatggaaaaagaattagatactttaaatagactcttaaatgagttagacttagtatttaaatattcatatgatggtgatggccaaactgctatgatccattttgacatttttatggaaatatataagaaaaatgcttttaaattttggtgttgatatgacaatgcgtgttagaatctaaaaatactaaaatatttaaattacaattatatttatcgaactttatttataattataaagacaatataaatatctctgttttctttaataaaatgaatcaaaaaattaatcataaatactatataatatatctaaaggagaattatggaatatttaccaaaatctcaaggacctaaaaaactttataattttgatattaatatgactcaagcgtgtacactaagatgtacatactgtattcaagattttaataaacaaaaatttgaaaaattatcaccagaacttactaaaaaaatgatagaaaagtttgattttctattgaattcagtagaattcaataaacattatgatggtattagaatttcattctggggtggggaacccacaactaacctagaaggtgttaaagagtttgtagaatactatagacacaacccaaaagtttgtttctttatgtattcaaatggttataaatacaaccacgtttttgattacttagaaacatttaagtatatgccaaatgtcgggtcagaaccaaaattcttgactcaaatatcttatgatggaatggcaagtcacgattcagatagacttaatttacaaggtaagggctcagcacaacaagttaaagaaactgtttttgaactagcaaaaagaaatataccttttattgtacatcctacgattgcagctaagaatttcgataagattgctattaattatttcgaatttaaaagaatgtccgatgtcttaggtattgaacttaattataaccctacgatagactatatgtctaaatatgattttacaaaagaacaattagaagcattgacaaatactttaaaagaagaattcttaaaaatacgtgatgctgaagttgagttctttaaaagaaaaggatattttaattttggttggatgaatccaaatagaagtatttgtacagcaggtgatggctattctggtattgaattggatggtaaaatgtatgcttgtcacggtgtttttagtgaagaatataaaccaaataatgttttaaatgatattaattttgagaatgtaaaatttactgaaacattgattaagagctcacaagatcatagaaaaatattaaatgaaaatatgcccaaagcttgccaagaatgttttacacattattgtttaaaatgtaattctacaaaatttggtatttctaataaagaaacctacgcagaaagatggactgattatagttgccaacctggtttatgttatatgtttaaattcataggtaaatatagaatagctttgatgaaatatattcaagcttcttagaattctaaaatagttctaaattgacactatagtgttctattttagaactatactgacatataccagaatccagaatccaaaaataaatatacaaaaagtaggatttattttgagtataataaaatcaactgctaggggtattagaggtacttatagagcaggcaaaaatgcagttaatagtgttaattctgcttataatagtgctgttagtggtataaacaaagtaaattctgctttagatcctatgaatacagttagaagtgctactcaaagactcaataactggatggattcggattctaaagtatctaagacaactcaaaaaaataatgattcaattgttagtgaattaaacaacgtagccaatgaagttgttagtgcagccaaagctttagatcctatgaatgctagaaaattaacagaaatttcagaatctcttaaaaatatttcaaaacaaatctcggatattaaaaaaggattaatagataatcaagatacagaaataagacaccaaggttttgataaaaacgttcaaaatgtttcagaatctaaagtaaatgtacctcagaataaaagtttttttgataaacttttaggttggttaggaggtttattaggtatatcggcaggtgctttattaccattattgggatcattaggaagttttttaacaaagcctttagatttcattttagatctattaaaaggtggtattaataaattatggactttatttgagccattattaggccctattatagaccctttaaaaaatggatttgaattcttaaaaaataaatggaactcattagtagattttattaataaaaaaattaatattggtgataaatggaaaatctcagataatgataatccaaaaaatccaaaatcaccaaaagtaagttcatctaatccagctaaagaacaatcttggatgtctaagaaatgggattcttttaaaggtgctatgcaaaatggatatgattgggcttcacaaaaagtagatgatttaaaatcatatgctagtaagaaatatcaagatattaaaaattctaaagtaggtaaaattatatctgcaggatatgataaattaaaagcagcacaaaaatatattgtagaaaaagctattgaaggatttgatgctgttaaaaatatggtaagctctgcttgggattcagcagttaaagcagcacaaaaaggctttaatatgcttaaaaagtttgctttagctcctatggagaaatttgttagttcagtaggtaagaaactatttggaagttctaagttattttcagttctacctagtatacttggaaatcttgaaaaaataggagcaagattagctgctagtggtgctaaaatagcttcaaaagctttaccaggtgttgggtttgctgtaggtatataccaagcttgggatttctttactcgtggtagatgggtattgggttcaatagcagcacttagtgcttgtatttcattattaccaggtattggtgggatcatatctatgtgtttagacttaggtttatttgctactgatattataacaagtccagatgatgtagataatcttaataaagaacaaaatgatttagtaaatacagcaaataaaatggttcaaaataatgatactggaggtattttagaaccaagtcaagtagaaaaagataaagcacaatctggagttcaagattcaagttctaattcaagttcaagtaataaaggattaaatgctaaagtacttgatggtaaatctgctaacgattttgctgcttcgtatacaccacataaagtggattctaacggaaccgttatagctgctaaaacaggttctatatataaaggtttgacctgggtagaatctgaaaaatatgatgctgaaaagcaagcttattttaagaaacgtgaagaaaaagaagcacaattagatgcgctttttgaacaaggtcaaaaagctatgaattctggagatactgaaacctttaataaattagttacacaaagaaataaattatctgatgaattatctaaaatgagcttagattctatcgattctaaatatcaagctattggacaagcaagaattaaaaaattgcaaagccaaggagctaatgcagatttatcggtatttagaactaatggagattcaagtactagttcagggggaactgatacaaaaccagattctacaaatgctagtgctagtgtagcttcgcaagcttctggttcaatctctccggcgcaagttcaaggagctcaatccacagaagcccaaggctcgagttcaggaggatctccaggagcaagagctgcagcagaattcagtaaaaaatataacttaggaactagagcaacaggcgcttgcgccaagtatgttagatcttatttgatggcagcaggatatccattatctggttggccagtagcagctgcagattatataaatttcttacctaaatatggttttacaccagttcaaggtagagcttcacaaataagcccagaagtaggtgacatttcaataacccagagatttggaaatcacaaatatgggcatattgctatttggaatggttctaattgggtttcagattttaaacaaaactcagtttcaatttatagagacgtaaatgctttcggtgggccggatgctaatataactattctaagagatacttcaggtcaaaatccatctcaagaacttgtaaatcaacaattatccaatatgaatagttcttttaaagttgcattagggggtggaggtgctaaaggtgctgtttatagtttggattctggagtttcaaatgttgttacaaatacagcaggcgctgcagctagtgttataagttctggtgtaagtagtatccaatcttttgctaatgctaattctattacaaccagaaaatctttaactcaaatgtatacagaatctggattaagtactagttttgggtcaagttcagccccacaagctgctagcccagctgcaaattcaacaccaaaagaaacaaaagcagatattaagccagcttcaaaaccagtagcgtcagctccaaaagcagttcctaaagctgctagctatggtacaccacacagaggtcaatatgatgcagaaacaatggaagacttcaacaacttaggagataactttagtaaatccaaatcaccaatttctttacctggagattcgaaatctaacgttcaaactaacaatgctggctcagtagtaccagtaactcctgtagttaatataaagaataattcatctccaagtgattattcttgggcttctaaaaacagttttaaaattgctagaatgtttgggttagatggcatcagcgattacgaaatacttaatgaaggttcagaatctgactttttacaatcttatggtatgtctaaaagacaagcaattcaatcagcagggttaaacaatacagtacaaaccaaagttgctagtaatgttaaaacaaaagatgtgataccagctgtcaataaaacccaaataaataataccaatatacagactaaaacaaaagaaacttctaataaagatttgactgattcttttgttttgagctaaggttcattaaatgcaaaggattaaattttgggattatttggttctgtcagtagtgttatttcaggtgttgatttaccaaaagctacgaaaactttctcggccaacaatggtgctgaaattctaaaatttaccaaatctttagaatctgataattttaaacacaaacaaataatattgactgtttatgacccaaatgatttctataaaaaagtcaaagatgctattggtcaaaaaatgtcaagcctgatgacagcaggaacttcagcattttctggtgatgggtatgattcttcagatgctagccaaactctaaaagatgctggtcaagacattgtagatatgtcagcagtcaatatattatatacaatacatttaccattaatgaatgcgttccaagaacaaaactctcataattattctgaagatactggtattttaggttctatgtcaaatgctgctaatgaattatcaagtacagctagttctggtataattgaagcttatggtagatttggagattttggtggaaatacagataatatggcatttgctccgcaactaccacaagtagatccattaaaatggcaaaactttaaaggttctaacttaagaacatttcaatttacttttaaaatatctcccagaaacatagatgaagcttctaatatgatgcgaatattttggttattaaaaagaagttcataccctaaaaaagaagctggtggtgtcttattgataccgcctgcaagaataggtgtccaattttcaaacccactgctacataagttgatagctcctggtatttgtgtaatagatggtgtttctatggtttatgaaaacggtgatgatattgctgtgacattagatggagttccaaagaaaatagagtttacattatcattaaaagaattccgtcaaaaataccaggatgattggaattttgaaaatgctagtctataggagttagaatgtatattagtaagcaacttacaaattatttagataattattcgttcagtgaagctaataaaactgaagcagaagtttgtaatgttagagattacaggtctatggattatagcactataacaaaatatattaatgattctaatactattaatgttaaaataaatgcaaatgatttcattgaaagtgtttctaatagattgtataatgatcctaatttatgggatttattaatgcttattaataataaagatgccttgagtgatatgccttatgataatgatagaatagcagatatggctgacgaattgatagccaattattttaataatcctgagaaaccataccaaggtaatgttactgaacaattaataaccgaatacagggaatatttgatagatttattgacacaaaagaattatcaaaatatgattataaaagctttagaccctgcttatttgggtgacttcttaagactttttaagtacaaataatttaataagccaagcattttttatactttttaatattagtttaagctttgctttaagttttaagcatatgctgggatatatagcattgttatatactactaaaaagccaagcattttttatactttttaatattgctttaagctttagactttaagttttaagcatatactaggatatatagcattgttatatactactaaaaagccaagcattttttatactttttaatattgctttaagctttagactttaagcatatataggatatatagcattgttatatactactaaaaagccaagcattttttatactttttaatattgctttaagttttagacatatagatactagatagtatatactactaaaaagccaagcattttttatactttttaatattagtttaagctttgctttaagttttaagcatatgctaggatataatactatagtatatactactaaaaagccaagcattttttatactttttaatattagtttaagttttaaaatctaaactaaaaattttggttttaaaaactcgaaaaaacttttttaaaaattttttaaaaagctttatattataatatatcatattaaagagtaaaaattttttttaaaaaaatttcaaggacttggaatcccacattaaaattcaaaacaaagcttaaagcaatattaaaaagtataaaaaatgcttggctttttagtagtatatactatagtatatgcttaaagcttaaagcttaaagcaatattaaaaagtataaaaaatgcttggctttttagtagtatatactatagtattatatcctagcatatgcttaaaacttaaagcaatattaaaaagtataaaaaatgcttggatatttcatagtatatactatagtattatatcctagcatatgcttaaaacttaaagcaatattaaaaagtataaaaaatgcttggatatttcatagtatataacaatgactacatttcagttaaaattcagttatattttaatataataccgtaagtataaaaaataaatacttgaatataatataacaagcaaggaaatatatgactagtaatagctattcgcaatctagtaattataaaatatttttaccttttctaggcgatgaatggatatatgctcaaaatatagcattaccggggtttagtctgaacccaagtcaagccaacttcggcggtaaaactatttatgttggtggtgaccacatagactatgacccagtaactgtaggtttccttgtgggagaagatttcaaaatatatacaaaattaatcaaatatattttcgatagagttcacccaaataatggtaatatcgaaccattaaaagaatttacttgtggtgtggaaataaccgacaataaaggagaatcgttagtcagtatgactatgtatggttgtaaaatcacaaacttaggtgctttacaactaatatcgaatgctgatgatgctgaacaaacttttgatcttacctttaatttcgataatttcgaattgatcgattattttgaatctattaaattaaaagaagctgttataaaatcataaagggttctaatggaacaagtaatagaagcagaaatcgttgagttcgattctgagaaagctaaaattaataaagctcaattaaatccagatgaaataattcaattggatttagtagtagacgattataataaattaagacaaattattttagctaatgtagcacaattaaaagttatgagtgacaacctagttcaagaaatggaaattgaaggatataacccagacttagtaactgcttatagtaaactaattgaaacttcaaacaagtctttaaaaattctaacggattcttataaagggatatctgatattttaattaatattaataaaattaatgcattgcatccaagtacagaagttaaagaagattttgaagttatttcaacagcagatgttattaaaagaattcgagattcaaaacaggattaaatattgaaaacaaagtatttcagataggacaaatcaaatgcctttaagtgtaaatgaatttattaagaaaccaaaatattttaaaccttttcttaagaaattagaaacaaatgattttttattagaaggtgatcttggtgtttttagttttgatttaaaagatcctacaaatattagattatttgaattaattaaaagtatgaatgtcgatgctgtagaacttttgatatatgacaaagatactaaaaaatataaaaactttaaaggttctattaatggaaagaaaggtgaagcaccttttagtaaaattcataaatctaatgtatctggtatcacattaaaaggtcaaaaaagtgacaacaaagacgacttagcagagtgtggcgttgtatactatttagatatgtttttaaatactaaattaaccgatattaaattctataatgaaactcaagttaaaaatactaggactaagacgccattagattctgttaaaacatttttatttgaaaatccagattgggataaagcttgtaaagatgcatctaaatgtattctaaatgaaattattttaaaacaaaaccttagaaattatgaatttcaccacaaaactgatgtttttaatgatcttaaaaagcaaggtaaacaattaactaaattagcagaggataaatggaatcctggagatttctttttggttaaacctacatataaaatcaaatcatacaaaacttatcaagaacttaacaaagaaattaatgattttgataatataatacctataagtcttaagaaatctgctaaagaagctttaggtggttcctatgctttgaataatttatcaggtaattatggtttaccaaattttaaaagtattaaatataaatcattcgataataatttttttaatttttttaaagaatgtatggttgaattaaagaagcataaaaattcagatatcattagagttagaactaataacattaacttagctgacatttatgatgaaattgccagcaatgctaaagctgctaattttttcgaagggtttccaccgagtttagcatttatatctatgagttcaaaatattttaatgatattatatttgaagttgtttgtaattgtttaagtagatctctattaagttctaatttttataaagtttcaggaaatcatttagaagtatttgatacattgccttcagatttaaaaatcgaatactgtgttgtctcctgtgatggtaatgctgatatcaaatggaatattaaaatagacggtaaattatggaaattgcaattaagatctaaaggttctttaccacaatttatgttggtacctcaaccggtaagtgcttcaagtcaagacaaaaaaattcaagctattaatgtttaaaaatctacactcgagtgttagatctagcactatatttagtatccaaataagtgaataaatacataaaaaggatcataatggcaaaattaatcttacaaagaatacaagaatgtaccaatgttagaaaactaagtaaagaaaaaatcgaaggatctacattatctgatttaatattatatgatgacaatggtcaaattctttggaaaggtgctgcttgtgaaaatgccggaccaagcacagaagaatcaggaactgataaacgtataacagcaggttcttataaattagaatggtgtgctagttctaaaaatgttggattagctaaaaaatacccacaatggtataataaagatcgatcaaccatagcaatttgggttaaaagaccaaacgatgctaattttaacaatagattaatcagaatacatattggaaattacccacaagatacagaaggttgtattttacctggtaaaaccagaggtgctggcattgtttctagttcagcagatgcttgcaacgaactctatactaaaataaaagaaattggaattaaaactgtagattttattattaaagaaattgaagcttaaggattaaaatgagggggttagtttataaatcaccacttaaagttgatttagatttagcagaatcttataaaggtaatatattcttatataacgaaccaataaaaaatgatccagaatatagcatacaagattctattaatttggtatctaaaccagatcccgcaacttttagtgaatcaatatctttagatgatactaaccacttcaatattgatttcaattttaacgaaacagcgatattaagagaatctgtctttgatataacttctgagactattgattctgattttagtagagatccagatataaataaatacaaaaaaaacaaggattttaaatgtcagataagttaaaattactttatgaatatcacgatgctaatgtacttatcgaagaatcagttaacgacaaaaaagaaaaagttaaaaaatataaaattgctggtattttttcaacaataggtgaaaaaaaccgtaacggtagaatttacccaaaagaactctgggaaagtaatgttaaaaaataccaagacgttataaaaagcggttctattaatagactttgtgagtgggaacatcctgaaagaggtacagttgatcctatggaagcagttgctgccatcaataaacttgaaatcaacggcaagtatgttatgggtgaagctacattgttagataatccaagagctaaccaattaaaatccttaatagataatggtattaaattgtctgtatctagtagaggttctggcagagttaaaaatggtattgtcgaatcatttgatttaattacatatgatttagtatctgcaccaagcgattataatgctactatggaaggaacatctatatatgaatcacaaaaagaatttgtaatggtggatggtaaattagtagaatctaaagattctgacagtgctaaagattctgacagcgatagcaaagctgatactaaagattcgaaagattctgattcaaacgattctaaagataatactgaagattcgaaactaaaagaatctattcttaaagaacatttcttagagtttattgaaatacttaagaacaaaaataaaaacaaataatctataacaggagttaaaaaatgtatgacgatattgtaaagaatgtaattcaaaataaagggctggctcaagcaagtaatgatttcagagctattctaattgataagttcgactatatgccagaaattagatcaagactagcttctattgaaaaatatagggatatgagagcttcacaattttctgcaaataatgcatataacccagatcgagattcgatttcttaaacatttaaaatccaaattttactcgagagctaacattttaa

SEQ ID NO: 6 - DNA, 52381 bp, Camplyobacter Phage CJLB-13
ttatatctgaaacttaatataaacttaaactctaaaacgacataaataatataaaaggttcatatgtatttaaataaagaaactaacgaatctacgtatacagcaaaagaaattaaatctgattattttactaataaattacataaaaatattaaaggcactgctggttatgttatattctttggtatattcacagcagtttgtttaatatttcaatgcttagattatatcatagattattatataccaggttcgggtatctttaataaaaactttcaagtcccaatggaaacactaaccacactatatgctaccctatgttgtgtatatgtgggtgtcgacagaacaacttctgttattgccacttttaaaggaactaaagattctgctaattatggtaacccagaaagaaatagacatattataatacagaacttttttatatgttctttggctttaattcttaatagattttttgatgcaaatctaggattagaacctttgttagtatcttttggtgggtcgataatcttatatgtttctggtcaaaaaattgtttatcaagctagtaagtttgcaccagaaaaagatattaataaaaatgggatagacgatagaatagaaaataataaagatttgattaatgttttaaatgaagcagttaaaaatgatagacattttaaagtatattatatagacccaagaggtgtagaatctttagagtttgattctaatcctaatgataacactcctagtataccaaatgaaccagcagtacctattccaattgagccaatggtagaacctataaatccagaatcaaacttaatagaatcaaagagttaatcttttaccattaactctttgagttcgtttgcgttttcacttacattataaactttatattcagagctgtatttagaacttagtttagaactaactactaaatctggattgtcgttgatatccacaagttttaaacctttatgaattacaattaattcaaataatctttttaaactcatttgattataaactttataataatcatatattggagcaatttgattaaaaccataacctcctgagtgagaacctctcatattaaatggttcaccaataacttgtagaaaaccattttgaattctaaacgcacacatatctttgaaatctacatcaacattgaattgaaaaatagcatcttggagatttataacaccatcattatttttagtatcacctggtagaacaccaacaattacatcatattcactgagtgaaactttgttgtaactatgaacatttacatatacttctaaatctgatttaggatctaaagtcaaagtacaaaactctgctgtaattaatggatttttaggatcaaaacttcttgaactggcccaatcaccagagtgtatttgaatcttaccatctatgctagtttcaagttttgtataatccaaaacattctttagtgaacctgaactatctctgaataaacaagataaatctaagtctaaccaacctttagaattatccttccttttccaagcaacgaatacttgaaatttagaatctattctaaggctggatccttttggaaagaatatatcagtttttaaagaatctttaggtttaattggaggaaccatagtttctaaatcatcagaaattgctattcttttagctgagccaaaatcaattaaatcttttttagattgtaataaaattgaaaataatttacttaagacttcccaaagattaccgcttggttttttagcttcatcaaaatataaaatatttcctttgatattagacatacgaactttaccagttcttttataattaagaactaaatccaataattgtttgagtgttttaggtctatgatacaacaaaatactaaaatcattgttattagttttagctgctaaattaaaaacatttttataagctaaatttatattatacttataaatttcaataaaagcattattaaattttactgggttatttagtaaagttctgattctataagtacccgtttgtttataatctctttttaatattttgttaaaaacatagtttgcaactattagatttttatatcttttttgtgttgtaacaattaaatactgtatattttgccagaatttcttgtatattaacatttcatttaatatagtttcacgatccaattttaattcattaatagaattcataacaaaagttttaatatatctaggtaaattgaattcttttgtgtaaattctatctaatttgtctatatctaaatcgtattcagatttaattaagcatttagtaatagttctgaccgcattaacattttctggtttgtattttttagagaattccagagcttcactaggatttaaattagaaatcaaagtttctaaagctaacttatttggaatcttacttggcatatatttaaaaccatattttattatgatatctttttcattatccgtaggattgaattgagattctaggatgttttttgtaattttttcaatttcagattcttgtattaaatctaattcaactagttctttgtttggtattagatcactaaaattaatacttagagtataatcgtgagtatctaagttaaaaatatatcttaagacatagtgatagaattgatcttcataatctgaaatatctcttaatttatgagtatattttttatagaatgttgtgcctgcagctaatactatagattcttcaaatgatttaagatcagaatctgaagcattattaatagcttctaacaatgtctggcttggtttataaccttttaaaagcaacttataaagaactgagtttacatttctttgcgatggttttatatctgatttatcgatataaactttgtttactgttaaaaaatttttaaaatctaccattatatttcctttgtctaaccattactagtcttgtttgaattaaccgcggttgtaagatctgtttaatatattattgatcttttttatttcaactttaatatcagatatgatatctttgttactttctgggtctttgatcaagattgataatctttgatttaaagaatccctgtaattttttaaaactttgtcttgtaacatctgaatctcctttttaatttatataattatataataataatcttaaattaaattgaagtttcagatatttttgcgtatttttagtaatatttaaatatatgtatagaggctcaaaaatcggcttaaatcgattttagatttaaagtgatatttaagtatatttcaatatattaagtggcttgggttctatctatagttaagaaatctaagcctaaagaaaccatataagctttatattgatcataattaaagtcttcacctttaggccctttaaatccgtgagcatcgccatattttttacaaaataatgctggatccatattaggaactactgtaatataataattttgagctatagttctttgaaccttaagtccaccagaaccagattcacgagtatttttagagccagaacttgagtttgaacccgaattagaatattcccaataagtaacttctacagtaaaaggaaatgttagtatattattatccctataatatccagcaatacctttagttccccaggatttgccagtatagtgcatatcttgatttttaatatcttctatagtagctttttcttcataattagtatccttaaattcagttccatctaacttaaagccactccaaagatatgtgatcatttttggatgatacaaatcaacatcatctggcagaccagaaagagttaaagaagtgggtgtccaagttttctttaggcctttagggacgtgttctacaccttcatcaactattctagcagatataaactcttcattagtttcaaaagaccaaactatcgtttggctataattttgaacatttctaaggttcttagaatttaaagaattaagtaaattccctgcgggagtaacgaacttagccattaagatcctttatttgatttgactatataatcgttgttatttagccatcttattataggttctcctttataagatttatcccaaatataccaagcatataccatcataccagctttataagttccatcttctctaatagtatcttcaagtaaaccatatctacaaaaaacataaacagtttttaatggaaaatcagtatccttgtatatttcattatatcttgaaaccccgtgtaaataattcaatggtaataacattgcaattttattatttgctatttgtttagcttttaatataaattcttttgctaaactaaatggcggatttgttataatattatcatatctatcaaaatcatcattaatgaaatctttgaaatctttgaagatacctgttaaactaaaatcattgtttaaatcacaataatctacagatttattataatcttttagaactttgactattgctccagcaccacaagaaggttctagtatacttccttcgaaattttcaacttctaataattgtttagtcatactataaggtgtttggtaatagtcatttttattacgtttatttgagtttaagctaaaatttttacctttcatttttatcctttgggatattatattataaaatatcttaaaggcttcttatatagattcaaataaataacataaaaggttcgtaatgagagatttagctcttggtgcttacacgcaaaaagatttaaccaaaaaagtcaatactattggtgatgtaacaacattaaaaaccgaagcaaaaactacagcagtaggagccataaatgaacttaaagataattatgaaaaaattaaaaattctatagataccaataccgctaatttcttaatagatcaaaaattagatccggttaaagaagatgttaaagctttgcatacacaagttgataattattctataaactataagcaatcaaatgatcccacagcttctataaatcctacaatcgatagtgcaacttttttaaatacagctactggagttatttggacttgtatagataaaacaaaaaataaaaatcgctggataaacggaaacggagaagttgctggtgcacttccaagtaatccaaatcttggtgatattggttttggagtgggtattgcacctaaagaaattactaacaaatataatatgtatcctatgctaggaacttttactcctggtcatatgaattatggaaattatactgatatccacggtaatgttatggtttggatacctaaactttatattaagacttcaaatgtagacgctgcaccatattgcggattaaaagttgaagtttccgctactcaagaagaaggtttttggtgccatagagcatttattaataatggtaaagaaattccaggtttttttatagacaaatatctagcatctaaccaagggggtattttaggttctaggcgtaatacagtgcctttaacctgtgattctaaatttaactctgtagctttaatctcaggagtttctgcaaaggttgctttgggtaataaaattacagaagattctgatttagattctgatgatttaaaatctattaagaatagaaattcaagcttcttagaagctgttaaaaatagaggccctgaatttcaagtattaactatatttgcttataattatttgattttgttgtctaaatgtatatatcaaaatgcttataatacaaataatttcaataatattgagtttgctaaatcaagaacagatagatttgcatttattcaaggtatgaatactatgcaaagtgtgcaaagagatattcaagctattcataatttagattataaaactgctgggtatacggatggtactaacgcgttgtatagaacaggtagtgtttcagattctaaaatgggtaaaattagtcataatggtcacgcgtgcggggttgttgatttagtaggcgggttatttaatctggctataggcgctatgtatggttatatattagatagaagttattttggtgttatcaaagaaagcactaatataacagatttagatttagaatctttagtagatactaataattatgatgaaactacattaccagcagagattataacttatataaacagtgactctgatagcccattaggttattttaaggatgttggtgccaagtacaataacacaaatgtaagaacaacttctgagtataaaatagattcttgcggtattccaaaatggagtgttttacaagatgctaccgtagacaccacaagacaaacttttcaatggagaggaaatccaacgtataaagatactttaacatttcctatagtaggttcaagttttaaagatagtttttattcaagtgttcaattccaaaaagatacacaaggtgttgaatttggaactcgctgcatattattacccgaaatttaaaacttaaaaatttaaatttaaaatataatattatataatatataagaattaaaaactcgagtttaaaaaaaaattaaactcgagtttttagtaattaaatcattaatttcattataatactccttacgtttgattagattttgatctcgcaaatccaaaaatctttataatttattatagaacctatacaaatacccactaatggtaaatctaattcagtttcacttgcaatacccaacccattagaatcagcatagatataatcacctatactaggtttatttttgcaataaactggagttctacctttcaatgcaattggaacaccatcacattcattattcagaattacaccaggattttttgaaacaacaccaaataatttcatacctgggttaaataaatttacaccacaagcatctatgcctaatatatgacctgcttttatattcgatttaatagattctggaacttcataatactcagctaagtcagcatatttagctcgcaaagcagttccttgaaaattaacagcatatatattagaccatcttaaagctgtagatcctaaactaaatttattatcttgagtaggggtatcactggttgaacgtctcaagaaatctttagaatctaatccatctaatttatcagcatctattttacccaaagatcctggtactttttgaagtaataaagcaatttcttctggtgtaaatctacttgctggtaagaaataacctgcgtgttgaccatctaatgtatcagcatcaactccagataaatgcccatccacttctttaattttattgagaaattcagcattccaataatcgtaagtaactctttttttcagatcagaatctatgcgatttaaataatctcttaatcctttaatagaatcaatacccaaagattcaatcatatctctatttgttttaatccagttaacaatttcctgaagttcatctaagtttatgtcatttgaagttaaaattgtgttaatatgatctattaatcctttaagaaccttaccttggtaagcgcttaacggtaatctgcgattatcagattctaaactatcaacgacagattcttcagtcaatgctattctaacaaaatcatcaaactcttgtttagagcagaaataatctttgtgttcaccatcaagtctatcagcatttgtaacagtttcattatcaaaccaatgttttagacgatcttcaacgtgtttaacggttgttgggtgaaaagtattagattcttcataatcttgtattgaactaggatcataaggatcttgattatctttagctaggtaattactggcaggaaattcagtatattcttgatattttgtaacgacccaaaaactaggttcctcactaggaactttattaacacattcttgcacacatttataatctacttcattatatcttacaatttcattaacctcatagttttcagattgattccactcgagtggtgattttccgtttactatttgaaatttattgtagatatcagttgtctcttttttaagacgaacttgaaatagatttatagtatcttcagtaggtaccataccgtgtttaatagcataatcagtataaaaggttttttgatttttgtgtgtaaaagccatcacaatccttgctttttgtatatttatttatgaattgtggttaataagcctttagtatttacccaaaggcttaagttattagaatgtgtatgtatttttagtttctttaatagattctaacgaaaaggttataatgccatttctagctttaaatgaattttgtttaagtttaaagttattaacagaatccaaactaactctgattgtattataaccagttataaaaaatgatttagcatcatctataactttatatctaactacaatttcatcaggtttaaagtctaattcaattgttttagaaccatcttcttgaactcctggagccaatacaacaacatcaattcccgaactagtttcagttgttaaatacgaagtaactgatgatggatatgtttccattgtttctgaaacattttttaataaatcttgaagatttttgttattaaatgatatgctaggcatatctaagaatggtgatctaagaaaattgcttaattctaacatataattccttttttgttttaattatattatatttttacttaaataattcttaaatcttagagcttttaatgtttaaattaaagtttaaaagttattaccattctaactcatcatcccctggtcctatagttcctggtaaaaaatcccttgtatacataatatcttcgtattcttcgcgtattatttgaaaatcattataattggttctagcttcacccaaggtatttatgtatgtagatttattatcatatatagttaagatttctccggttaaatcttttcctatcaacacaccatttgagaatagcttattaccttcataatctgtagattttaaagttgatgaccaaacttgagaagtaccagaacctgtaacagtcgtttctactgctgtcatattaccatagaattctaaaaatacagtttctggcatagtcaatgttattatatttccagatatttcataactagcttcaaaatatgaataatcatcagtatcgtcaggtaaatcaaattcttgcgtggttacaattttttgaaaagtttctggatctgttttattagctcttgatagataattaccaaaacttgaatctttttctatagttaccataatttttgacaaatcgtcggtcataaaacttgggtacccatatataaacacagcttttttagtattagcatttactgctataattttagctatttgaattttattcttaggacttccaattaaaaatgatgcttccgcaatatcactaaaagttaatttaataacctgattagtaacaacgtcgtatgtaggtgcattagatattgtttctaagctatcaaaattatcattgatatacttaagatttttatattttgcttcccagtaattataagtatttggttttttatatgaacctttgaaaaagtcttttgaaattgatataattgaccataaagattgtcgttttctttcaactttactataaaaattatcttgccattttgcttcatttgctatgcttgataagcgagtaatgttatcattaatagttttaacctcagcagctaactcatcctttgaaactttgttttctaaactggtttgaacattattttcaacgtttgataatgattcagaaacagaatcaacaacaccttgtatactattgatattttgagtaatttgatctttaaaattattaatattagtttgtatttcagacatatcaaaattattaataataacttcaaattcttctatttttttagatgtattggtttctaattgttctatcttgcttgttaaatcttgttgaactttttggagattttctgttatagcatccaaatcaataccatctaaagagccttgtaatcttgcgatttgttcattaatactctgtatagtttcagtgaaatttaaatctctgattgcttggtttattttagaatctacacctgattgcgtttcaaataatttaatttgtgaattaatagaatttaaagaatcttgtatttctattaacttagcattataatttgtatttaatacaaaatcactagctgggtgtgattctaataatgctgaatttggtgcaacatatgtagaatcatccctatttaatttagaatctaaagcagcttgcaagcctttgatattagcaattgttaaatcatcaaatttttcgcgattttcttctatataattaataatatcttgaagatttttaaaatcatcatctgtaatattaattactttctttatttcgtctattatacctttaagaactttaccttgattagcacttaaagcatctttagtagaatctgattctaaattatcttgtatgtttatatgtaaatctattttagcttgttcaattaatgctctaagttcagaatcatcatataaagtatcttgcgtttctatgctttcactcgagccgtcagctcttcttaaggttattattctaccattggcagtaagagcttgtgtgcttggtaaaactctggaattagtattaaaagtatctatgaaattcttataatatgaattaaagttaaattctgaaagttcaccatctttaatagtataagtagtatctgtaaaaactgggtctttcccaccggcttgctttctagcatcatcccaagaaattttcttatttaactcaatttgagtcaagttagaaattggcttgtcgatgtcggcagtgttatcaacgttttctaaaccaagcgttttctttgttatattgtgtgggttttcagctgtataatgtctttgaaattctaattttgtagaattagaaattggcttgtcaatgtcagcagtgttatcaacgttttcaagacctacgtcttttttgtttaattcaacgtcaccttgtttacccgcaaccgtgttaacaacaccttggataggagtccattgtatttcatcatttacaagcataccaatttcatttgtatcgatagcaagaacgatttcaccttgtgttggttttgcgtcatttacaaaatgttttttaagattacgtcttaataaaataccagtttttatttcagccatttaaccctactttttgtatatttattgctgagtcaagctattttagttcaagcttttaagctttagctttagctttagaacctttaacaacataatatctatctatatctgcttctaatcctggatgtcttaaacgtaattcttttaagaaataattataagcagttaatttaacttgtctatctaatttcaaatcatttggctctatgaattgtgctggcattccaaaaatgatatcaaagaatctttcttgtgttaatttaatagttttttcatcgcagtattttttcattaatttaacaacaccaataaaactatgcaaatcttttattcccacgtttgatttaaacatatatttaaatatttcttttaaatctgttataaattctgaatcactagtatcttgttcttgatatacttgtttaccttcgtaataaacgggttcacctttatctaacataggaaccaaaccaaatctcaaaccccgggtaacactgaattgagccattctaggtgtgcttttatctgcttttaatttgatattgcctggtttagaactcttagtagctacaactatatttggatttgctgaaatagctcctactaacgctcttaataataacttatgtgcaaatgcttttatagattctttggcatcctcgaaacttgaaccgtgactaaatctcgcaaattccgttggttttccatctttaaagtcggcattttcaaaatctatttggcaagctatgttttcgggtttatacacgaatattgttaataattgatctcctaatttttcacgattttgtgaaaagcatccgtgatattcaaaattacctattgttttaccttctaaagaatctaataaatcccatagtttttcttggtgttcagcaggtataacaatatcaatatcaccggaactttgtttatatttaaagatttcttttggatccattttagggttcataatataactcgtggaaccattaaaaacaagaccttttttaatcaaagaatcattagcccaaagtttttctttgtatttgtttaaaaacaatctattaagacttgtgaataaatctatgaattcagctctaaaagattctattgacaatctattaaaatctattttttcagcacttttagattcacccgtttttttattgattgttgtggtattgccaccttctaaaataagtattaattcagataatttcattagttcatacttttagtttatttattgtgaaccaaatcaaggtattatttgttattatagatttataaaattgttttcaaggataaattatccttgaaaactatgctttaaatttgcgcattatttctaagaaatttttagggccgtcattgtaataagttaattgtgttttcgcatcttttaataacttcaccattgtataaagcttgtctattccgctgctgtctatgatgtcagaattaaaaatatcttctaatgcagcctcaaattggtttcggataacattctcgtattttgaaagccccattttacttaaacgaacccttaaacgatcattaaattttttggaggcgtcgtctatattgtaaccacttttgtctaactcaacccaacttgaaccggaatctttcactctttctaattcagatgattttgaatttcgtctatgtgtttgcttatcgcgcatatttctcctactttcactatcgatagcaaagcagaatactctcgaagtcgcactttggtcattaaaatctgctatacacgttttgagcgtggctgttaatgttttctttcgatacattgtactaagtatatagccaagatcgccgtggataaacacatatccaatatcgtgatagattgaggatttttcatcagggtaaacaaagagataatcaaattcacttgatgtgttcttttttaaattattaacttctgctgctgtaagtaatttgatgtcggcgttttgtaaatctacacgatcgtgcaacgcctgtattaaactttttaattgcttcccacccaaacccggtattttttgtgctatataattttgcacattttcatttaaagtatcactattgacgctattaaataaaaaatctttgaatttcatttttaaccttccattttaaatttacacttttgtgctaaaacacttataaaaatattgaattaacaactgcaacaaagtgcatatattaatatcatatcttcataataatattatatttacaaaaagctgaattgtattttaattatttgattctggtctttgtcaaataacgtctatatctttaggttctttttctatagtaatataattgtaattcagatttttgctggcaagtgccgttgtaattgattttagtgcttacaaacaatcacctcgaattatcatcattttccttgtcttagttttataatatatttgtaactcacacaagctaaaatcaagaatgttctgtaaaagattcaaatatctttgcattttcttgcacttcaaatgatttatcattatattggtaatatataccatcaaaatctgcaaaattacaacccatacaagccaaacaatttaaatgacaaataggcattttagttcttttaaacacttcacaagtttgccttttcagggtttctttaaactcagatacatttatatattgttctaattcagtttcatagaaattaactacaatttttttataattagaatctaaacttaatgttattaaatcttttaaagcattcatataatttaatttatgtacagtgtaacggatagttaatttatagtctttagatttaaaataacttaaaacaaactcagtatcttttgtagaatctttaccatttctgtaaactcttctggagttccctgataaatcataagatatttccaaagaaaaatggtttaataatttgcgggttctttctataaaataatcagcatttttagtatttttaaaatatgcaccatttgtagttaatgatagattgaatttcttcttggtatgaaatgttattttatcagttaaatcaaaaatataataaacaatatctgggtttaaaaatggttctcccccaaatataactacagtgctaggcttatctggttctctcttaataagatctttaaaaaaatcattaatttctctttcagagatatacgtgttttttattaaacgatctctatcatttttttgataacaataatcacaatcaaaattgcaagcatctgttaagtataaaatattagatttaagtttatatttagattctatgagtggtcttttaaaatcttcattaagattagaatctatagctgcttggaagaattcagcaaagtcttcatctgaaatcatttttggtgcttttttaacttttgtatatctcgattctttagacattttgtctcctttgaatgtttgtgttttaaattttagttttaaattttatattatatattatatttaaagttttaatttttagcatttgaattagtttgaactttaacctgagttctaaaaaatggatctatatattttggtaacactgtagtaccattttctctatagggtgtttgactaaattttttaagtctatcctgcaatctaaatatattataattcaattgcatctcagcatcaaacaaatcattagaacttactaaaatattttcagaatctatgtaatttgttgtgtattgattattggtcaaataaactctgtacttattataataaaacccaaaataataaagcctacctagttgtttagataaagcttcggcacgttctttattcgatatattaacaaagtaaaatatagaatttttttgtttttgatttaaatctatgaaatattgataagcatcattaatgcataattttaaattatctttagaagctgtcactttttgtcttctatattggtatacatcttggttattaactccttttgttttagatatcaaaaacattttagaagcattttgaatagggatataatccagaataaaaggctctaattgagttgataaatagaacttattatctcttgtacacacgtattctgtgtaatctacgttatgtttagataaattattcaaaaattcattgtagagttttatatcgtatttgtcgatattataaatcattaagaacctttattatttttatttgtacacagaataaaaggttttaaaatatcatcacttaacatatatggtttgaatttgtagactacaaatgattcagtctcacccgtgattttttggtttcttttagttgcttctaaattcaagtaatctaatacagatttttcacgagtcaaagaacaatttaaatgatcttgaatgatatattctaatacatcataattgatttcatccatttagaacctttagcttaagatttaaatatacccatttcgtatgcttttgttcttatcaattcagtattgaaatcgcaccatttataagctaaatcaaaatgttcgatgttgacgtcgttatttgtaactaattcattattagataaatcaatatcattttcttcaagtaaatctaaataacaagtcataaaaattaatttaacacgctcaatatcaaaggtatctttagcataaaaagtataatcgtcataaaaatgactataagttatagatctcaactgttcgtgcaaatcactataaactttcgtttgtttgatatcatttatttgagttttagttgttatattatataaaaaataattacgttttgttaaaaattcttgaaagctatctaccaaagatgctaatgtaattttaatattaccttttttaggagcttcatatcccgggtttaagtagtccataatctctctttttgtgattatttattttgtgtgttttacactgatggccacaaactggtaccagctagtattagccggcacaaaattaatttgtttcgtattctaatttcttagattcaagctcctttaacatttcgtcaagtttataatctataattttattaactttagataatttattaacaatattcggattttctatcgcttctgttccaacgtaagcaccagccatcaaatacatagtgctgcttctaggtactaaaataactacagcaccaaatattataccagctatcacacaaatttttatactttttgatgtcattttatataaacgatcctctctatcggcgtgtgatgccacgttaaatgcaaaagacaaacaaaaaacaacaaatgttaaacaaattactacttcagctgtgtccttaagagcatcaaaaacaccagctaaatatataaaaacgataataacataatttttcctttattttataatcaagtttaattgaacgcaatcaagcatttgaatccataaaagtatgacccttggatttcaaaaaatctatgataacttctggttctacttcatcaatacaagaacaaaattcaatttcttcatcatcagcttcacataaaacatagattttatctgtattatagaattcttctaaaacaatttctaaatcaattggttctgggtctctaggcatatatcctaaactatcgtagatattttctaaaatatcaactgtttcaacatccattaattggtagtcataaccaaaatactcattaaatctagcaacgtacattttatctcctttgtttttatcaatataattatataataataatcttaaattaaactgaagttttagtagattttagcatattttagcattttgttcacactaagcaaaattatactttaaaatcattgacttggcagggtttgtttgcccagtaattttaccagaatagctatcatcttgctcttctactacaatatgatatggtatctcatttttttggatgatattttttactaccttttgataaagattgaactttctcggtatccccataatttttacaaatcctatcggctttattgccaggtaatccactaaaactgaaaacacatatgataatacttttagaaaatttacatcagaatttagataaccatctttttgaataaaaagctcactattcactaaatcactgattctcttcgtgtctttatttttaaaagcttctaccaactcattgaatttattttcataaaagactccaaaatgtggttccaactttgaatccttcattattaggatgcaatagtattgtttattatctacattaaaaagagatatttgcagatatttctttgcatccagaacttgattaaacatattaatgtatttctcaccgagcttaatataattagtctttttagtcaaagactcttgcagcaataaaaattctttaaagttagctattgtattctccttttttaatataatttgtgaaatatataagaatatataaatatctataattatattataagttttcttaaaaagactttaaatgtatattattggagaattttctaaaattataggtgttactaaggcaaccttaagaaattgagaaaaactatataatttatatcaaatattatatattctggacttaaaacagtggctacagatacaacagctggaaccactttaaaaaatcaaagcttgtggagttcttagaaagctcagataaagtctgagaagaactatgaagcaagaaaaactattaaaaatgtaaagaattttatagttctttataatattttataatggtttagttggtattaataataatccaagaacttattaaacctatagcagcacccgcacaaacatctctaaaatgatgttttttcgcagctattctcgaaaatccagtaaaaacagctaaagctaataatatcacagtagctataattaaaattgtattatattcatttataccaaaaaataaacaaccaaaaccagcgtaagcagcacacgtatgacccgaaggcattgaatctttacctccattgggtctaactgataatttaggaaagtatttagaaactaatttctttagactagcggataccaataattgtcctgcagctacataaagccacaccataggtgtaattgtcatattcgtaggatataaagctataaaaaataaagctatccaaagagtaccaaattgaaaaatatcacctacttcttggattacgtcaatttcatctggatctaacccaaaaaactttttgattgaaccataatttatattcattttttaaacctttggttttatttgataaattagttattactttgtttggctttatttcacaaacatatatccatatttttatgtattaggtgttattttaaaaaattatttaacagacatatataacaataactggtaaactctctaacacccctcttatgtatttgtttatccttataattgatatatccatcaatatttgtcaaatcttgcacatcctcaattgaaatcatttcaattttattcattttcaatgcattaaaaagatacgatttgaaatctaacatttttaaaggtgggttaataaattcgtatgcaggtgtccttataaaaaaataaatgatttcctgatcaccataattatttaattctattttaaatattttagcaaatgcaaaatgtctaaactttatatccaaacaataccaatatgatttagaaccatctgtgtatttggagtcgctgtacggctttgttgctaaattatatatttttattattttatttaatctctttttgcttaattccattatcactctttttatatatttatttttcaacaaaaaaatacaccactaaaaattataaatatattgaaaaatataaggagcatacaaattatgtttaaaactgataacaacgtaccggcttctaaatttatattagattatgatgtcaacattaatttttataatatttaccaatattgtagtgatataaatccggagttatatggttgtgattacattaattttggtactgatggtattataagagatttattcaattattttcgaggattatcaatatattatgatttacccaattataaaatgattgacgtctatgccaatcttttcaaaatgaaattaaccaatattaatcaagcagatgtggtgtatgtgacttatcctaatggttgtacgttaaattttccacgatataatatttgggaattaactaataaaattaaaataattgatttaagttattatatatatacctcccaatgtagagattttacagattttcagcatatggtagaaaaattaaaaagtaaaggtttttttgttatttatggcccttcaaaaacactaggccttcctggtttacgtgtaggtttttgtaacacaaataatttagaaccttttaataacactcaaccctggcaaattacaagccattccaagttggtgatagacagtttatggaacaaacccataatagataaacacaccgatacaataaaaaaatcaaaacaatatttcattgataagtttcgtagttttttaatttttgatactgaaggtccttttttagcgctgtctaaggattttaatacatatgacactagggattttgggtattataaacgatttagtgtgattgataaagaccttttaatttaatctaattataatatttatgatgatgtaaaaatagggggttggctggtttacatttgaaactttcaccatattcgtattcctctatcatttcatattcatttttaaataacatccaatccgcgacatattcttctatgtcatactcggatgtgtttcgagccctcaatatttttgctattttattaaactctttcaaataaagattataaaaatttgaacccggttttgttattatcagatcagtctcagcaagccttgtcccaaatattttttttctttgataattttcatcctcaattgaatatacacctaatgcagtatttcctctaaaaagcaatatctcagaagggtctcttaaaacatacatatctaaatctatatgtatatgtgtaaaatttggataattattagttgctgcttgacctgccttgtaaatatttacgaagccatagtcagataagctgttgtcaaaattaacatataaatatttaatattatcaaatggtaattttagtgtggtatcgtcagtgcaaaccaatatgtctatgttttttagtgatccaccattgttgcgccaacaatcaatacaatgtagtaattcattataataatgtctaggcttatgtattgtttttaacatattatttctagcatttttttcataagttaaatttaatagtatattattcaaacattttcctttttttattgcctattttacatccatctactgaacatttataacaaggataaatctcgctgcgtttgtgagctaacatcagcgacctgtgtttagtttcgatagaccaggcttttaataagctcatatcctttatattagcaaacactaaacgtttttcccaatcgtgtggacaatattgtatatcaccatcgatatctacatataacgcataaaaggggtagttacaagttgttttgtttactctggttatgtatgaattatctacactaccagcgcggttgtttatatgcttatcctttaaattgatacttttgtctaaaaacatatcctttattacaacattttctaatgtttttagtccagtatatttttcaacttgtttagaatcataaactgaaatgtttaatattacattttgattttcaattaagttgtataattttttacgaaaatcaaaatcttttagtaatttatcaccattggttgtaattcttatataatttgtagttttttttaatatatattcaataaattctaaaaaattagggtgtaatgtaggctcaccactgcctatgatatcgatattaaaactgaaatcttttatgtttgatatttcatctactatacgtttaaaaattaatttatccataaataaattattaaaattgtttaaaaatttttgatattcaacattactgtgtggacatattgtacaagttcggttgcacttacgtgatatattaatttctatttcttcaaaattttttgattctttgtgtaaagattctctcatttctaaataattattcacattaaagtaattcattataaacctcataattcaaatttaaatattgtttacataaatttatagagtagtttaaagcttctctggtcaccacacttttatcaatgtctgtatatttgtctataccaagatgatttaaaaaatcatcataacaaataacatttgcgtattcattgatatcaaccataaacttcttaaattttttaattatatttatgttatattgatcgtcactctcagctgtaaaaaagtttaaagatattgctatcacagggtcgcgccacacacatatttttaaccagtcatcatcaaaataattaaaatattttatgtcaaattttaatacttcgtatttgccacgcttctcagccaatccttttaaccacaaatcattttttgcttgtaaattttttaaaatattatagtattttttaaacttttttaaattaaacttagtatcaaatacattattataaaatgattggttcaaatcatcataactatatgtatatacattatgattgcgaaaatttaagtatttaagaataccttttacaccacaataatcgtaaacattaaaaaaaacaatatttctttcaatattctcaagttctgagaaatttaaaatgttactcatattttggataccaacatagttctaaacatttacaatttttatgtgggcaggttactacaatattatcatctatatttttaatatgcttaaaacaatcattcataaaagtgccatcaatatctaataaaaaatttaaaggtttgcattttatatctttggtatttagtcgtaatatttcaaaattatcatccaaaatattgtcgtgtgttttgtatttgagattccaatcaaacatatataaaattttgctatgtttttttgcaatactatccaatggcactccattacaatcgtgtataggatttataaaatagttaatattatgtttatcgaacaacgctacaacattttctacaagtttgagttttaccgtgttaagtgatattattttacgagtcttaattttataatattttaaaataaatttaaaaaagtttttgccgtggtaggatgcaactataaaaactttgctattgttaaaattatatgaatgtagaggtgctgttaaatttgttatgagagcaatctgatttatataattattatgcactagtatttccacaattttattcaatttggggtgtaaagtaggctccccaccaactaattgtatattaactggtctgtggatatgtttttttaaaaataacatcaaagttgatatttttataaatttagatttattaatattattgtgataaccaatacaatatgaacaattgaaattacaagcgtctgtgacgtttatgctaattataggtaaaacttcttcaaaacctcttaccaatttcatttgcggtactccattatttcataatcttcacaagctatttttttacaatttatatcaacaccgaacattgtttctaatttattagattttaagttacgacatttagacgtaaatatgccattatcataatatatcaatttggggttgcatagacaacccagtgatttattcagattatttttaaaaatattaaaatattgttcatccctagttagattaaatctattggttaaaatatttttattgtttaagaagatttgttcaaaaaaattaaaacatttttcttcaacaggaactttcaatccttttttatccgttaaaaaaattagaaaaaaatgataattatttgtactgagaaaatcaattatttttgtagggtaacctaaaactggtaacgctacatatagttgttttattgtttgtttatttattatgtttataaaactatcttcatcaatctgattaggatggtaactaataatggtatgtacttttttataattatttaatttttctaaattattacaactaccattagtagttattatcacccgctgtatatttttaacgttatttaatttttcaataaattctaaaaaattagggtgtaaagtaggctccccaccagtaacttttattataaaacgacttagacttttttcaatttgctttatcaacattaaaaaattaagtttagttagagggtttgaattcacttttttaacttgacttgatgaacaatattcacaattaaaaccacaataatctattaaatttaaaactatgactttacacatattttattaattcatccgctctattcaagtctaaagtagaacaatgtataccaccgccaaaaaactcagaatcttctaagtcaacttctatagtttctataccacgtttttctaattctattttaactttattatacgaattgttactttttgatattatacatttatttgtagacaacattaaaaaattaagattcatacccatttcagaacaaagacaaacaccatccttacgatgaccttttatatgttcaattttaactatttcccagttcttaaatattttcggtatcctattagtgatataagataaatcttttacaaatattaaccccggtctaactattctaaaagaaccatctaaatgactagtatccatagtaactatatgcatattaatatctggattaattttttttaattctaaaaacatattgtattgagaatctgatgctacattaactatccagtctttacctaaaggtattatgttagcaccatccatacaagcttcaaccttgttattttcttttattatataatttaaagattctacagatggttcattttgtatttgcttaaattctacaattttgtttatatttttaaaaatattttcaagacatttaaattcatttactctgtattttaatggcaaagccattttataaagagtatcaccaaagcagaataatatatctctaacatttgaaggaattatatcatcatttatataatctggtctcaatacttctatgccattttgttctaagattaaacttaatgaatctaattgttctatacgttttaacactctatttaatgggtgtgttattagcttagatttaataccatagaagttagcaccaatagatgttaaatctcttactaatttacttgtttctatgccgacaattactgttttaaggtcaccaaaagttgtgtgacaattaacatcaatcaaagctaaatcctatataaatttttttatattatatctatttttattcattaaatacaataaagattttttataaacatttttattatttttaataatttgtttcaataattttatattttctaatgataaatttttataatatttaatatcttgtggtatattacagggtataacatcaaaatatatataattataagtttttaaaaaattatctaatttatgaatgttatcatcagttacgataactaaatattctatgttattctcagtgtatgtattttcaatgggttccaaatctacagtacaatggtaataaattttagttgctttatctacaaaatttttatatttttttataaatgttccattcgtattaacagaaacatcactatgtatactgaatatagttttaattatattttctggtatcagaccaggttcaccaccacttaatataatagggttatccaaattttgtttaacttttaatataatatcttcataattaggtgtttttttagaattatgtatattttcacaacaataatagcaattccaattacatttggttgtgcaaaaaatttcgatcatctcatctccactttttaaattcaagccctctatggcactgcttaactctacaaattttataaggtacaaaaaaattatttaaatctaagtcttttaaaggtaaaccttttatttctttattattaaatttattagattcatcatcacaatggtaacacaattcatcataattgataaccaagcttttagatccaacttcacatttacaaaatctacattgtttatataatccttcgttatatgctttatcgtaaataacttctttagaatctattaaaaatgtaaattgtgtttccaaataattatttaaaaatggataagtttttattagtttttcataattcatatgttttgaacctgggttagcattatctactgtaaatctcatttttaatttatcaggtattgcttgcgctaaagcattaaattcttttatgaattgttgttcttgatctaaatacgtattcataaaacaataacctaatatatttaattcttttaatatattaagtttttcaataaaatcttcaactttttgtttattcatatgataagaggaacaaaactcaaaattattatatttaaaattataaagtctatttttatctatacttaagtttgtttgacattgtataaacaaatctctatctttgtaaacttcaaaaagattttcggtaagttcttcaaggtgtttaaacaatgtgggttcacccccataatagtacacaaatattttttgaaatctatctggggtatcttttaatttatctacgagtcgtgtaatggtcgatctatcccattccgggaatgtattgtcgtattcacaacaaaacgaacacatttggttacatttataagtaggttttaacgttattttcaaatctggattattattataatttttaacttctagtgttttaaacaaattttgacctattataaacattcaatattatataaacaactttaatttatttatatattatacagctaagagtgatcctaaaaacaacactataattgtaaaaactacacacaataatatagcaatagttatagaacctatgacactgactaaatacgagaacataaacgtatataaaacaactacaaatatagctataagcaaaacaaataaccccgtaaaaaatctttctattaacttctcaaaagaaaactcactgaaaatattacaaattcgactttttaaattcattctaaaatcctttattaaaattatattatataaagaaataacttaaaagtttattaaactatatcatcgaaataacaaaaaatgatgcaattgcaaaaactatgcataatagcaaagcaatcataggtgagcctataacaacacttaaatataaaaatacacttaaatataaaaatgtcataaacatagttatacacaaaaagaatacattcaaacaaaatagtaccaaaatcttttcaaaaacagattcattaaaaattctacaaattcgactttttaaattcattttaaaatccttattaaaagaagtagaaattgtgataaaatcaaaaaaaaatgtaaaacataaaataagtcgttaattagcttacgattagcaaatgcgaatacggttcgtaatttgaaaatcttgagtactttcgtacccagattaatctaggatttatttcttatatacaaatacattccagaatctaaagtaaatctaaaatttttagaattcactgagtttaatttaatagttccttccatcacgaatatatctgcttgtttttcttccattaatttattaataatttttttgaatttttttggttttatagctacgtattcattatctttaccacgataacaagttatgataatatagcttttaccttgaagcatttgtattctatatttaaaaatataataatatataaaacctttaaaaatataagcagaatcattattatctttaaaacaatctataagtttcattaaactcctttgatatatttatgaactaacattaccagcactattggaatccactaataatgatattatagggtcttcaaggctcataaatctggattctaaatcatagtcaaatgctctcaaattagcaccatcaaaacaatctttatgttcaacaaactcataagggacaccaaaatattgacattcttgaaataatctaggttttacatcaaaaaatacaggatcttgtatatataacatttcattaaattgttcgaatatattagacataatatttaaatcacttctagttatttcagattcttttttaatgtattttgctctggtattaataaatttttgattcttttgaaatctaggtttattcaatatctcaaaaaatattttacttctataattaactgatttaccgacaggttttaaatgctcgtattccacaaaataattacactcgagtgtatgattttttgagccacttaaagcatataaattcttgcattttaaaaatggtttatatctatcgaaatgatctatacagtacatttcaaataaaattaaattattgatagacataaaacattttttaaatattataatattcttaaaacaatctttattaatattatatttaatttcaagatattttttaacaatctcaagagattcaaaagtagtatctattataagaataatatttttattatataaccaagagaaataaaaatattcaaaagcattcgaaagtgacccatctatggggattctcgatttgcaaggtcctattaaaatagcattcgtattcatagctttataagtctagtattttcagcctttttagtataacaagcataggttagaactttgatatattatcaacttctaaaaatttaagattaccatcttcacaaactgaaagatctccaagtctaccataatatatttttacattttcaaaataattttcagaaaggaagttatatgtatcggccatacttttaggagaagtgtttatataaaaattattagcaatacgttgaaaattattatcaaataacgttaattcaacatctttgcttatactttcactaaaagaaataaaatacatatattactccttaattagaaatttttatccacaaataacatttccagatccttgcgctacagcttgcccacaactaatggcatcacctattctacaagcaggttttgaattgaccataacagtaccagaacctgtaacaatgcttccaccgtgtggtggtgacgggctaggacttgggtgtggtatcataggatcaccttgtctaactgtactaattgaattagtcaagacattcgtagaaccactcgaaattgtattaggcggaaacgaagaatgccctgtactaaaatcaacaccaactctagttaaaggaggcattatttagctccgtttaacatatcttttaatatctctttatcagttttagatttagttttagcttttgatgctttagacttactttctttagctttagactcagttttaacatctttgactttagttttagttttagttatcccggcttcggtttcagactttgtatttaaatatctagttttggcattactagtagatattaaataatcatttaatttaatatgaacgtcaatacctttaatttcttctataattttattgcgagtgcatataacttcttctatacaaatagctactaaaatcaaagcataagttgctggctctacgacaaccttacctgctgtaattaaagacactatatcacaaataattgatattattagtattatataaaatgagaacttaatatttttgaatattttcatttaattcctttcattgaatttagtttagtttagtttagcttgatgactccagcagacatagtaatactaggtcctgctgaaattgtttcgctgccggacacatttatattctggttaccagaaattgttacattttcattacctcctactttacgtgttctatcagaacctacctctaacttttcgtttgacttaacatttaaattgtggttagcgtcatatttctcattaacgtcttttttaacgtattcattttgttcaccatcgatatgtaataaattattttcttgtgtatattcttttttattctttacagtattgatagtcatttcaccatctttattcatagtaattgtagtaccagttctgtggtgaaaaataatattaccatcttcgtcactccattcttcgtaatgacctgtaatactatcatatactctagtatttttaggttttgtatttttgtgtatttcgttttcacttgcaatgcagcctataacaataggtaagtttgggttattattgtctaaaacacaaaatacccaagttcctggtgttaatataacgttataaccaaatcctggatattttccagatcttgttatagttttgtatccagatttagaacctttaccatctatattgttggcatattcatcagaaccatctgaaggtgctgggtaataaccaatataatcaatactttgcataacttctgcccaaggcaaatcactttcctgtatttgattatatttagtgtccttttctccagaagttactggatattggccaggagtagcattttcactcattccgtgaagttcaaatatacgaacttgaactctacctccttttttagggtcatcattattaacaacaataccacgatatattctaaattctgatttattcatcaggtacctttatgtatatttataacattttaagctgctagcacattctaaatactaaaatacttaagatgctaacagcattgctgtagtacgtttaaaaacatttaatgggtcaataaaatcattaacacaaactaattcaccctcacgattaaagaaaatattatccggagttaccatagttgattcgcgtctaagaatatcaaaatctctagcatcggtattgaaaaatgtttgcgatcctgaatttcttaaaaaatcattaagttcatcgaattttaaatcttttgtatttgtaataattataccctttgggttctttgtattgaataaataattgcgtgtagttaattctataaattcattgaattcttttagtgtatccttagatggttcttcataaccatattcaaatggtatagtactaaacttgtcaataatagagcctgagtcaataacaatttttctatataaatttttattgtttataataaaatcatatttaattgaaccaaactttacactttgtgttaattctggatccaaaataattaatttaataatattatcaatagattctttagtatctataaaaaataattcagtacttagatcaaaatcatcggataattcgaacttacccggacttgtttcttcgtagtctttaaagaaacgaatagtttgaatacttgggttgacggcaatattagataattcaattgcagaaatcatttttaaactcctttaaatgtttttttttacataacaaaaaaattaaagtcgattttaaccgtgtttttgagtggttataaccgtatttagattctagttttatattttagagccagacatataacactaaagtgtcgtatgcttagaactagaatctaaaattgttttattatataaaaaaaagcttaaaaattaattaaggagctgtaaaagctccttgaatttacattatgaaaatttagggtttaaaaatctacaatgtgattttggtgtttcccaatattcaactgctacaacattgacgtctaaatcttttaacattttttcagctatttctaaccaccacttacataagttttcactagtaggacaaaaatcaacgaaaacaaaaccttctaatttttcttgtatagcatttttatgttttgtttggttgtatttagattttatttcatcaataacagattgtttaatagttttatatccatattcttgagtatcgaaatattgtggatctaaaccatctaaagattctgaatataattctggtaattcgtggatatgacctggatcattaaaatcccaaacaaatttatgatcaataacttcatcaactagttttttataacaatttaaaaatttgaaatctaaaaccatattattgattagttcatctgaacctaagaatagttttattacgccactgtgcgaatgatgatgtctgcaagcacaaatactatcgatactatattttggatctaatgtttgagtccaaactctgtgacccatacaaaaatcaaattgtttgtctatagtccatttaaatgttttcatttttactccttaattttctttattataatataacaaatcttaatttctatttaaatttcgcattttcttagaacttaacgcaatatatctatcacgattagcataaaagatatccttatgtattctagtatttttattagttaatgtatcaaatactggaactacacctttaggtgcacctaagtattcaatattacgtttttgttctttaaattttttatatatagatgatggtaattttaaaattttaccgtctaacatacatttaatcaaagattcatttattatctcgtggtaattttctaaagaatcgttgaatatactttcataaatctctaattttctattataaacgtttacgcgttttctttcacctgtattttttacaacaacggaaactgtgccagtaacgtcagcatacccacattcacattcactattagctctattaaaataatcgtcgtttataaccacatttaattttttatgtagaaaagcttcgtaataaagtgcttctaacctgttgttaaaaactttaagtatttttaaactgtaattgtcaggattttttaaaatatcatttttctacagcttgaagaaccgtaactccaaaaatccgatatcagatcagtttgtttagaagttctaaatcctatgtattttttattatcaatatttgaagttacttcatatacataagatttaaatacttcatcagcttgatcaataaaattatattttaatttgaattcttcaaaatctaaattattcaattaaataatcctattgattccaaaccctatggccgtaacaacattcaaatgttttacttatattaaacataaaatctccttgtcttaatcattcacttcaatagaatctatattattagttccaaatataaattctccaatagcattataatactcagtatctttaataacacaacgaatataaccatcacttgaagatttgaaaatgtgtgcaccaccgcctagcacaaccaagaaatctagtttatccaatatattgctatatctttcatttactaatgctaaaatttctcttaagtattcttttttaataccttcaatttctttagtataatcatatttttggcctcttagtttataaacacccgtatctaagatttctctagcctctggcaatgaaatagatctgttgtgtttttcatttactaatttagcaacttgcgaagctattttcatcaatccgtgttgtgaaattccttcgaataattctggtgaagtaactcctttattaacaagaactaaatctaatgtattgaatccaatatccacaatacaatatgttgaatcacctaagtattctttttgaagatttggaaaatcatttccgaatttttcataacttaacttagctccagctccttgaggtaacaacattacattataattgtattcagtaccatcaaccacaaaatgacttagtacattttgaaaatatccagattgtttaatttctgcaatacttaatcctgaaactattaaatctactttactgagtttagcaattttcactgcgtgattcaataacaatggtccaaaatattctaaattcttataagtatctaaatctatgatattagaacttggtaaatgtttggcatcttcacctaccatataataacgttcattgtaatgaactatattatcattttgaacaccttcaagttttttggtttggcctataacacttggaaatttaaactttttaattatttgaccatcaccagtgcctacacaaactttaacaaagctgtaacctatgtctacacctaaaataactttttctgttttcattaatattccttgaatggatttacattattatatattaaaattacttaaaacaaaattaatttttagttttagcttcagtcttagattcaattttagactcagctttaattgaagctaaagtttctaaaccaaataacaaagaatctaccaaatcgatagtagcacccactatagcattcaacgcaaattttaaagtaacgtcgtctaatttttgtagtctattttcacctaacataagcatatcaattaagtgttctgtgtctaagagataatttgtttctgaggtgtttattatttcacaaattttatttaaattatttgcaatataaaaaataccacttaaaactaaatctatttcttcttctgtataagcatctgggtttctcaaaatatccttagctataagaatagtttcataatctatatctaaagattcaatttcttcacttgatctaaaatattgatttacattgtatttaggaattttgtcctcgttttcatagatagattctaagtagtcttctaaataagatttcaatcaatctcctttaatttaaattttaagtattcaataaacgcatctaatctatataacttcagagcttcatcacttaattgatatttaaatattattaattcagctaatatgcaagctatatgatttttattatatagtttattaaatatatcaatatcaatttgtttaaataaaatagttttatttttatatgataatgtaagtatataactatcctctgaatttttattaagattgcaatttattggtggtataggtatacacaattgtgttaatagcattatgaacccttaaacttttaattcttacttaatcatttctgtataacatcttcacatcttctaaaacttgaactatagcttcgtgttttttcataccaccatcaataaccaagatatcaacgttattattgaatatctcacagaaatattttccttgatctttaccttctaacgattcttttaattttttaacgtttcataagcaacctactcttgtaatacgataaagttctccaataagtttattttctaataattttacttattggctttattggcttgtcttgccattttttcaactattttatataatcttttatattcgtctataatagattttatgatagcttccagatttctattactaatgtgagaaacagaaacataatcggattttaactctttcatagcttgcttgatttcatctatataatctttgatgatttctttgtatcttttcaattcttgtgattggagttcctctctataccaaggcatcttgtctttatagctaagtagatattgatttatattccatacttcgttcagtaagtcattataaagtttataatattgtttgttgctatgcggaccatcagcaagcttgtgtagaatttttaaagctttcttcccaagcgattctatatctttataatcttttttgaaggccagacctgatttgttattggctacattaatctccttgagcatatcatcaatagcagcttcattaataatggcttcattaataaatttcgtaaacgtcatttgttaccctttttaatagtttaattttatacataattataacagattaaccttataataaacttatttattacaaattatgtattaatatacttctttccaatattataatctatatactaaatctaaaatcaaaatcttttaatcttctttccatctttatcaaaccaattttcatttttaatcttctaacaattttttaatttcttctttttcttctttggaacaattttctagtattttttctacaatttctatcttgtcagtattttttaaaaaactatttatgaatttttcttgctctgtattatacaagttttcataaattacaaaagcttcatctgctgtaacgccttttaactcatctgcgttaattatcatcatttcaaatttcattttaatctcctttgatttaatttatcaatgtaattatatagtaataaacttaaaataatattaaattagctagcagagtctaattttatttctaagttctcagtatttgtattcacttcaagtgtgctaataccagaatctacaaaagatttcatagtctctggttcttgttttgaatctttattaaaaatttgttcagcaaactcagttataggtccacgaaccacattaattaactcaccaccccaagtattaattatgctaggatttttaactgcattttgaagaactgttaaagcgttgttatacttattaatatattgattgtctatttgtgagtttgaaccaattattataactttacaatccttgtcaactcttgttaatatggtgctcattgacttagtagagatattttgggattcatccacaataacaaacgcatccgaaattgttctaccacgcaaagcaccaatccacatagtttcgataccagataactcaataatttctttaataccttcttgtatttttaaattatcaattttaacttttcttgatttattatcattagatttttcaagtctttttctaacaatatattctaaagaatcatatagtgggtgattaaaaaccgcaaacttttcgtcatttccagcaagatatccaatatcttcacctttatctaaagattcaattgagttacgtatataaacaattttactatattgtttttctttaactaatctgataccagtcgcaatagctaataagcttttacctgatcctgaaactgcagaaacaacttgtaaatctacattagtatctagcatagcatccacgaaatatttttgacggatattaataggtttgacatcttgtttttccaagtgtttttcgtctatgtaattaattctgtgattttgtatccttgctagttttttattaccatctttactctgtattaagtagttataattttcgtgtttataatctggatctacacttaaaatgctgctaagattttctggtaatttctcaacatcgagaactttaaaaaactctggaacttcattaaaatctttttttaaaccgaatgtctcagtttttaccccttcagatatagctcttatcttgcacatactatcatatgttataaaaatacaatctggatataacttagcaacttctataatttttctatcatttagaatattaataggttcatctgcgtgtttatattcttttttactagtaatagttacttttaaaagagaatcacccagtgttgtctcagtatagtcattgaatttattaagttcaatgacatcaagatttgataaaagtcttgcaaaattacgggcttggtatccaacttcatcgaataatgattttttagcatctaattcatcaataactgtttcggggattataatacgattttcactatcgtataaacgtgagagattatttacatcatctaaaatgatgttggtatcaacgacataagttttcattggagccttttgtcttttgattttatttatgatttaataaccttgagttttaaattacaaaaatttaaactttagttttagttgttttaaaagctttgaactttagtttagattgtttatatgttatgatattataatattataatcttataagctttaaattaaaaaatgtttcattttttagatttacttgaaacttttgaatccctaagcgctttcttatacaaagcttctgcagaaacacctataaaagtttctgttttagtttctataatttgtttcatattttcattaggtattttgactgctcttctatatattctgctattaatataaagtcttattattggaaaaaatccaaactttttgagcataggcttaattctataccaatctatatctaatggtttattctctttaatattctttttatttagtcgaaatatggcatttaaaagcatttttctcattggtatcgggcaccagtgaaaatttatacctaaggtataagatttagattttctgagtaccaggcacaatggagttctatcatatttaacactggtatctttaggattatatttaaaaattactaaattaccaggttttaaaatttgtcctttttcaaccgatttggttttaataagatttttaactaactttaaactatccattttctgactgttttgaagtatttatgagtctggatttccagactcttaagaattattggtctacagaaactacgttagtagcagctgatttaccatcttgtggcatattaaattcagatccattagaaataatccaatctgagaagctaaatgtgatatcacattcttgtaatgtatctaattgatcagcaccaacactaatttcaccaacaccacttggccagcagtttcttaaagtatattcagcaacttcattttctaatgaatctaattgacaaaccgaaacttctgtaaataaacctcctggattaccagaatgtgtatttgcttggaagttatcacaagctttcatccaacttaagaagtctttacgagtttggtgtgcattatccatataaaatgtcacagtccattgtgtatcatacgaagtatcaccaggtataggaagctttcttccttggttaaatacttcaatttgtccaatagttacacctggaaaactagtagctttagctaagcagttcaagctttgtaattccattttatgttgcacttctgttggaaatgaaagtttaacacggtattttgtagcttttgcaccagattttagtgcgtttttaatttcttcaattttgttagacataactgttaaaccattcctttgcttttgttttatttattattttgatgatttttatggtttaagattattttaagttctaaaattaaaatacgacactatagtgttaaactttacactatagtgtgaaatcttctgataggagcaagtaatggtccttcaaaaatataaggatagaaaagatatacgagttctaaagaatgtcttgagtttgtggtagtgttctacctcccagtccttcataaaaatattatagaagtatccacagttcgcttatcgacatatgtcttagcaaggtagagactattctgaacattgattagaactataaagacttccggtgtgctaagtttatactaacaaattcccgattaaataagaagtatgtatgatgttctgcacataaaagtctttatagttctaacattctaagtttagaatttaaaactaaaatataaccaaaattgtgagcatctctctgttcagatttttaaactttttaaattttttaatctttcaattaagttacattgcaatctaaagaaaaaggagcacactatgatgattttctctgtcaggaaatccgaaatgctcacaattttggttatattctaaatctgtttaacaatgatatttaaaagatctaatttatttatatttataattatatactaagtatccttaaaagttccttaaattttcaaatcttttgtcgataattttgacagctgctttaaatctttcgtctacagaaccacttaaattaactacattaataccgtaggtatctatatagtaatcgtagtaattactacaaatatttctaaattctaaatcagtagatctgacaccatccggaactaaatcaaattctggtttaatataaaaaactatatcatattttttcattaattcaatagaaactatttcagctaaatctaaaaatacatcaggtattgattttttaatctctactaaatacttagtataaactacagcatctaatattgttctttcgtatataccatctttgttaagatcttctatatgaatttgcaaagctgctttttgagtttccatatcaccatcttcatttatattaaaacccaattcttttaattttcttccaggccctggaataatatccaaattatatcgttcttttaataatttggctatagtcgtctttccagaacctgaaactcctgtaaatcctattttcatttaaacccctttaaaacctaattttggctatttaaaccatatcaaaggccattaatagttctaaaatccataatatttaataaaatagtattggcggaacctttataatctataagatctactaatttagtacttattttagttcttaaaccatctttagaatatcttacattatatataccgtgaacaattgggttagaagtatctaaagatacaatctctggaatgttcttataatttttaaattcttgaggaacttgacaacccaataaatgtattttagaatcttttaatagatttaatttatctaaatgttttataaaatctatccttgcttgtgttaatttagcttctttagtatcaccttcgtattcatagaagtagtctcctgaaaaacaaatagctaccatatctgcattttctttcataaacttaaagcaatctgttaattcttctaaagtattaccttgaacaacgcctattttcttaccaggtatactaaacttagaaaagtctctaaaagattgtattgttgcactagcattgcctaaagcatcagggactatataatagaaattactaggattgatagaacctaattcatttgcttctttagcaaacttatcgtgatcgtataatgttcctaattcaaataaagaattatctaaataaactgttctacgcttttttaatgaatctatgtaaaattgtttgtattctgggtagatttcaaataaatgaactaaagcataatcataatcattaaacgttcttgatttttctaaaagacttaacggaacttcgtgagaaacaagcatataactcctttttgtttattatattataattgaacttaaagttctatgaatcttatgttaaaaactaaaactctagtttaaattattttaaaatttaagcttttaagtttagaaccaaagtctaaactctattgaatcgaactcttcataagtaggtattacaaaagatttcatcatagcatccacaacacttttattaattattttacctgtagcatttcttttttcaagtctatttaatatcattgtatatggtgttaaaaatactactgctttcttatgataatttctaaccaagctcgaagtagcaaataatctacgcctcgatttaatcgaagtattcgttttatctattaaaatattttgattcttttgaagtgctcttaaaaacttatcattaaataaagaatcgatttctttttgatcagaatctgttaagtttctccaaatatctgaatattcaacttgattgtattttttaaaaccgtatctcattaaaatatcgtctcttgatatagctgctttatcattcatataaacataagttgatttaccagaacctggtaatcctactaatacttctaaaactggttcattggcaacattagatctatcataagcttcaatatttaaatcgggaagttcttttggaacttcagtgattctacctaaagcatcagcaactgaaaacttggataataattttaaatctctataaacataacgttttttaagtgtttctaaatcgaatttataaatgtcgtgatgggctactattttaattatatctattatttcttgtttggttagatttaaatccaaatcgtgtaaaacatctaatgcaaagaacacaccagcattttcgtgatttaaaaaatgtattttttctgggttatttttagatggtgttctagttattattttaccaatatcgtgtaaagctgctcctaatattaatactttataatcaggatcatctttatataattcgttgactttggccataaccatttcggtgtgtataccaacgttcggttctaagtggtatttgtttggtgtattttcagtgccattcaaacatcgatataaagcatcaatatatttgtgatttaaatcttttaagttcaacattgttatctcctttttgtaattataatatattaaagcttaaaacttacttaatattttaaaatatatctaaaaattttaatatatttttaagttttaatattatataataatattatttaaaaataggatttaaatgaaagtaacttataaaaatataacgatagatctaaacaaaactttcaaagaaatactcattgaattaaaacagtatccactttatagaaaacaaattattgatattctattaaaagaccctaaatataatggggaatttcattcaatatacaaagactacaaggatttacaaaacaatcctaatttttgtgtaatttgtggaactaagacaaggacacaatattgtaaagaatgtctaaaatcaccagattttaacaaaatacgcatagctaaaatcaaatctacaaaattagaaagatatggtgatgctaactacaataatatagataaacataaagaaacaataaaagaaaaatacaatgtagaaaacgtatcacagataccagaagtaaatgataaaattagaaacaccaaagccaatacagattataccgaaataaacaataaaagaaaagaaaccaatttaagtaaatataatactgaatatgcgacacaaagtgaagttgttaaaaataaaacaattgaaacaaatctaaaaaagtttggagttatctgtaattctcaaacaaaggaatttaaagaatccgttcgtaaaacctgggattctaaatccgatgaagaaatacaaagaatcgctgatcaaagaaaacaaactaatttggaacgttatggttatgagtgtggtaataaagatttaattatagaatcttggaattcaaaatctgaggaagaaatcatagaaataaacgaaaagcgaaaacaaacaaatttggaactttatggagtcgctagcccaactcaaagacatttaaaaaataatgatttactgcacgaggattattttaagactttcataaaaaatgaaagatttgatgcagacgcctgttcaaatttttataacttaagcccgacaggtgttctaaaatataagaaaaaatttaacgtagaagaacctaatgttactagtatagctaaaacacaacaaaaaatatttgattttattaaaactgatataaaaaaatacaatgttaaaaatattataaagggtgaattagatatatttttgcctgattataacttagcaattgaatacgatggtttattttttcacagtagaggtttacataaacatagaatgtttaatacacctgattatgataaaaaatatcatttaaaaaagacagaaatgtgtgaagctttggagatacaattatttcatatttttgaatctgatgatttagatatatggttttctatgattaataacaaactaggtttaaataaaaaaatttatgctagaaaatgtattataaaagaattaagttataatgaagtagttgactttttaaatgagaatcatttacagaaatcgacagtttcaaaaattaatttaggtttattttataataacgaattagtagaagttatgacatttggtaagcctagatttaataaaaactatgaatatgaattaataagattatgcactttaaaatattgttcggttataggaggagcttctaaattatttaagtatttcttagacaattataaaccaaaaagtatagtaagttatgctaatagaagatttagtaaagggtcaatatataaaaccttaggttttaagttcgtagagaatactgagcctaattatttttatttcaaagatttaaaattgctggctagacatcaatttcaaaaacataagctaaaagaaaagttagagattttcgatcctagtctttcagaaagtgctaatatgatgctaaatggttatagaataatatacgattgtggaaatatgaagtttcagtggatccaaggatcgtaaaatccttgaatcttttgtaaattgaaccttgggtttagcttacaacaatgctgaagtcgtttgaaccgacattcgtgaatctgagatgaatgaactctgcaacataagtcggcttaatatatacgtctatgacgagttggttcgctgcaactacacttgctggattgtttgatgcgtcacatatcacaaggtagtcttggatcccgcggccagcttttacttgcgccaagaaaggtttgataatacttacaaggtaatttcttgtaaaactatcattgaactcaaatagactatacttcgacatacgccctaaagatctttccaaatggttaaacaagctaacaacgtttacacgatcgaagcttgaagctttagtttgtaatgttttttgaccccaaagaactgcaccagtgtttggaaacataactactggatttataccattcttgtaaagtatcattgtgttcaacatcgttcgctacgcgatgtccgttcgaagtaatggtaaacaacgaactgctttaactttcgttaaagatcagactatatcttgctcatatcataatgacttagagcgccccatttcgaattcgcttgaattctactctacttggtgtctataagaccctttcgatagtcgttgaacgttctcttttaaaaaagagcttcgctgctgattagcatattgtaaagtgattaaaagtttcggagttttaatcacaaaatgcaaagtagaatcttttttaaatagattcaatttatttatttgttctacataaaattgaatcttttaaacaaattcaatttatttattttgtattatataattatagatatcatctatttcgatatcgcaccttctatttttacttatattttcaactgctggtataaatcttaaatttgatatgttacctattaaataagcgggtatattattgataaatcccatttttatagagtatatatgatctaaatgatacccattgtttttcagagttcctcttttatcataattttctaaagtttttaaatcgtttttattagtatatcgccaaacaacgcgtctatagtactcgaaatcaggtaaatcttcgggtttaggccaaacaccactttcttgcatttttaattctgtgtctatcatagaaatttaaaccattttcatctttttcgagattttgtatttgcatcctatcatagaaatttaaaccattttcatctttttctaatttttttaaatgtacaaattgataatgatctataatttcaccgttatattcaatctttttatttttcatagtttttgcagctttgatagcggcatttttaataatttctggattattcttataagtttcatttcttttaataatagctaatttaaagacttctttatgttcctgatatgctttcttagctatattgcttagatcttcgtgtgtatattttttacgcttggtttctttggctttgtttatagcttgctgtttttcttctggtgatttatttttaaaagtttctttaactttttcactctgtgattttgctaatacattggacatcgttgagttcgcgtgtctgcttgaacatccattagaaaacccttctctgagatttctaaatcttttcttatttccgcaagtaggacaaactaaatcaataggctttaaatcttctattatataataaactcgttctaatatgcaagcgttataatcgtctaagaattcagtatttttatatatttcttcttttaattctttgataaatttactattacgagtaaaattttcacagtttggatatttttctttaaattttttaatttcttttaataatttatatctaatagatatatcataagaataatttaaatttaatttagtagaacattttaatttaggtgtttctacaaatatgatcaaatgaggaagctccgacctttcctcatttaaagttaatttttgcattttattcctttggaaatattacaacttagccttccagcaattaaaggcttttttcaagttacgtttccgtaaccggtgacatacatacttttattatattaaaagcattttgttgctatcacgcatcgcaccagttgggctatatgccaacgcctcgcagtttttaatgagacctctgttaagaccagcagctgcataccagttagcttgattataatttgtttgagctttaagacctgcaatatctgcagctaagttcagccatctgtaaccaccaagctcagcacagtattgatatttgtaattgctacacaaagttacatatttagaatctatatttaaagattttctaaaatcaagtgttttttgattagcaattgtagatttataacccactgaacaactttttggtgcacccataaatgctatacagtcaccacgagtaatcgcaatatcagtagctgcttttggataagtttcgttacaaattaagatatcaacatcgatttcttctttgttgtcaaaaattgtataagcgtctataatatcgccaatacctggagctgaatccataccattttcaagtttaagtaaatcttcacctaaacaagtttttggtttaccttgaactgcttcatttacagaaactaagatatagcttgacttgccattaatcattgtttctatataagtaaattcatttttctcatttttatcagttaagcctaagcttacaataaatgattcttgaatttcgtttgcgtagataacaataacagcaaattgatcaccataaggaatataatcaaattgagaatctaatggtataccatcagtgatatattttcctttgttgaaatcatcagggtgtgcgattgcgacatcaattttattgccccactctcccggtgttttagcaaatatttttaattttgcatctttataaacaaatggtttagataatttatcttcatcaaatgtattgaagttactaatggtatgatcataaagttcatattctgacgcatcgtatttggtttcagaaccttctacaggaacttcaacacaagacgatttagtagccttaactaaataaactggaaaacctttagttgcttcaacaatagcttcagaatcctcagttccttcataagtaatatttgtgaaagcttcaccattgactatactgtcagagattgctaagattctgaatcttggatcagttaaaacatcagaaaatgctataatatctccgcgttttaattcagtgttagcacctctaagacttaaaatataattagaatctggttgagattcaccttccattaagtatactgaagtgtctgcatttagttcacctggttctttgtctaaagtaacaatagttacttcttgagttataaactctggtatatcgtagatatctgccatttattatcctttcttagctttagatttttggttagctctaccacttggatctgcatcttcggctttatcaaaactgagagattctttgttgataattatgtcggaaatttcaggcaaatcttcaattgttactgatatttgacttgaaaaatctttatgaccttcttttgaaactgttacattaactgtagtgtttcccgcagctactggagtaatttttaaaatattgtcactaacttccaaagttgcaacttcactatcttgtatagtagctttaagtgtagcagattctggtaatgtagcagttactgtttgaacaccttgattaattttagctgtaactgattctgggctaaaagatactccagtaatttctggtaagtcaactgcttcagtaacggttacggttatagttttagtaacttcagtttttccttgagcttgagctgtgatttcaattgtagtggaacccactcttacaccatttacagttttcttatcactttcaatacttgcaatacctaagtttttagaaacaattgtataatcactagcatcagtgtcgatatttaacacaccttgctcgccttgaattatatttaattgttctggagaaacaatcaattttgtttgttctttttcttgaacgtcgaattttaattcaaatgaattagttctcgaaccttctttggtagctttaaaagttacaatagcagtccctacttttaatgcagtcaaagatttattagatttgttaacaagaaccacatcaggtctatctgtttctacagtataagattctgcatcggttgttattacgtagctaacaacttcatcaacataagcacttacttgacttgggtccactactaattgagttaatggttgataatctggatttggtatttgcttaacttcatttctaacatatttaattttatattctttattagaatcgttgaatttaagaacttgtccaacttcgaatttatcagttttttcgaatttaacgtctacagagtcagcttcgataactttaacaccttcgattttactagcgttaacatttgttttatatgcattttcttcaaattgtaagccatctaattgtgtgggtgtaccattgatgtctgctgcacgagaaacataaattgcaccactgtaagctaagaaattttgaacttgataataatcattataattctttgtattaggcataccgtaattatctctgagttcttgaacacttgagattaaagtatgtacaccaactggtcctttctcaaaatcaccaccaaaaacggcagcagagtcaccttcaacaggcgtaatttgagattgatctacttcagaaacctggataccagggctaagtaaatttgccattttaatccttttaatatgatttgatattacaaaaagtctctcgaactgcatcaagcttcgttgttgagctcttaaaccaatttcgatgcctttaggctaaaacgactaaagtatattggaatcttattatttatttaaggatttaaaaattgaattttaagagttttttcagtttatgtattaaaaattagattggggatttaacatccccaaattattgaagcaattaagctaaaatagttcctgttaaatctacaccgaatgttcttgcgtaattttctggttcaagtggattagtagctaagccatatcttgttcttgcaatcatacctggttgtcctgattcttgattcattactttttggaagcttaatggtacatatggacagaagaatccgagactatcttgagcggttgtacccttataaagaacagtgatataatcagatttagcatattgatcaacaattacattatatctaccatcataagtccctacatcaccagtaaatacatcagtagctatattgcttgaactagaagcaaatttaaatgtaccgatttgatctaacatagtagcaacttttggagatacaagcaatgtattacctgaaccgcgtcttgtcattaacccgatgtttcttgcttctaaatctattttgatagcattacatctatatctttcaatttcccatctaccagcttctttgtgttcagcacctggacttaaagtatcagcgacaacggtagctgtattgtttacgaaattgataatctcacgatctatttcagtttgcatttcagcagcaataagattagctaaatgtccatctgcaagcacaccgtgttgattttttaaatcttcatacatttctaaagtatattcagctttaagttttcttgtttttgcctcaacagtatctttttcaattccaaaacctacagtgttcatatcttcagcaagtttttcaccgtcagctgtactatatggtcctgaataagtttctaagattttatggaaagtagcttcgttagaataaacgttaacgattttagttcctttattagcagcttcgttttggaattttttatcgctagttaactgaactaaagcagttttaccatctttttcaacgtgtataattttacctgtcgcacttgaagttgtacctgtaacagtatcacctttagtcacattagcttcaaacacaagaatttgagctttagaaactggagatatagcaccgtcttttttattacctgtatatctattgactaatgcataaatgtaacctgtaggcattgttaaaggttgaatacctaaaagttgattagcaactaatgctgggtaaacccttcttacaattggcattaagattggtgtaaattgagcgatatcactagagataacactttcacctacaagtgcaccttgagatgctaaagcagtgttgctgagcaatgtactcatcaatacagcttcactttcatttaaagcagcgtattttgaatctttaatataagactctactttttcattaagacttacatttttatccattgtttttaaccttttaattttttatatatttattttttaactgaattttaactgagcttgttagttgaacttagtagttagcccagttaatgtcagcgcctgctttgtttttaaaactttctttgatatcctttgaatcctttgaatcctttgaatcctttgaatcctttgaatcatcagaatcatcagaatcatcagaatcatcttcgtttgtttttttacaagcttcaaataacgcttctaatttagattcaaaaccttcacctcgttctaccaagctagctaattttttaaatttttcactttctacaagatttaaattagcagctaattcatcaatttttttagattcttgaagaatcgcaagttcagctttaagttctctattttcaacaactaatttatcaaattgatcacttaattcagaatctttgtttgcataattttcgagtatgtttgatccagcaacatctactaagttatcaaatatacttactagagtagcagccttttcattctcaacaacagcgtctaatttttcaagaacttcgtctttaaatttataaagttcttcattaatgaatgaatctatattttcagtaattttagattcaagttcttttttagcttctttgaactcttctactaacttgattttttcgagttcgatttgttcattagctatttcaacagctttaatttcaacagcttcattaaacacagattcaatttctgatttaactgattctgttagaacatctttaaagctatcgttgcttaaaactttgtctaacatttaggtacctttctttgaatttttttatatttattaaaatcggtttaattttgttttaagcttattttttgtagtgttagtagtgttagtagtatttagtattggcagaatcgaagcaaatatcaattttaacacttcgtgtaatttatgatattgcttatatacataaaattaaaaatcatcactaaaaacagtttttttaggacttttatagaatttatatttaataagatttgcttctatataatcttttaagtatgcatcctctgatatcaaaaaaccaagttcttctaaagggatatcatttaaatcacaaaaatcttgcattatttccataacacattcatttttatgctctcttaaaaacttgtagaatttatttaatgttttaatttcctttgctattaaatcttggctaatattcattttgaatcacctttagttagatttacattaaaatgtttataattacttagaacgtttttaagttcagcgtaatcatcaaatgatataaaaccttcattgtatctaatattaatatttttgtatttgatttcagtggtatctaaaatattttcaatcatttttaaattaaaattgggtattgtgtaatctacatataattcattaacaatatctatagttgaagcattcctagattcattatgtatatcatattcagaattatacatacaagctaagttttcaagttctttatcttttttgtttttctcattgataatagctaaaatactattatgaattatttgtgaaatataactaaaacaagatactgattggtttgtaattttagattttaatgtatgatcgaagttatgaatatatttaaatacacgatagcaagcatcactataaaaatcatcttgccaagtatacccggaaaaattaggtttagttaatatttttttaatcattagaataacaatgttaccaaaatattcgtgagattttggtgatatttttacaccctcggatatactaataatatagtctttaagatctggatcttttgttttaatatattcttttatcttaatgtctaagtcttcatttatagaaccatcaggatcttcagagcctagatttaatttgaagtttttttcacgaatagctagcgattttagttcaagttcgttagtataatcgtgtttcatacgagtttcactcattttaccacctttagattttaaactttagttttaaatttaaatattaaatataaattaaatatatttttaattagctaatagttcagcttttttgaaatgctctaaagcttggtctgtattaccatacaaatctctgaattcttttaaatacatatcaagagcttcttcacacccaggtccaaaaattctgccagttatttcaactgctaaatcttcattatatccaaatttttccatagttctgagtttaatgaattgaaaaatatatggaactaattgctgagctttttgtttttctggagataatggtcttcttgtgtatacttctttagctgctttagcgcgacgttttttacgttctaatagtaggcttgtaaatctattatcgaatttacgttcgtgtttgaataattgtggtgcttttttgccattttctacaaaattattaatgatgatttgttcaaaatcattgaaaggttttttgttaacaattttagtgtataacttgcgtaatttttgtgtattgagaccttttttggttagtttcgtttcaagctcttctatttgtttttgagttttaagtcttgtattttgtgtgaataaacttgaatatctaagtcgtttgtaatccagcttgaataaattaaactctacttttaaacgcagatatgtgttaataatatcttgatgtttggtatacaatttgtgtttgtaagtcagtttcattattttcctttcaattggtatattatataatatataagcttaaaaaattcttaaatttattagaatggtttaaatatttgcagtcttctgtgttgatctaacaaaaag

SEQ ID NO: 7 - DNA, 48608 bp, Camplyobacter Phage CJLB-13
ttaagttttagatttaatactatagtataaactgtaaaaactcaaaaaaagttcgtaacaacacaatttaaaaagatcaaaaatatattatataataaaaaaccttattttgtacttataaaattttcaaatgaatctgaaacagaatccaatacaggtgaaactaggtcgtccaaagcgccaaaaacagcatcctttaaagtattggtaacactattaatagtattctgtatagtattcttgatcaaactcgtgacttcagaactagttaacccttccctagaaattgtattaatttcaaaatgagtatatgcaaactcaactgtaaaagtttcaatttgatttaacccgtcgtattgaactgaaatttctcctacatttgttggaaatacattcatcatagtatacacaacacaatctttagacatttcaaaatctaattgatatatagaaatgcttggtaatataccttcaaaattacctttagttttatcctcaaattggtgagcttgatcataagtcatccaatctaaaaataactttctaactgcgtgtttttcatcattataaaaagttgctgtccatttttgttgataagtttgtactgatttgactggtagggttctacctctatatttaaaatctattgtttctacagtcaatcccggaaaacttgtagcgtgacaaaaatagtctaaatattgtcctatttcagaagtactggatgttgcagaagctccttcatttaaaatacttaattcacacttaatttctttaggtggaaatatttgacatttaaacttagtggggcgagctaaatcacccatcacttgattcattttattttgaataatatcagccatctaaatcctttataatcaagtatttgttttattaattatattgtcgggttctctatcatattttccagtatatattttattaggtgccactggttcagagacttgaccatttcttaagaaactatcactaaaatcatttgacttactagttggataccatttaaacatataatcttttgttatatcattagatcctataacaatataatcatccatttggtatacgctggcgtgttctaatctttcgtatttttcattaaatctttcaagatccctagtagttttataaacgtcaacatatcccgattgccaaccccatttattttgatagaatcctgtataatcatttttatagacttctgtgatttttggccaagaatcaataaattcaaaattaacatcaaatccatcatttgtagcagttcctgttaattcaaatgtatctatggctgttaatccccaagggtttgtttctctgagttcataatctaatttgttcgacgtaccagtaaatacctgagttggctgaacattattagctgcaaaatatcctacataatgattatgataaactgaactttctctataccacaaggattcttcattaagtttattttctttgaatttaatcttattaaaatctatctcatagagataatcaccaagtgctttaaaggtatattgtggtgccaaattaaaatctatttgttccaatacttcaagatctttattaatagctctaattgttgaatttctatttttaatatcttgattgaatttaagatctaatggattaacatctaattgcatagattccttattttcaaactcaacaaagtcgtcatttaaataaattttaattggaaaatcaacatcctcaaagtttgcgttattaatactaagtattgttttcttattgtgtttattctttaagaaaaacaatttgacaatatcatcgtcttcttttgtaaaaataattctattatttaaataatcatattgataatctattaaatattttatagaatctttttgcgcatctataaataaatcatcatcttttcttatactataagtatataagaaactttcttcgttaactttttctgcgtatctaatattaatatcttttttagttgctgtgtaaattgttatagaatcttcattaactttgaattttaaatcattgttaaaaccggccataactggcaaaccatattcaatatttttaataaatttatatttacctagttttgaatctgggtcgttactttccacagcttttaaatcagctttcttaattttaagagtttttaatcttgaaaatgaataaaaatcttcagtagacactgtattgatatcttgtttaactatgacaccatttttaacagcatataataattttgtggagtccgggtctccagctttattataagtaacatcagccctatttttagtatcatctaaataatatattcttacttttataccttcagaataagatattttaaatccagtagttaaaatacctatttcaacgtctaaaacatttccatcagtatccataacaactaaaggataagttttcatttcgttgtgcttataaacatatttgtttgtactagtatccatatttaataatatatctttatatttaaatatttttgcgttataattaatgtaactagtatctaatttaaattcagcatctattgtatatgttcttggtataccttcatctatattatcaaagtattgtattgtaatagcttcatttgtatcagtataaaaagataccccagtattttcaatatcatagtctaattgtattctttgattatttttatcgaatatattaacaatcataatattttcgattctaaaattataaaggaatttacctcttttatcattaacttctgaaaaatttccagcaatatcaaatgttgtagatttaatagttattggatttttaatacttgcagaataatctaagtataataaacttaaattatttgtttttgcattacaatctaatgttgctaatttaccttcagaatcgtaaactatttgtccttcaacgtattggttatcagcattgattaaacctaagaatatactattttcttttgcttgtatagtttcattagttgcactcagtatagttatcggaaatcttttagaagtattatctataacatatactcttattttttgagcagtgcttgaagttattttaaaacctttttgtaaaccagcaatatacataatgtccaaatctacattgctaatacgattagctacgctgacaaaatagtattctttttctggtgtagtatattcatataatttagaatctttattataacttaattcggcatcaataatttgaaatggtcttgaatcgtattcataagtatcatcaataaattgaatagttacaggatcttttatatttaaataaagcctatattcagaatctacaagcctataattacctttaactatataaccattagaatctacaatattcaagtaattaacaccttttttaaggactgtataatattgacctaaaggcttattcatagattctttaaaatctttgtaaacttgtgaattgtatttactgaataatgttttatctatatataataattgtgtatttttaagttcatcttcagctataacttctaatgaatcttcgttatattttattttagcgcgaactctatacccgtaagtattaattaattcaaaaaatattgcatttggattatataatctataatgatataaattgtcagattctaaaataaaattacaagtacttgattttacgtgatcatcaaaaccagaataaactttatcaaatacctgtctaatagaattatcatttttcttatataatgctttaaagtcagaagtttgtaaaactttattacgaactctagttccataagttactggtgtatttgcattgattctatttttaccaagaacccaagtatctgaacctagatacatattaccagcgccaatagctgcaaatttaccagtagtgctagctaaaccaaaatctacttgaaattgatatttgtctttaactgtggttacaactcttctaacataattaagttccaaagcacatttgcttaagaaatcagtataatcttttttaatttcttgatttaatgaattaatacctttataataatataatattaaattcttagggtttgaattttgttctaatctttcaccagattcaaaatatacaattaatttgtcattaccttttatgctggatttttcaatagttctaatagtaggatctttaactaattttaattcagattctaatgttaattctgggtaattgacaccaaatcttgtaacattaaatactggatttccatcagctttatacatttttggtttattattttcatatattatattattattaatgtcagtttcaaaaagatatccggtatttgttttaaaattatcttcacaatcagaatcttcacaagttactctaaaaacatttacatcgtaaacttctttgcataagaaataatcttcgaatttaagaacgtaagttcttgtaaataagtaagtccaacctactggatgtgctaaaggcttaacaaatgcttcgaatatttctggtaacatagatccgtaaacgcggtattcaaatatattttcaccgggctctattgttaattgaccgtcggtttctaatacaaaactttcaatatttaattgttctataatacgatatataaactcaatagatcttaaagttcctttagattgttgaaagtttttaaataattctaattgttcttgtgataataagtgtattacatttatatctaattgcgtttcactaaaatcaaaaccatattttttgtgcgcttttctaacagcttctgcaagtttatgattttttgaaccatcggttatagtcttataaaagtttgcagcatatgttttaataatttcttcatatagaacttcatttttagaattatataaattattgatgtcaatcgctaggcttgaattatcatagatataatctacaaaaacgtcaaggacgtccataataaatttattagatttgtaattttctggtactaagtttttagctatacttttaaacacagcaaacctttaattatgcttttagtatatttatttggttcttagtcttaaattaaattattttaattttttgacttctaccttagattccatatgaacacttttaagaaccactctatgtaaagttcctactttatcgggtgttgtactccaaactctttcatcgttgtgatcatttagatttacattctttgctaagataccttgatctaatttaattatatccactgtaaatcctgggttattactaaaagaataatatattctcctagcattttcatattgttcagaatcacctaataaagtatatttaagaacggtagttgctagataatataataatttgcctaatctgatacctctatggtctctatcaacttctacagcactaactgtataaacatttttataatccattcttttaattttatctgtaggcaataatctaatcatagctataggactaaatctatctttggtaccattagggttatctttagtcgggtaatcttcaggtactttagtagctaaaatatggtaagattctctacgataaaaaaaatattctttaccattataataaactttatatacaaaaggtgatttatcaaatgtatattctatcgaagtcagaccatacttattaatatagtttaaattcccaaaatcataatcacctgatttagcaattgcttgctcttctaaaaaatctgaaaacttcaatttagctcctttaatttgtaactttagttaataccaatctattaaatctaccacgtattctttcttctttagttcctgttaaaaataaatcttcatcggtccaaattcttggatctaaagcatcttttaatttaacatttttagcaataattttacctgttgctaactcaactatatcaacgttaaacccaggtgatttagacaagaaagtccataagtttcttgcaccttcatattgttcagaatcacccatcaatacccatttaaaatcatccactaaaatagtatataattttttacctatcccaccacctctgtatgatcttaaagtttcgacacctttaactattctaagaggaccataacctaaacctctgtattttgttgtatattccaaaagtatagcagctaatatcttaaatcttgttgtataaggttcaaatcttttatctatttcttctttagctacacaataatatttttgtttaggatggttagcattacattcaataatgaataattctgtattatcaccatttatatcaaaattgaacttatggagaactttcacaactttctttgatatcaaacctccagcgcctatgtaatccaagttaccaaaatcataatcacctgatttagcaattgcttgctcttctaaaaaatctgaaaatttcatcatagcctcgttattttaatttgcataattatatcataaaataacttaaaatatatttaattagataattaaacactcatagtgctcatatcaatatcaccagctcttaaactatctctaacttcttgataatccaataaatcatcaaaaactacagatctaagtctaaatattgaatttcttattaatttaaaattatgtgatggataatttaacataaattcataattatatccaggttgaaaaatttttgtttggaatttaactctaatataaggtatccttgaattaaatattgtataagaacctacaatttgttcaccttcttctggcgtagcagcacttctattcattaatttaataggtattcttatataagcaactttagatagatccaaattaatatattcttcaactgttgtataaaatggtaacatagtcttaacagattcttcatctataacatagttagcaactattttttgttccgccacataatttgttaaatttgctgggataactttatgtgttttgctaggttcttgtatttcctcaaaacaaataggttcattatcctcaccttctgcaggattagctttagcaaataaagcccattctattgtgggtatattttctggtattatttgacccttggtatcatatataccttcaattggtaaatctaaatatacataagctcctcctgggccttcatccactgataaatctaccgcagcttctttaacatatactatttgattttgatataataaatcaccacgttttacttgaacgtctaaattaaaattaaaagttcctgtttttctataattatttaatactacgtatggcgcttcgtattttaatggagaaccttccggtatactgactgtatatgaatctaatgcatcatcgtgatttgcaattaaattcctgacgtcgaatttattattataattaacataaaatgtaattttttcattagattttaattgaacttctctatcaaatgtggttgtgggcgcatattctgttatattttcaaactgtttagcaacaaattgaattctatcatcttctacaggtgttaattcattttgtctttctacgtaagtaggatatataccgatagaaccatcagcactaccaaatgaaatttttgtaacatctaataatataccatctatttttgtatcaaactgcctttgagctatcatagcgtctgttataacaatacttgtagttttttgagcataatctattaataatgtatcattggcttttactgagcttggtatccaaactctaatatctatttgaccgtcagaatcttcataccagttataatataaattagaagtttctatatcaccaaaaacattatcttgactttcagtttggttaactgcagattcccaagaaccactggcagttcctaatagttgattagattttaacccattgctatcaggttcttcactatcacttggttttaaagattctctattacaagtataaacaactttataatcacttgctcctacaagacctgcatatttacccctttgtaaatcatcacattgtagatagccttgtgaaagtatctcttcagtaatatagaaatcatatattaattgttctgctttgcgagaaccatataaaccgtaaactttaaaactatcacctacactaacaaatcttggcaatgctattttaataactgataattcattacctatattaacattaaaaaatacggttttattttttaagttgtataaattaatgtcgtttcccccataggtggtcaatccatcgtatgatattattctaacatttaatgattcttcatcaaatcccacatccttaaaataaaaagatttgtaagattggttgatatcagtatccgttaattcataagtataatgatctgtattgtctaaaataaacggcaaactttctttattaaaataaacttctaatttatcacccacactagccaataaactaaaataaacactaagaactaaattcttagataatttgtcatatgatttagcataaaaacaatttactttactaaagtctttattttctttaaattgttttacacagttttcttcacttagtaataaactaaaatatggatttacttctataccattacccagacccaattcattgtctaaatgcctaactaagttagaatggataaattcaccttcaaatttttcaatttctgccattttttcacgaatctttgcatagatttttttacgaatatctgattttggagtaccaaatggatattgtttaataagaacttgtaaatctatattaacatatgttggatttttaagattattcttaagtgctggtaaattatatgtatctactaagtcaaaaatacctgggtttttataaccgttagcatctttttctgcagaaacaacttcaccatcatttaaatataatgtgtcaggatcattataagattcttttatgtagtattgattggtactcatttcagtagtattcaataattcaccgtttgctaaagtagagttttcttttttgtaagtatatgttccatcactttgttgaacttttttaaagattgtaaattctggttcttttcttcggggttcagctgaaaaatacaaattacctggagcaactggatattcatcttcgcctccccaagtcactacatttttaacactagagtgtgtttttataactgaattataatcgtgtatagttactgttcttgaagcactattataaaacattggtgcatttgttttaatagactctatactttcttcatcctgagcttgggaaactaatacaggtacatctttaccagaagtcaatattttacaaaaagagccaagatcaccgttaacggaagctgaatcacatctctcataatatgcgtctattccagaagttcttaaaacattaatataaactctcgtattagaaggcaacttagtaccagcagtccctagttgaaaatatatcctagcattgccagtatccacatcatcttttctaaagaacttattattggtactatccttaatatcaattaaattaaaagaagattttacaaaagttgcattatccgataaatttccaaaagtatcataataagtaacataacattccacaccatcatcttctacatcattccaaggtatatctatgtattcaaatttttcatctattttataagttaaaatatcaggatattcttcgtttttaattaatgtaccttcttttacttgtattgtagttgtagctcctattttatctatattgaattctaaatcatcgcctaaataattgtaagtaaaaccatttatgataaatgtgctgtattttggtattttaaaataaccagttctggtaaaacttaatgttatttcgagtattgtagattttttatgagaaggttcataagacaaaaccctagcatcttgtataacatttttacgtttggtcgccaaagttaaaacattctcattaacatttactgctgtattgaagttcaaagaacttacgatataagataaaacagatgctaagattgctccattagaaccttcataagctcctccatcccagcctttttcaattaatcttttagctatatcttgatatatttcatcatatgtaaaaggtaatgtttcttttataatagccatttgaaatcctgatttttgtaatatttatttgatttttacggccaattttttgtttaataaataataaaaaattattaaaggattatcaatgttaagtattgctatttacgttgctatattcgttgtcggtcttgctgtaggttattgtattcgcgtcaacggctctaaaaaagctgaagctctttatgaagctcttaaaaaagaatacgatgaattaaaagaaaaatatgacaataaataaggtttaaaatgagtggtcaatcagaagatttaaaaaagaaactaaaatattattggtttgttttcagatggtttttaataggtagatatcattgttctggtggtgaacattataccatttcattaagaactgtttggaaaatatgtaatagaaccatatggggtgtcattacattttcattaatatatgcaatagctagtttttttaattatattgattaacccattgcttatcaatattttatgttaataaataacataaattttttaaagggagtaaaatgttgaatatttatgatgcgctgtttagctcccttcctatactacttataggtgctgttataggtgctgtacaattcttgcatatagataaagctgctaaatctaaaaccaattttttaacgagattcaaactttttataaaaacctcttcaacctctggtattttagcgttatcttcttttttaataactgataattttgatttaacttattcgagtagaataggtgtatcgatttttatagcatttgctgggtatgaaaaaatacaaagtataattgatagattattagataacatatctcccaaagataaagattctaaattgtgacattcaaatattttaaatatacttaatgttagttttaaaacatataacattagaatgtaaaataaatatttaataattaataattatgaaaggtattttatggcattagaacatattactgcagatccagttaaagttgacataaatggttcaatctatgaaaaatcacaggcggaggttaaagctattatagctgaaagaactgaagcaaacttggctgataatgaagaaagtgatccagaatcaccgtcagtagaaactactttatctttaaatccagctgataaacaaactattgagaagggtcagactaaagatattaatgtaactacaaatgctagtgatttcacagttgagtctaacaatgccaatgctacagttaaaaaaggttcaggtaaattcactataactgctgcaactaaaggaacttctgaaattactgtaaaagctacagctaagggtggttctgaaaaagttgttaaattaagtgttgaagtaactgagtctgaagattaacatagtgaaaattaaggtaaaaataagtcgatattaaatcggcttataccttaaaataatataataggtatataaatgacaacttataaagattttcataatgattctttgaatgctgtagttatagataaacgagctatagaacaaagtatttttaatatattaactactagaaaaggttccttagctggtaaaccagaatttggttgcaatttatatgcttatttgtttgaaatgattgaccatattactattaatagtatgcaaaccgaaattacaagatgtctaaaagtttacgaacctagaatcaaagttcaaagtgtagacatttattcacaaccagaattcaacagggttatattaagtattaattataattttacaggagtagaaacttcaagctttgaaacttatacaataaccttaaatactaattaatctatttaaattatttaagcctctgatcaaaaataaatactaaaaatataagcaggagatttaatgtctgattttagataccaaggctataattttaacttaactagttttagagagttcgttcaagaattcaatattatggataaccaaagagctagtgcagacgcactaaacaagtcggttaataaactcaaaagagaggttaatcaattaatcggccaatttaaaatattaacttcaaaagaatctatcagatgggatgctagcataatttatgaagcaggtgaaatagtttcttatataacagaagataatccagatgtagaaaccattaaaaattcatattatttagcattgcctagtgatatcgaaaatcaagggtattatccagatactaatcctgatatgtggaaaaaagttactttaaatgaattatacccttggttagatgtagataattatcctactaaaactgataatgataaagattggcccatcaacgacgattacgatgttattaacttaaagtatcttaaatgggctttagaacaatttaaagatttcttagatggttatctcgcaggtatctatattaaacaagataataaaatagatttagaagtatctgaacccgctcacgtaacaactaaaaaatatgtagataatttaatagatgaagtaaaacaaagcattactaatatagatgatttgttaacggattatgtatttgttgattctaaatctaaacaattacaaactcgtaaaagtaaaaaagaagcttggttaaccacagaagctggattattaccaggattaaacttaatatctacaattggctcaacaacacaacaatttaaagctatgtacgctcaagattttataggaactgctttaaaagcaaaatacgctgacttagctgaggtctacgaaaccgataaagagtttgaagttggtgctgttctgggtattaatgaaaattcagaaattgaatatttcgacatctataaacataatagacctttaggtgtagtttcagataaaccagggtttattcttaataaagattgtaaaggtgtgttaatagctttaaagggtcaaacaccagtaattgttaaaggttctgtaaaagccggcgacgaattatatgctgagtatgacggttatgcctgtgtaaacccaagcaaaaaagaagaaaaatattttataggcatagctttagaatctaaagaatctgaactagttggcttagtaaacactaaagtataaaatatgttaatacataatggccaagaatatgaacaattaataatagtagatttattaatactacttttagtagttacattcattttagcaaaagaagaaatataaataattataaaaaattataaataaaagaaaggagtttagaatgttatctagaaagataagaattgatagttttatatctgatgcagaaaaatcagaaatatttcaatattctaaatccctttctgctgtctataacgtatgtcttgatacgctcaaagaaaatttaaattttaaagatttatctaaaatcacaaaaggtaggtctaaaacaacaggcttgcattcaaaacatatacagaatacctctagagaggttataaatgctgtaaaatcttatctagcaaaaaagaaaacagataaaactgttagatttccaaaattatatagagaatatagtcctatcattatggatataaatctttcttctaagattgtagaggttgttaattctgaaacaggagaggtaactcttgtaaagaaatattgtccaggcgggggatttaaactagaaggtaagaaaataaactttacttcaataggatttgaattagatttaagtaaatgcccttactatgatatagaacttatcaactatgagactttaaaacagatagtcatcaagattgatgagaataagagaatagattgtatttttgttttctcagagaaaaaacaagaaaaagcactaaatcaaaattttctttctatagatctaggaataagcagtacagcatcttgctactcaaataagattgattgtctgaagatacaaactaagagatttaaaggtttagaaagagctataaatgaacttaagtctaaaagagataagaagaagaaaggttcaagagcatataagaaacttaacaaaacaatcagaagaaagcaagcaaaactaactaataaaagaaaagactatctccataagacctcaaaaactatggtagatctctgcattcttaatggtatagataacatcatttgtggagatatcaagactaaaaaattaaagaaagactataaaacaagtttaaacaaatcaactcaaaatgaaggactattgagtagatttaagggtttcttaaagtataaagcagagaataaagggttgaactttttacttgtgaatgaagcatatacttctcagactaactgtcttacaggaaaaagagaactagactcgaatcttagtattagagaggtagaattaagtccaggtttcaaagttgatagagatataaattcagctgtcaatatagccaaaatatgtggggatttatggttatcccatatctttgagaagaatagacttctcaagatacaaaaaatgaatattactttgtaatatttgattaaattcttgtagatttctataagaatttaaaaatcatatatttttatatgaaggattatgatgccagtcccaagtgttagatttattgatagtgataccagttcaacatcaaattattcacaaccaagaagagtattctatgctggatatttcgataaaggttcaccagatactttaacatccgtttattctatattagattttaaaacaaaatttggtaaaccaaacaaaaataatataaatgactggtttcaaatttataattattttttatatgataataatgaaatagttatttcgagatctattggtgaaaattcagttaatgctagtattagctatccatttaatgactttgacgtcagaatagataacttagatgattttagaagtaaacgtataatttctgaaaataatttcttgagaatccttgctagaaacccaggagagtggggaaatgatttaacagtttgtatttttacacaatatgaagttcttaataatatgctaatacacagcaattatttagcaaaagatattcaaaattcaatgagttcaaatcaatattgtatttgtgtgttcttaaaagatacattaatggaaaaatatatcttaaaagaagctgaggatatggtagatactattaatgaaaattctaattatatattcattgttttcgatcctaaaaaatacaagttatatgatggtaatatccactatgtggatggcttaaatcgcttagctgatggaaatgaacctaactcagataaaacagttttttatggttctaatagtcttaaattaagtaacgggtacgcaagtttaccaagtgcagcccaaatagatgaaacatataaaagtgtcggtgaatctaatgattatgtgtttgattttataatcgctaatacacaaagtccaaattctgctatcaatttagcagatactcgtggtgattgttgcgctttcgtaggcatacccagaggtatcaaacctgaagaatatattaaacaattacaaatttcaaacaatgctgttgtttactatggttctaaattacaattaaatccatttaataatcaaaatatatatgttaattgtataggcgatattgttggtttaagaaccagattaattaattcacaagaattatcagtatctcactgtaaaacaatttatagtttcttaaatacaatagatttggatatatatttaacagaatcacaaataaaagatttatatgatttaaatattaatattgttaaaaaaggatattccggtatatacgctttaagtgaaaataccttaaaaggatctaaattaacaaatagaataatatatttcaatttagttcgagaatgtgaaaatgctgcattatattatgtatttgaaaataatgatgaatatacaagaaatgatttaacttcaaaaataaaagaaatttgtagaagttatgttgcagataataatatagaagattttaaaatagtttgtgatatttctaataatcctactcaggataataacatttatgtagatgtttattataaacctaagtatttaattgaagaagttgtatttagaattcaagcagctagtgaattgcctagttgaattctaaattgatttcttaaaattttaatcccatatttttgactctatctaaagtatctgtataatctttatcttctctaaatccattaaatcttggatgcattaaagcatatatttcagaatcttcagattttgtcaatgctgttgctttaactgtaaaaactttatttaaatacttagaactatttttaaatatttcagctctttcagtatcactaatcccagaaactttaccttgaattaattcatcatctgttttaaaaacaatagcaccaaaagtatccttaaacttaccattaccttctgtaaaatcaatacaacgaacttcaacttctatttctggttttaattttatttgttctgtactagtaccattcttaaatacagcgtcacaattttttaagatagcaccttcttcaccttcttttaaccaagtatttaaatactcattagcagcttctatattgtcaataactctggttctaacaacagttaatgtatcagattctaaagattcagttaatctccaaacaaactcaaatctttctttatatggtgttttactatttccattttcaaattcttctaaagtcaaataatcccacatataaaaagttacattttcaggtggtgttaaactattaagtaaaccattagatttatatctgatttcagttgaattagtaccttcaacttcattacaaattaattcaccaatataagcaccatctggcagattcaataatgctgaatatactttagggtgatcataactttcaccagatcttgaaaatgcttgggcactatcaccttttttaataaaagttctataagttccatccgcttttatttgaatcattgctggaaatctaatattcttaaatttatccattaatgaacatctcatatatggaaattctgttataagttttttatgaactttgttgatttgtttagttgaaatacctgaatgaatatctctatccaaaatataagtaataatcctggttatttctggtgttttattgttaagtaatgactgaacaacactaatcgccttattccctgtaaaatcgcgattatgcaacgctatgaacgtatttttaattgtattgaaatctatggtttcattattattttgaaattctggtacttttttaattccgtaagaatatttgactttatcataaaccaatgaaagaaattctttaatgatttcattgttatattttttaagaacttctaatttataattagaactatttgaagcatttaattcatttaaaaaatctgttataatttgcattttatctccttttgatatattataatataattgaacttaaaaaattattaattatgcattttctcgttctaagaatccacaacattctacacaattaacacagtttttacaatttttgcaatcttcacaagtatagcaatcaacacattctacacaattatagcaataatcacaactttcacattttttgcattttttgcagtcttcacaatctccacattttttacacctgacacaattgtaacaacaatcacaaccttcgcagtcacaacattttgtgcagttcttacaaccttcacaaacaaaacattcataacattcagcacaaccattacatctgacacagtcttcgcaaccaaagcaatcttcgcagtttttgcaatctatgcactcgctacatttttcacagtcttcacaatcataacaatcttcgcagttaaaacaattaacacagtctttacaatttactaaagattctgaagcttttttagcttggtcctcagaatataattcagcatcccatttattgttgttagaatctacataataaccatctattaatttcatttaaactcctttaatattataatttaaaacctaaaatgatagccagccttcataaacttcaaatgaatctaaatttatataatctttcttattgaatataaaaagttcacaaccaagtacttccatacaacatcgatctgattctgaatccaaccctctaaagaatagaccaaaatcttcaccgtgttgataagaatctacatgatctaaaaaatattttttaccgttgaatgtaaatattaatttttcatttctaacgcgatctattaaatcgttcataacattgtgtgcatagttgttagggtctttagctattttattcattatggctcctttatcttttaatgaaataattataatataaaataacttaaaagtttctgaatgtaactaaagttttaaatcagtgagtcttttttaatagataaaccggttttatcatattcttcttcggtatctgtattattagcattgttattagaatcgttgtatttaggttcatcaccagaatcagaatctgaatctgaactgaattcatccccactttcaaaatctctgtaaaattgtttatacaatggatttttagattctttttgaatagctttaagattctttttgatttcaacatcattaaatctaaaaatttctttatataatgtatctacaggtaaaactgttcctccaaaatctttagctgttgagaatgcatctatacgtttcataaacaatgttagattcattctttcaataaattgattttcttcgctaaagtatatattaatagaatctttaagttcttgaaattgtttttcagtacaaactttagtacaaattaattctctttttagaatttgcataaagaattccgtgtatacttggcgaatcctagttattttttggaagaatttgatgtcctcgtttgtgatagcatctgcttgcaaatcaaataatggttgttgtgattggtcatctaagtagattctattaactggtattcccatagatctatataataacttgtaaaaaaacataatatcaccaagttctcctaaattaccagtttcatccaagatatctacttgcatacctttagcaccagctttattaccaatccaataatcttcgaccatagtgacaatatgttggttattagttacttcaccagtttctgggttgtattgttttttatatttgaacttattagtcaaatccctcatataagcttctgctttagaattcggtaattcacttaaatctatattaaatacacgtcttgaaattgatcttgaaaatcttaaaggtattaacaaatcttcaagtgtttttaattgattagctgttttaacggaagcttctaattcacttaaacaaataccagaatctgaaaataaaccaaaattttgatgaactatttcctctatatcgtattctaaagccgcttgatctattcgaactggagctttaccattgatattgatatatctttgatttcctaagaaattatttttaagagctactgaagaatttatatctatgtatttgtatttagaatctgttaaatcataccaaagatatctaggatctaaataatataattcttttataccttttttcttatcatcgtggtatttaattaatatattcatttggccgtctatataagattgtctgataaaagaatgtagatatttttgggttccaaataatttcattattttttcaaaagcattagatattgctatgtctattttcttattcgaagtatcaacttctaatttaataggatctttgaaatctctacaatatgcgacttcgtctacaatttctgttaaaccactccaacattcagcaatcttagcagtttgtctgtagatatcaattttttgagcttgttctgatgctttttgtagattatcaacataagttatgtcatttacattatcaaaaaaggtttggaatcttaaaggttcatcatcagataaagtgtttattactctaccgaatggaactgtagtatctattttattaataggttgttctaagaatggtctatctattttttcacctataatactattttttatactttctaataaccccattattaaccttttttttttaatatttatgtactaaacttttaaactttagttatactttaaactttaagaatacaaattataagatattaataaatcttttgttttttgactaagatattttgtatacttaattttctttttaatataattaatatcttttttagtttctaaatgaattgctttaatcagtttattatataaagacttcggaaaaatttcttttaatttttttgcttcacttgggtatacatacggtgttgtatcagtttccaaataatttgcagcatttcttaaaaaatcagccaagttttgaattctatatcttttataattattttccattttacctaagaaaatattacaagtactgcaaataacatttctgactaagccagcgccttgcacacctaaattttcttgttttttactatgtttgtgatcaagtacaggattgaagatcttagaaccgcataaaggacaaattgggtttgattctaccatagaatctctgagttcttttgcagtttttgtatttagaactataagttcttctatttcataagtttttagttctcgaggttttaaatcttgcatttttagtctttatattttatgtttttatattagtatttgacggttcattaacaacatcacgaattaatttaatatcataatatatagttattatacaaaatattaagaacattttccaggataatgtatgatgcatataaaaatcaattaaaaaacaaattatacccactgatatagctatagccatatttaagaaagttttaattaaatggtttgacaagtgttaaatcctagtttaaacttgatatttcaataccattattataaaacaattttttagttttcttagaactaattaaaacattttctggtattgttgagttatctaacgtagatgacacccaagttttattagaactattatatgtccatttttgattgtttgatatatctattatagtatcatcatacacacctgattgtgaatcaaaataaaatttaatattttgagaccaattaccaaaacccatttgacaaggtgaatttaataattctttcaatatattaaattcattatcggataaaacactaggttttgttgttggtaatgtataatcaattaatgagttgtcatccaatgcttggtttagatctgaagtccaacattgtactctatttttagttctagccacttttaataaatgtttacctgctcgccaaattgttttaggataattatctgtaatattgcctttagaagctaataacctataagttgtataaggttcttcattgttgccacaataattaaaaaataaaccccacgaagtaccacctggtaaagcgtttaattgtaaagatctcactgcgcttaatgtatataatttaccattgatcattttagctgctacaacaatacttaaaacatcatcatcattatcttggcccacagctgatatttgcacactataagtatctttgacgccattacttaaaaacatattataataacttgaatttatattacttgctatagcatcttctgcttctatgtaagaccatttagcagcttctgcttgaccagcatcatcatctaatttaggaccactagcagaattcataatagaatgtcttacccaattatcaaaaacattttttaatgtaacacttgattttaacgtggctaaatcagtcgcattatcacatatgtttaaaaattgaactgcaggtgtgttttgaacttgagttatagtgttatttacattttgtatttgctgagttatagtgttatttacattattttgaactttttctatttcggtttttaagctttctgcatctataattttattagctttgttaccatcacctaaatacacggcatttttagaaaatgttaacatacctctttgggtagatttataatctcccgcttctatgatatctttagaatctacatttaatcttaactcagtcattttaaaccttgcccgtcattttttgttatttattttctggttctttagacaaatctgatactaaacctaagcttttaaatctttttaatattttattatacatagaatgtatttcacttggtgtatttcttttaaagaaaatttctgaatttagattctcaattactgcagttgcagaaatagcgccagtatctctaggcgtttcgacaacttgaatatctgggttagctcttaattggtttacatagtcattatatctatcactaccacataaaacagcatttatattcattttagatttattcataatactaataatatttcctgtactatgttgtataatttcaatttcaggaaaacaagattttaacatttctaatctaagatcttcaaattctttagtatcttttgaagttaccaaacagactacaccattatcgtatttttttaatccatttttaataatattataatgagctttagttaaaattctaaacttgcctaagaataaaaagttattatttcctttaagtcttttaataacgatcattttgatattaccttgaatatcatcttttatttgaaattgtgtctttttaggatgtgtaaaattcaacttatatttcttaagagcttctccatacctttgaagtatttcatttaaagaacctttaatattactagctccaataatatttaaagctgctaatctaacgttagcccaataagcattttcagtatcaggatctccttgatattgtgaacgtgtttctgctcttgctttaggatccacttgataaggttgttgaatttttaataagaatccaggataagttaaaacataaccttcaggtttaccaccatacttagattccattttaagaaacatttcagatatttgttgtatatataaatctatgttttctattttaagaatatttttataagttctaaaaatatcattgagttcttgtgatttgataccacgttcgaaattagcgaaattaccttcaaatatagttcttgggtaatcaaatcctaatttcttagcataagtttctcttgaatctgtatagaaaccttttggttttgtgaataatctcccaaatttgacttcataagtacaagggctataagctaataaaattgcgcccatcttcttatacttatgttgtaatgtaggttttttcatcaagaattctacaaagaattcataatttaaaggtaaactctttgaatcacattttttaagaatatcgaaaataaatgtaaattgtgaattattaatgctttcaggtcttattttggatttggctgcgtattcaaactcatcaggatatataatattggatttgtatgaaacaataaaatcttgtttataatcaccagttttatctatatgaactatagttactttaataccatcatatttttcttctactttaactttatcatagataaaagcttcttttcttgcttggctagttaaatatttgtttgcatttaatatagatatatcaatttgatctttttgcattgtattcactttttgttttatttattactaaataaatatatcaaaaaatcataaaggtctaatatgaattttaaagaagttcaaaaaacacctgccagaggttatttttgtattgaaagtttagatgctaatggtaatattatagataaattcgaacagaaaaatcttattacaaatgtagcaagagctgaatttgctaaattgattgctggtatcaatgaaagcaatgctattaatagatttgttatgggtaccaaaggacaccaaggttctgatattttaacaccaaaggatgaaactactggatttactgcgtctgttactgatattttcagtggtcaagaacaaggtgatattaatagaacttggaaccaagtaatttttacaccaagtggtaatatggttaacactgctgctacaaacgttcaggatggtgctaataataactctacagtagatattacagttactggtattgagcaagcagagcctgtagtaacttatactattaatattgcgcaagatgcttttaactgtgctaatgatggtgtagtttatactgaagctggtttgtatagtggtacaaatttaattgctatgagaacctttaaaggtaaagtaaaagaatcaacagttgcattcagaattcaatggagtgtaatgttttaattattggagctaatatagctcctttgattaagatttacacatagaatctaaaatacttgcatataatttagctacttctttatttaccttatattttaattgtatttctttgatagattctgattcagctaacgctttcgcaaatcttataaattttggtttattttttgtgtatctcactaaattatattgtgcttcatctggtaagcttttatataatatattaatatcattagctaattgtaaagtgctagggcttgaccctaaaaatctacaaaacataaagctattaaaacctaaactctcattataatctttgtctttgagacagtttgtaaattgttcgaatatatttgccataattaattatatcctaattttgtttaaattttgattaaaggcttttaaaaataacactcgagtgttagatatactaaaggtatcaagatccaacttcaagtcttctatatagataatctttgtattctttagtagagttcttaaaaacaaacatagcccacttaaaagaatgtttaaataaatgacatacagaatctattggttctctaccttcgaatttagcttctcgcatttcttggtgtgtacacccaacattacaatactcacgaatttcgcacttcatacatttcttgaattttcttgggtcagcgtatttagacataaacttaagattctttagatttaatccagattctggactatatagaaccattttattagttgatctgtatcgctcgcaaggccagaatttaccatctaccgcatataaacaaccgttatttcctacgaaacaaccgtggtctcttttaccaaatctagcacctgctaaaatatctaaagcatataaatcaaataatcctacacttgctggtattcctttatgttgatattcaagtactttatgtgctaatctttcaacttctatagcaaatgtttctatttgacttttagtataaatgttatcacgaactaaacaaaaatcgggtcttaagaattcataatcgttaacaaaaaactcaaaattttcagtcattgttgtgaagttcttgggttgtatcataactttacaggtatctgtaatgctatgaattaatgctttattttgcttaaaataatctaaagttccttcaaaagtaccttcagccactggtcgattagtattttgccatagaccatcaaaactcagtgaaattccacaattatgagcctttaagaactgaacttttttagggtctaataatgcaccattagttatcacaacatagctggtacatcttggatcttcttggaattttggtaaagttgcttcaatcacttcccagtttaataaaggttccccaccaaagtatgaaatatgatagctatctttatcataataatctaacatataattaattctatcaaagaatttcatagctgtgtctatagacatagggtttggtggcgtatgcgcactataacaatatttacaagctaagttacatttagtatctaagctaaattctactattagtttacctgccattttaacctttgtttttagttttggtcttaggtaagcaagttaaacaagctaaaaagtttagttcttcttggcttaaatccgaatctaaacttgagttagattcagaatttaaactaatctttttagcacaacgcaaagcatattttatacccactctgatgtcttgcaaatcttgtatttttaactgaacttcggcttgatttttatctattaaatcttttaccactgtctttaatcctttgtaaaattggacccaaataagcatcaacttcactagcatcatattttacatcatttataagacgttttttagtttctgcaataattttgagaacattttcttgagaagtttctaaaattaataaagaatctacacttaattctataataatatctttaaacatttgctttaatttgttatattctggtttatcggtaaacttatacccaagtaattggaaagcactcataaaatccattattataatataatcacttaaaagttctttataattaacagagtttattttagcatctaaaccttcttgataaaataattcttgtaatgctttaacagcatcaaacccataatcataatcaccaagttctaaagaatgtctaatcttaagataatttttataacttggtctatctactttatcaattgtttgtctaaatacaaccttatcacctaaataagtcagacatttattgatattattaatattatcatcaaaatctttaccattgatagaaactctgtacaacgctggtgtgttgtaaactactgggttatttgcttgtgcgtaatccaaatcatttttatcaaatgttgctattaatttactatattcaattaaattgttttcataacaattcatagctaatttacattggagcattttgatatctggaaaaatatcagtagcttctaattcacccaattgttttaaataatctaaaactttagatttatcatcagttgtatatattttcgaaattaaatacgcagttcttgtttctataccctctgggttattttctatgatatattcgtatttttcgaacatttctacaacttgtgaaagcaaacgttcatcaaataatataaaaattatttttcttaattcttgttgaaccattatattccttttgaatctttaacttcagtttctacatttggtgtagatttagatccatttaaaatctcatcaaataaagagtctacttctgcttgttctttcttattaagttgaatcttaggctcagttgttttagtatatcctaattcatctaaaaatgcttgggataatccagcttgatctaataattcaatagccatagaattaaacattaaagacatcataccattggtttcttgaatatattctgaagcttgacttagatgataggctgtcataagaacttgttttgtttgatcttcagtaaaagaaaattttggattttgtacattcatattcatttaacacctttaaatttaatatatttatgattttttataacaatatctaagtcgattattagcttctaaaatatttctaaagaaatctccagcttgtttagattgtttattagactcaaacgtcagtgcttggacatctttaggaaaacatttaccaccaaaaccttttttaccatctacacataacttagccattaatccttgagaatcaaaatcttcgaactcatttaataataattctatttttctaacattgaacccagcttcatttaattcgtgaaagaataatacctttaaagcacctaaagcatttctagcgtatttaacttccattgcttctctaagactacaaaaatcataaggcgtatctattaattcagcaatttctttagcatacataatattattagcgcctatcacgtgatattttgctcgtttcaatgattcaacttctgttagaaattctggccaggttacaaattttaaattgtattcagattctataaaatctacattactaggcaacaatgttgatctaataacaactaaaccactaaaatcttttgattctatggtatttaaaatttcgtataatgtttttgtgtcttgatttgaatcaatattatcatttaacacattaatgcatataaaaatcttgctataacaatttaaaccaatttcattaagatctttatcattaaatcttggatctattatattatattcaatgcctttagaatcaaaataatttcctaagctttgtccgactacaccaaaaccaattattaagttcatattaactccttaaatcttaaatataaattcaatattagttaaacctatagtatagcctaaacttaaacaagcaaacgctgctaaacctaaaacaataaaaacgaataacttataaaatactcctggtattttaaacacactgataatgctaagaactgctaaaaataaagccgacacatagaagcctaattcaactaataataacaaaaatttaataataattaaaccagttgtttctaatatattatattgtgcataattacttaacattatataccctccttagtatcaaaagctaaaatatgtgctcttggactaaaactaaatccgtgctcagcacatttttcaaacacaaatggtgtattcttaatctgtaattcacgagtttcacccataggcattagatatacttcagtatatataggtaaatcataaagtatttcttttatttcagtgtagtccgtatcccaagtttctggattaactacaaatttaagataagatttaggacaattttcaagaatcttactgattgtttttatattaattcttttctttttaggttctcctgaacaacttaatttaactgacatactgaacataatttctttttggtattctttaaagaactcaatatccaaacttgcattagtctctattgttatttgatgttttcttgaaatataataagctaagaaatcttgaataacattagtatcccaatataataaaggttcaccgccagttaaaataatatctttggtatgtttaatttcagagtttttaaatgtgactaatgggtcaataattgatgttaaatctttgaaattatcaaagtatttccattgtgatttaaattttggagatactgcacgaatagtatcacaacctgttactaccgaaccatctggagctactgcagagcatccaaaacctttacaagtattattacaaccagcaactctaacaaatactgcagattttaatcttggcccttcaccttgaatggtgtcaccaaaaaattcatagaatggaacttttttagttcttgttttgaaaatcatttaatctcctttttcatattatataatataacaacttaaagttttttgaaattgttttagttttatatttaaattaacactaaagtgttaaatatagcttattatttaatgaattcttcaatataaaacctagctctatttcctaaatgatttagagtttcaggatcattaaagttagcaccgataaactcattagttaaaaatcttactaatacctggtgttcaaaaactgttaaagtccaagaatctaaaaacttactgatattagcttcagcttctaaaatatctttcattaaaacttctgcattttggttattcatttatatctccttttgttttattatataataaaataacttaaagtttttttgaatttagaaatttaaatgttaaagtgagaaagatctaagttatcttagatctttatttttgagtgtctgtagtctgatttgaaggctgagctgaattttgacgattttcataatctgctttaattgttgaaaaccatcctttataatccatagttacgaaattcttttgagcgttcgtaaaataatttaaagcttcttgtaagatttgatctaaagttgcttcatcatctgtcatttccatttcatctaaaccatttaagaattcttgatacattttttcatattgatttaattgattcacaatcttaagatattcttcaagactagcgattaatttatcattatcagtttcaagaattttaatatacatctcttcacgattatcatcagttataaaataaccttgtgaagcaaatatattattaagatattggaatctaaaataagtatattgtggtattctcgtaaaaatctgactaattgcagaagttaattggaaaatatatgaattcttaactaagttagcactctcgtcaatttccaagttttctaaagttaacacatcaatatctttatagaatttacaagtttttttatctgctaatgcttccaaaactgctgtaaataatttactatcaaaaacttctaatgtgctagaccccggtaacaaaaaagcattgtctctttgcgcggaaacaatcatattataagcaccttgatctatatatgttatatacatactcataatttaatcctttcttaacgttttaaccattttgggggtataatatctggtattacatcgaaattaaaagttgaactagcaccacaacgtgaacaagttactgtatgttccctagattcaattttaaatatcattttttcaaatgcttcagaaatcttatccattatattaatatctaactcattgaagtagtccttaatatcttggaagccttttgtgttatccccattgatagatttaatatggaaaatcaaatcatctgtgcttggtgaatctgaagttcttaatttgttattatagagttcgatattttgaacatcttgtagttcaattttgatatcaccaatatcaatatcttggattttacctgattttgttgtaaatagtttgcttaatttaattttagaatcagtagttttttcacaacttctgcaccaccaactgtaatttaaatcatcaccaagatttataattcttaacaataaaaacaaatattctaattcgtcgttatttaaagctgtcgggttttctaaaacatttgtaacaaaacattcatatcttgctttaagttcgtcttctgtggaactagtattttttaatttacttttatagagttctctatctttaactttccaattacgaactttaatagatctattacctaatttgatagggttatattctaataccattaaatctccttatttgttattatattatataaatgcttaaaatctgcttaagtttttgattacgatactctgatgaataagcctttagtatcgcttattttaccagtacatttccaagtaccttgcatatatgcataagtgtctgtagataaaccagatcctgcatataaattattaaaaactaaagttgtttttgaatctaatatagctatactgccaatttcattaatgccaatattagttaagtgatttgtgaattgagttcttgttatattaatttcagcatttcctgaacctgtgatatcagttccatttatagtttttatagaatctaatttcttagataaagctaaatcatttgaagttttataatttgttaaatcattattaacttggttgtatttagtttctaagcttttaatatcatcagtaatggtttgtatttgttcagcagcttttaaaagtttctccatattttcgggatctaattgttttagaactgtagattgctcaattattttatcactaacagtttttaaccacgtaataatattagcaaagtttctatctacttcttggtgtgttaagacatctaatttaacatctgtagttaagttatcttctttagaatctgtgaaacttggtaattctggtacttgctgattattaataatacgtaatcttacgttcactgctgagccttttttggatatttatttccgatctataatataatttataacaaatgcaaagctaacttctctgggtttaaatctatatcttttgtgctgctagggcacccaataaactggctaaatgaccatttcctccagttaagaatatcataacactcctttaatttaaaattgatttaaaccctgtttttgttaagatatgaagggattttagatcttactaaaatccacattccaaggtgtcatttctataggtttactcatttcattccataattgactaaaccattgactacaagtagttatattataaaatgaaaaatacttattaagattttccatattaaaatctgtactagattctgtatatttctttaagatttctaattcaatatcaataggtatttcactatccataactaacttataattacgattataattaagtctatatatttcgttagaatctaagaaggcgtctaaagaaccaaactctttaatctttttatttaaagcagcttcaccaaatctttgttttttataaacttcaacatcaggataaatttcattaaaattattaataatacctagttttaagttttcatctaacttatagaaatctaattcggttccttgataataagctttaaactcaggtgtaaattccgaaaaatccacaacacgtggtacattatcagcagcatcacctaaacaacaatgtattctttcccaaccttctggatcatcattaatgatccatttattagttattgctgaatattgttttatatcgcctaatttatgcaattgtttaaagtctttatcgggacttagaattaaaatagattctgctttgcagaacttcctagttaatacaccaatgatatcatcagcttcagctcctgggacaccaatagctttaaatggtgtataatcatttagaattctaattagtatattaatatgtttataaacttctttaaaattaacttcagattcttctctttgagtttttctttgagctttataatctggatataaagattttctccaatatggaacactatgatcatctatacaaataaccatagtattatatttacctctataaagtctataattttctaataattcttctataattctaaaaatagtcccacttatgaattcttcagtaatatatttaccgtcttttttatgtggattcatttgcttaatactagtatgtaaagctctgtgaatcaaagaacttaaatcatataaaatcatatataatccttacaataatggtgctaattccataatacaagcagctaaatttaagtttctatctcttgagaaagcactttggtattgatatttagctagtattatgatagcttgtggtttattattattttgaatatctaattttttaaatgcatattcataaaaagcatctgggtttgttaaaccataaactactttcattaaattatcgaaatcgcgagatctaattaagttaattaaaccttcaaaatcagaatctttttgaatgtcaagaactaatttattattgaaattacatttttgtaaacaagcaatcatacctcttatacttggataatagttcttaataatattaacaagatcctcatttgtataagaaactttttcattatctaagatttcttttagtaaattaaaagctttttgaacaagttcttgtttattagaagcgtgaacaacatcaaaatcaaatacttcaaatctgttaactataggaggcattatattagaaacataattacaagttaatatgaatctacaattagcagcaacttcttcaataagtgctcttgcagctgcttgaccattttggccaaagtagtcaaattcatctgctaaaacaattttaggttttccatcaaagctttcagtactagcaaattgtaatattttacttctcatagtatcaataccagattctaatgaagcgttaatatataaagattcaaaattaccttcttttataatggcttgtgctgtgcttgtttttcctgttcctgggtttactgaacttaataaaatgtttgacggtttttcaatatattttctaaatttatctaaataaacatttggtaaaattaagtcatcaattttttgaggacgatatttttctacccaaatatcgtgttttaaatctactgtcattgaactccttttaatattttcttaattataatatattttagcttgatacaaaattaaaatttaatttaaaattataacattaatataaacttacaccatagtggattattaaatttaaatacgacccaaatctatgaaatgatacaaatttttacagattttatatcttaagaatgtttagcacacctcataaaatattttattaagttttattatttcttcagatatgacataatcttcatcttttatatcaccatacaaaacataatccatattagaatctaaaacaagttttaaaatttcttttttgctttctaagtctaaattttcaaattctttatcttttaaaattttatttatatctactctataatctaaaaaagctttagtttttaactcttgataaatattatctaattctttttcatcatttaaattttgtattttttctttataaattgcatttaaaggcataagttcagcataaacaaaatttccaccaccgttgccaattaattcaaaactccctaaaacttttggactgaaaagtgtgtctatttcatttttatttaaaatattatcaaagaaaatctcattatttttctcaccttttgacggaacttcctttaatacacaatttttggatggaaaattaagtactatattttcgatactcttttgtctttttaccattttattatcctttttatttataattaaaatcataataaagattttaaatgtaataaagcaccgaagcctttcttaaaaacaagttctattttaatattattttgaagcatttcattaaaatctttttgtgttaaatcatttggataacatataaaatgactatttggtatcgaattatattttatcattttttcaattccaactttgtcgttatctaaacaaaagaaagggcactttattaaatctaaaacattctttgctattgtggaagtatttaaagctattatttgattagttctgtatatttgtctaaaagacaaagcatcgagaatagcttcaaatataaaaactggtttatttaaatcaacattaaatagattccaaactccataattttgattcaatgtaaaattaataaatcttttttcagttaaagatcttgcatagaacccataataattagagtctttagaaaatggaattacaagatagtctttgattccataataaacaccatttaaattaaaagatttagttccattatagaaatctaaaaagttaatagtatcatcgttaaacccacgagattttaaaaactctatttgtttacttgtattagtgtctaacactgaagttaagttaatatatttgaacccattgttggagctttcaatgctagtagagctagcaatgttttcaatacttgtattgctagattcattagaatcgctagtattgctagcactagaatcaaaacaagacttcatagtctctatttcattattactttctatgttagatttggtactagaatcaattgaattaattttaaatttaaaattctctgatttatacggcaataataattctggtttataaatctttaagaaattacttaaactcatttgagtatttaattcacaatcaccattaaaacaatgaactaaagtaactccttgtttttcatataggtgtagtcttttaacagattttttatattttgagtctccgcaaattggacatttaacagcaatatccaaagaactttctttataagttccaggaactgctaacttaaaatacttaatatctacaaagtctaacacctatatctcctattagtaaacgttttctaatcttaattcaaactcttgtattaacccatcactacccattgtagataattttaaaatatcagttttacccgctggtattaattcacattcattaatagatttaatttcattttcatttaataatgctagaactttattatagttcttattaaatgtatgttgattaatattttgagattgaactacatattccttttgtctatgataaaattttattgtattcatacttaaatccttattaagaattattaaaatgtgcaaatcttttaagatttaccactcgatccaaatcctttagaccctctttcttgcttagcttcaaaatccttgaattcagaattattaagttcgacgaacttaaaactatattttctatgaattaaaacttgcgcatatcttgaacctttttcaataactatagtttctttaccaatattattaattttaactccaaaatctccagtatatccagcgtcaataataccaatatgtggaattagatcttttttaaaacctaaagaacttcttaaatgaacggtcatataaaaaggatctttttcatcaattgaaattcttaatccatttggaacaacttttgattctcctggtttaatttcagttgtttcggtgcaagtaatatcaaatgctgctgaagttccattataagcaatttctggtattacggcatcttcatttgttttatgtatataaagattcaaatccattatttctcctattaattagttttagattttatagcttcgattatttttaatatcctagaatctgggtctaatttagaatctaagtgaatgacgttttctaagtctactttcttaaaaatattgtttattttagatctaaattcaggatctattgatctaacaccatttgattctaatggtatattttcagaatctaaaacaaaaataaaatcgaactgtttataatattttattaaagaatctgtgaataattttaaatcgatgtctttgttaatacctgtatatactataacatccaaaatacacctatcgtgcacagtgggtgcatttatattttttaaagcattaacactataatacaacatttgcaactgtgttgctaagtttgtattttctgagtgtttcttgtttgttttagctattttattagaaaatgattctatgaaatcaaaattcttaaaataactatgtttcttcattaaattaattaatgtagttttaccagaacattgagctcctgaaattgctattctaactggtctcattacaatcctttttgtagatcttcaaaattatatttaatattattaatttcaattgtatcattttcattcataatatatgttttaccatctattgtgacttcatagaatttaccatcttgtagatcttcaaattctgcgttctcagaaagtatttgatataattcagataattcgcgattggctgcaaatttttgattagtgacatcccaagaatttaatggtttacctttaagaacatagaagctcgtatgttcatttccaagaacttgtgatataccaccataagcggaaaaaccttcacaaatacaaagatatttttgactttttgttgctctaaaatatttttcagattttaacttcttagatttttctacactcttaagagctttatctgcatttaaagcttctttaactttatatatgtctataataggatctataatagatttatttttaagaattttattgatgaatccataatctatgttagagaattcattaaattcttttactgagtttgtaattttttctttagattgtgaattaaatttaagatttggcattccattaataaaacaaacaatcattaatttatttttaatatcgccaggtttaatacttttatattttttgactaatttgtctcttataccctgaactacgttattcataatagtatctatgtgaacaccaccgtctggtatttttaaaccattaacaaaactaaattgtttaaagtcatccaattcatttgggatgataccaattttaatattttgattttcatatagttcaaaatctgaactaaacatatttaaataattcttaaaagatttaaaatctattttcttagaattaaatttaaaattaatttctgggtaacaaatagctaagtttaataatctttgatagattatattcttatgagtttcatcgatttctttaagattaaatctttctaaatctggtttaaattctactaaagttcctgattttttagaagcttctatattttcactataagtttcagcattgtttttagatttaaaaatatatctatttttaccatcgtctgtaatacctttaaaattaatactccaaacatttgtacaataacttccaactccgttggtacctattgttacacgattagcatcatcatcgaagttagaacctgctttagcgtgattccaagctagttctggcatatagtggtcacctgattttattactggtataccagttccatcatcttcaatgctaacagtatcattagatattttaacactgatatttaagccagatttaaatttagatctaattgcagcatctactgaattatcgataatctcattgattattttaattaaaccgggtacataattcaaagtagtgtatttaattttacctgattctataataaaatcttctgtatttgtagaatctatagcacctatatacatactaggtctttttagaatatgttctctatcagtcagtttcttaatcattatatctcctttatgatattatattgtaaaatatcttaaaagtatcttaacgttttattattcacactaatacaaagcttcaatacaaatattttaatttgtttaaactatcagaataaccactacaatataatctacgtttagtatttaaaccttcaatataatacccggtgtgtaaatcccattttaaataccaagtatctttttcatttttatgaattttaagccctttgatttgtgctattaaattataaaaaaattctttcatttcaatctcctttgagtaattatattataaaatatcttaaaacattcttaattcaaaactaaagttttaaatcaaaaatcataaaatcataaataatattaaaagagggtctatgaagaatctaaaatgtttcgttatagctttgttagctttgtttataatagggtgtggatctgattattccagcgataaaacaggcaaagaagttcgtggaacttcggattccagaattaatcaagtttgtgtagacggtgttttatacttatcgacgggaaattatgtaacaccacaacaagatcttaatggtagtttaattggttgttctaaaaaaccagaagttattattgatcagctcaaagaaaaacaaaaaaataaagatttagctaaacttgctgaaaatattaagaatgatattaaggatgatattaaggatgatgtaaaatctgaagttaagtcagaagtcaagaatgacttaaaatctgaaataactgttgaaatcaatgaaagtattaagagtagattagataaaaaccatacaaagtaactcacacaagcacttaaagactaagattgttttttaagtgctttattttgttcttctacttcatcatttattaaacttataaagatttctctttcaaatggatataaatcatttaaaataccatctatggtaaacttacctagaaatgataatcttgtcaaacttttgtagaactcacctataggattctctgaaaatatatttttatatatttctgggtttgttaaatcaatttcaagatctttcttacaattataacatttaacaactttaataaagttaaatttagtagtattagcttctaaatacatatctaattcagaatcacaatccacaatattagattctaagtaagaatcactgtatatgtcggttaaatttgggctataaacgtctttcaaatctgggtatgtatttgtatcaatactatggagatctccaatttttcctaaatctatgttagatttaaaagtacaaccacaatcacacctagtatttaaagataattggtcagaaactgaagttgctcttaatctataaagtaaaaataatttttcttccggatataaatcataaatgtttatattagaatctatataaggttctaagattcttaagtaaatgtctaagtttaaatcatttagatctttactgcatacagtatcatctgagcttgcagttaataataaatctctttcagttttaactttgtaagctgttaaagtaaattttctatcgttgtatttaatatattctttcatttagaatccaaaattttaataatattccaaattactgagattcaaatccttattatcagtattagaatctggctctgtacctagaccatctgcaaaagctccaaatgttagatactcaaaactttttccttcggaactttttaaagaatctacaatttctttcatatcttcaaagttcttaacatttgtaaaaataccaaaacataaacaacaagacattactaaatcatcgtgatatcccacagctgcttggtacttaccattatcatttaatgtaaataccccaaactccttaatagtttctttgtccactaataataatttattagcttgtgctaacgttgatacagtttgtaaaataacatcccttgataattttgtagttctgaacccaggatattttaatctttgtttttgtttattgacgtcataatataagttttcatattcataatctcttttgagaatatcagcaaccacttgaccagagccttcattattttctacaattattaaagcttgattgaaccttaaaccatactcattgagtaactctggtaataacatataatctattttaagttttgctgatgctacttgtctgaaatttaaatctgtagtatcaaatatttggactcctgtaaaatcagcaccttctttagcagtatcaacacccataacgtatttatgtccgggtattggttcttcgtatattagtattttagaatccttaatattatcaacttctattggttcttgtggtttataagtatctaatatttcactaggtatcaatgtcatcgcagaaccttcaaatttgcattcgtatgcagaattccaaacaactaaaccaccggttttaatttgttgttgcttgaattcttcaggatcatacttagtaccgtcagatttaaaccttggtactaatctccaatctaccctatgtcttacaaatccattaatagaagtttctaaagtgtcaccagcaccctgccaaatatcgtaaaaatgattcttacctttaggtgtagataaaatgactaattttttgaaagctaagccggcttgtgatggtaaaacaccgtcagtgaaatctatccagcccgcaggatctaaatatgcacattcatctacaacgattatatttgtggacgttccacggaatgcgtccgaacttggtacgtccgttaaaatctttatattattttcacattctattgaacctttattccaagtaactgttccgggctgcatccatattggtaagcctatcaacattttctttgttttgtctaagaactctcgtgccgagttaccactgtaagcaactatgcctatgttgatatctttcttaaaacagtataaatgcgcaagttttacacttgttgtagttgatttagatgaattatgacttaaaacaccattggtgtaataaaggtgataatgctctaaagttaaatcataacaatgatcatattttataaatgttttagatattattttagaaggtcctgattttgttttaattaccttatttaaacaatctctaacatataattcgttatcattttcgtctattaatacgtgtaattcagatgcttgtaacttgaatccattttcggtttctatctcaaaaatattgtatttaatagttttatggacttcgagaattttgactttacctataggcgtttctacatatttgtctttacattcataactttcaataattttcaattttatcacctttcaatacatctatatcgaacgcttcggtagtaaataatctgttatttcttattatattaattctattgctatcaaatgattttaaaatattttgttcttttttaaagcattcatatattaaatcttcgtatatgtctataattatatattgcatacctttaataaaaaacttaccaaatctaccatctacagatcttttagtaatacctattttataaaatgtaatattattatcaaaaaatttgacataataacataagcccttagtattatgtagttcaccacctggtttatatttagaatcaatattagaagctttggctctgtttattctaatcttttcttctgtagacttattatttagggttgttaaccatttttgaactgtgttattaaaccttttagtaccttcttcaacgccatatctatatataaacatatttaaagaccttgtgttacagcgttcgtaatacttttgttttgctatatcattatccccatataatttgacataatattcataacgcgcattttcattttcggggtgtttttgtttcgtttggtgagatttcacacgtacatcattaattttattttcaatttcagtttcagttaatcccttatacttaataaaattcttagaatttgctgaatacaaaccttggtgattaaacccagggttattaaccttaaacaacgagttattataacggtaaataccttcagtcaaaccaaattgtaatattaaatatgcaagcgtaccactaccatttatgttgtttaaaagtcttattctttttaatatgttcgtgacatcacgagtcattaaaatttttaataaattaataggtaaaaattcgcgatttatacgtcttgtgtggtatatctccattaagttattttgttgattccgtgttaatttcacaccactaagccctagagattttaatatattttctggagttactttagtgtttatttttgtttgtaacttacttaaatcttcgtatggaattaaaattgattgtgtattatgtttgagtatagtacctgtataatttattatataagcgcgttctattttacaaacataggtgcaattaaattttttacgattcactaccacgcttacactcctcaaataattcaataatagtagtttcattaccatttacatttattttagtatttgcttcaatgcattgacgaggctgcattgatatcacgttttcgatagaatcgtcgctcagcaattgtataaattcatcctggtatggcctagaatctacgaaatcaaaaccttttggtgtagtcattcgcacataatttcttaagaaataaagtggatcattcgcacatttttcaagctcgctgatatgtatcggacttaagtttaattttgtgtaagcttttttaagaccacgagacccattataactaattctcgtattatacgcatctaagtaatagttatcagagtctttaggtaaatctaagatttctaaggcttgtgcttttcctagttttccttgagctctaattgtttctaagagttcgtctgttatttcatttttatgtgtttgaaaatattttatttcttctttgcttaacattataaatctttttatgattttgttttattatattatattatatattaaaattaactgattatggtttgaaatttgaagctgaagagctaatattttagtattttaaaatgttagctctcgagtaaaatttggattttaaatgtttaagaaatcgaatctcgatctgggttatatgcattatttgcagaaaattgtgaagctctcatatccctatatttttcaatagaagctagtcttgatctaatttctggcatatagtcgaacttatcaattagaatagctctgaaatcattacttgcttgagccagccctttattttgaattacattctttacaatatcgtcatacattttttaactcctgttatagattatttgtttttatttttgttcttaagtatttcaataaactctaagaaatgttctttaagaatagattcttttagtttcgaatcttcagtattatctttagaatcgtttgaatcagaatctttcgaatctttagtatcagctttgctatcgctgtcagaatctttagcactgtcagaatctttagattctactaatttaccatccaccattacaaattctttttgtgattcatatatagatgttccttccatagtagcattataatcgcttggtgcagatactaaatcatatgtaattaaatcaaatgattcgacaataccatttttaactctgccagaacctctactagatacagacaatttaataccattatctattaaggattttaattggttagctcttggattatctaacaatgtagcttcacccataacatacttgccgttgatttcaagtttattgatggcagcaactgcttccataggatcaactgtacctctttcaggatgttcccactcacaaagtctattaatagaaccgctttttataacgtcttggtattttttaacattactttcccagagttcttttgggtaaattctaccgttacggtttttttcacctattgttgaaaaaataccagcaattttatattttttaactttttcttttttgtcgttaactgattcttcgataagtacattagcatcgtgatattcataaagtaattttaacttatctgacatttaaaatccttgttttttttgtatttatttatacacttggttttgaatcagagttaaatccaggatctacaggctctggatctctactaaaatcagaatcaatagtctcagaagttatatcaaagacagattctcttaatatcgctgtttcgttaaaattgaaatcaatattgaagtggttagtatcatctaaagatattgattcactaaaagttgcgggatctggtttagataccaaattaatagaatcttgtatgctatattctggatcattttttattggttcgttatataagaatatattacctttataagattctgctaaatctaaatcaactttaagtggtgatttataaactaaccccctcattttaatccttaagcttcaatttctttaataataaaatctacagttttaattccaatttcttttattttagtatagagttcgttgcaagcatctgctgaactagaaacaatgccagcacctctggttttaccaggtaaaatacaaccttctgtatcttgtgggtaatttccaatatgtattctgattaatctattgttaaaattagcatcgtttggtcttttaacccaaattgctatggttgatcgatctttattataccattgtgggtattttttagctaatccaacatttttagaactagcacaccattctaatttataagaacctgctgttatacgtttatcagttcctgattcttctgtgcttggtccggcattttcacaagcagcacctttccaaagaatttgaccattgtcatcatataatattaaatcagataatgtagatccttcgattttttctttacttagttttctaacattggtacattcttgtattctttgtaagattaattttgccattatgatcctttttatgtatttattcacttatttggatactaaatatagtgctagatctaacactcgagtgtagatttttaaacattaatagcttgaatttttttgtcttgacttgaagcacttaccggttgaggtaccaacataaattgtggtaaagaacctttagatcttaattgcaatttccataatttaccgtctattttaatattccatttgatatcagcattaccatcacaggagacaacacagtattcgatttttaaatctgaaggcaatgtatcaaatacttctaaatgatttcctgaaactttataaaaattagaacttaatagagatctacttaaacaattacaaacaacttcaaatataatatcattaaaatattttgaactcatagatataaatgctaaactcggtggaaacccttcgaaaaaattagcagctttagcattgctggcaatttcatcataaatgtcagctaagttaatgttattagttctaactctaatgatatctgaatttttatgcttctttaattcaaccatacattctttaaaaaaattaaaaaaattattatcgaatgatttatatttaatacttttaaaatttggtaaaccataattacctgataaattattcaaagcataggaaccacctaaagcttctttagcagatttcttaagacttataggtattatattatcaaaatcattaatttctttgttaagttcttgataagttttgtatgatttgattttatatgtaggtttaaccaaaaagaaatctccaggattccatttatcctctgctaatttagttaattgtttaccttgctttttaagatcattaaaaacatcagttttgtggtgaaattcataatttctaaggttttgttttaaaataatttcatttagaatacatttagatgcatctttacaagctttatcccaatctggattttcaaataaaaatgttttaacagaatctaatggcgtcttagtcctagtatttttaacttgagtttcattatagaatttaatatcggttaatttagtatttaaaaacatatctaaatagtatacaacgccacactctgctaagtcgtctttgttgtcacttttttgaccttttaatgtgataccagatacattagatttatgaattttactaaaaggtgcttcacctttctttccattaatagaacctttaaagtttttatattttttagtatctttgtcatatatcaaaagttctacagcatcgacattcatacttttaattaattcaaataatctaatatttgtaggatcttttaaatcaaaactaaaaacaccaagatcaccttctaataaaaaatcatttgtttctaatttcttaagaaaaggtttaaaatattttggtttcttaataaattcatttacacttaaaggcatttgatttgtcctatctgaaatactttgttttcaatatttaatcctgttttgaatctcgaattcttttaataacatctgctgttgaaataacttcaaaatcttctttaacttctgtacttggatgcaatgcattaattttattaatattaattaaaatatcagatatccctttataagaatccgttagaatttttaaagacttgtttgaagtttcaattagtttactataagcagttactaagtctgggttatatccttcaatttccatttcttgaactaggttgtcactcataacttttaattgtgctacattagctaaaataatttgtcttaatttattataatcgtctactactaaatccaattgaattatttcatctggatttaattgagctttattaattttagctttctcagaatcgaactcaacgatttctgcttctattacttgttccattagaaccctttatgattttataacagcttcttttaatttaatagattcaaaataatcgatcaattcgaaattatcgaaattaaaggtaagatcaaaagtttgttcagcatcatcagcattcgatattagttgtaaagcacctaagtttgtgattttacaaccatacatagtcatactgactaacgattctcctttattgtcggttatttccacaccacaagtaaattcttttaatggttcgatattaccattatttgggtgaactctatcgaaaatatatttgattaattttgtatatattttgaaatcttctcccacaaggaaacctacagttactgggtcatagtctatgtggtcaccaccaacataaatagttttaccgccgaagttggcttgacttgggttcagactaaaccccggtaatgctatattttgagcatatatccattcatcgcctagaaaaggtaaaaatattttataattactagattgcgaatagctattactagtcatatatttccttgcttgttatattatattcaagtatttattttttatacttacggtattatattaaaatataactgaattttaactgaaatgtagtcattgttatatactattaaaaagccaagcattttttatactttttaatattgctttaagttttaagcatatgctaggatatatagcattgttatatactattaaaaacccaagcattttttatactttttaatattagtttaagctttgctttaagttttaagcatatgctaggatatatagcattgttatatactattaaaaacccaagcattttttatactttttaatattagtttaagctttgctttaagttttgttttgaattttaatgtgggattccaagtccttgaaatttttttaaaaaaaatttttactctttaatatgatatattataatataaagctttttaaaaaagttttttcgagtttttaaaaccaaaatttttagtttagatttaaaacttaaaacaatattaaaaagtataaaaaatgctaaggtttttagtagtatatactatagtattatatcctagtatatgcttaaaacttaaagcaaagcttaaactaatattaaaaagtataaaaaatgcttaagtttttagta

SEQ ID NO: 8 - DNA, 39433 bp, Camplyobacter Phage CJLB-13
aatgcttaaaacttaaagcaatattaaaaagtataaaaaatgcttcaagtttttaatctcttaaaaataccagcatttgaaatcttaaaatctaaacaattattacaaagaatcttataattatcagaaacagtgataacatcggtataactgtgtgtagcacaagaactgccacaattttcacatatactagttaacaatctaatatcactacaaaatggcataattctattgacatttctaaagacttctacattataaggttcattgatattattagtaccactttgtaaagcacataaaacaaatgttttattagattctaatatattattaataatttcaggttcaaaaaattgaaattcatctaataatatataatcatatttagattcactgaagttttcattgctatagtattgtatatttaagtctaaactaggtctaaaacttcttgatataaaatcccttgtgtcagttttgggtctatataaaacataaggtttgtcactaaaatgaagtttctctgcttgtcttaacaattcaagtgatttcccagatctcataggtcctataattaatgaaatatccattacactccttttaaaatgttaaaaaaaataaaactatagtttaaaatctaaagtttaaggtcaaaaactataaactaaaaattaaagaatgattttctaaatgtattaacatcttttattttagaaccttgaataggtttaaattcacaacctgctttaagaacttgaggctcaataccatcacagatataaaaatacttacaagttctacaagcatcacatttcctataacttttttgtctattagatgcagcttgttttgctaaatttactaaattaggttctaagtattcatacatagcaatattccaatcgtaaatatcatagatgtgctgataatatcctacaacgtatttctcatacccagtcatataacaaaacgggacatatcggacattgatcaaaggtatacttgatgaatctacaaatctttttataggttctaaaatctcagaataattaacaccttttgattttgaattctgactaaaataattcaatggtagaaaattcatttcaagtggttctaatttttcaacaacttcgaaatattcagtatcaactaatttataatttacatcagtaatagttgaatttaatctaacaacaatatcaagatcctttgcattatgaatagctttaattatataattataagaattttttatcccagttattttatcgtgagtttcattaacactatgtaatgaaaataatatttcagataacccaagatcttttgcttttttaagaaaatctttattctgaaatttagatccatttgtcaaacaagatattttattatctggattcaaagatttaatatattctaggattttaaagaaatctgggtgtatggaagattcgcctccacttaaatcaaaatctctacaacctatactatacaaagtatctattctttttttaatgacttcaaatggtgtctttttatctaactcattttggtaatagcaaaaataacaacgatagttgcagtatgtgccagtgtctagttttgctctaggacatatagtgtcattaggtaagtaagcgcctgctgaacttagagtttggataacatcactatgcatcacgaaccttggtaaggtcttttattaaagaccagagataagattatgtttaagtaagtaatctgctaatggcttcaggtcacctggattttgaatatcaactgtacaaggcacaaatttattagcatcattccaacgaactaaacaatcatacacagattttccttggaaaactcttgtaacttttttaacttcagaaactttattcatttaatatccttttattttaagcttttaagtcttaggctcgaatggtatcaaagcaccaataacttctggatttctgtctatacaacaattaattctttcaataccatctttagaatccactatccaattattgtgagtatggccgtgatatatttttttaataccagttaaatcatatgattttaaaaactctggagcttctttaggtattactgattttgaatctaacggataatgacaaaacaaagtatctttatatctaatgatatcagaaactgcactaaatccaatatataaaatactttcagtatctaaccacttgtcgtggttacctcttacaaaaatttttttgcttggtaatgaactaataaagtgtcttaagaattctatatttttattaggaccacaatctaaatctcctaaaaacattaaaatatcagaatcttttaaaacagatttaaaatacttatgaacttcttttgaatattctaaagcatcatcaatatacctaccagtatattttataatattttgatgagatatatgtaaatcacttgtaatataaatcattatcaccttttagtttatttatgaatctgtgattttatgcatttaagattttatatatttttaatactgtatgtgattttcgagtatgtgattcattcgaagtattcgcacactcaatgcaattcaaacaatctatagaagctcgacacctcttgcaatccacacattcgtgacaatccaaacaataaacgcatttatggcatttaaagcaaccttggcatttataacaatcaatacaatcaatacaagatttacaatcaatacaatctttagaaacgcggcatttataacaatcaatacaatcaatacatttataacaatcaatacaattgaaacaatttaaacaatctttacaaactactaaagactcagaagcttctttcgcttgttcttcagtatacatagaagaatcccatttattgttattagaatctgtgtaatagccatctattaattgcatttcaactcctttatttgattttttaattataatatatttggactaattttaaacttaaactaaagctcggaatctttcgaatcctgtattttaatattcattaatttcaaaatatcaccacctatttttcttaattcaataggtatcttactgaaattaaaacttaataaaacatcaaaagattttttatagtcacataaagtcatattgttaaaaacgtctacttttagacaagctttaccaatatggcttaattcttgataatctttgccaggtggtacgtgaaaatgatataaaagatttttaacagttcccctcttatattcaacatctctgtctttagaatcatcagtatgctccttaggctttttttctacagtagtttttaataaatcataattaatacaagcattatattttttgttcataacatagtaaattatctttttggaaaatcttgctctgcctaacatttgtaaagaactaataacgtctgtagaacttgcactatcataatgaaaatgtatatcaacatcattcagaatgttaactcctacagttaacactggagtgtaaataaagacatcacaatctagcgcttctttagacctaattttatcatatataatattttttgatactgagccggtttctttattaaaaataattatttttttatttagtatataacacatttgtttaataatatcaacaacttttatactagttgtagaaatagttatttttttattagaatctaaagcatttttaattaatgtataaaaggtattgctgtcattgcaactataaagttctgtattattttttgtatagctaacaacatttaaaggtttagtaaacatattgtccacaatgtatttacttaaaaatgcatcagctacaacaacttttttatttaaagcagtatagaattttattaagttctctgttttactattcaatgcagatcttgtatgcattaataaactcataaactcatcgagtataattaggtcgtagtcatctaaatcaaaatgtctaaaactgtcgtattgacaaattaaggatttaccttttgatctaactatttttggttttttggtttttgtgacaaaactagtattagcattatttaaattactaacgttgtcaacattactataactttcaataagtctgatagcttcttcaccacttatgttgttagaattcttagaatccttggctttaatagcatcagtataatctttataatataaaaacttcttatattttcttttgtaatcttctgctaacgtaactctattagttataattgcaaccttaaaatctctctctagtgctgcttctataattctatctataaaagttgttttacccgaacccataggagctctcaaagtcagagcaccattatgcttaaacaaaaaagcttctacaattgaatctaattcagacttaatttctgtaaagtttctatcaactacaatatctgctttataatctatataaggagttatatcaaaagtaggttcatattttatagcttctttccaaatatttactgacatataactttcagtatgattcataatatatggattatttgggtaccaaatataattttcagaatcttttgtgtattttatagaaccattagcattgatatctactaagataaaacccaggttcttaaaaattgttttgcatatttcagtagtttctttagaggtaatattaaatttacaatctaaatctatgttattatagtaatctgtaacattcgtacctataggcattaacatagaaccgtttgggttatccaagagtatattatctttattcaaaggcgctgtataataagttattcttaatgtatcagtagtatatttaccatactcagaaagttctttttgaattttagcttgcaaaacttttagttcttttaagctcattggagctgttttaataataccttttaaattaaaattattaacaccatcataagatctggattgaccgatagtgcattgtgtgctcttaaaatagtctaatgccatatttttattaaactctgatttgcattcaaaatcaaataataaatgatcaaatgttttaattatatgaggttctaaatctgtttttaatcttctggatttgccaggtccttttaagtctaaggcaatatttaaacaaaaattattaacaagtagttgaaatgcttggtaagtcgtttggacttcaattgtttcaaaaataaaagaattgtcatcgtatggcgacttagcaaacttttcatttttacttgcagttccaaagattgttattttcatattttattaccttaggtgttatatatgattataatatagctgaactaaaaagattcttaaagcctaaagatcttagctaagatctttagactcaatttcattattagtagtggttttagtagttttagtagttttagtagtgctggctttcttagcatcttttttagcttgttctaactcaatttcagccctttgtaaatcaatagaatcaaggtcaccttctttaataatatattcaagaaactctattctataatctaaattatctatgtactcacaataagcatctgctttcatacttaaaccaaaaacattaatatgagtagcaataccacgtttacacatttcataagcatcgaaccaaaactcaacaccatctattaataattcaatttctttcttggtaagatatggatttaataatgacttcatatattcattccaatacttattagaaaaatcaaattgcgttttaacatccgaatgtttaccagaaactccaaaacttactgaatggaacataatacttgagttctcataaattacacgtgaattaccaattaagaacatcatagcaccacaagaatatccaaatgggtttaatactgttgttacattaccatagaactttgttctaattatatttgtaaatctattaagttcattagcaaaaccacccacactggctataaagatttgtatagaatcaccttcattagcgtcattaagatcagcaaaaatattttctaattcaccttcttcgtgatcaaatgaattgatatttaaagtataattagtataattaaaactttttttgtataatgaatgcctcgtatcttttgtagatataatatccaattcagaatcctcaatttttgttttattgtttatagcttcgtatctcattttaactcctcttaagctttagttaatatgttcttaatagaatctaaagattcgacataatttttaaatgtatccagattttttaatgtttcaaatttagctttgatttctttagcattttgtactaatttttcaaaagtttcgtttgtaaacgaatgtattggtaacttaagcaaataatcataactattctcaaacttaataaactctttactttcaagatccaattcaatatcctttttagatcttttcataatttgtaactctgaatcaatgattaatttaacaaatcttaatttttgaatattaatatttaaatcattttcaagaacttttaaatcaaaatctttttgtttaaccaaaaatctttttctaacgtctatgtaataatcaattatagattcaatattttcaaaagttctgacttgattattttcatccaaagcattatatatttctgtttctcttttagataattttaatatatcgatagctttctctttagagatattatcgaaaaatataacttcgaatttaaattcttggtttctttggtctgacaagtctttataatttttaatctttttagtctctacaagattatctaatatttcgagatattttgtatactcgataaatggtggtatttctgttataattgctttatttttattgacttcgacaacacctataaagttccattgtgtattattagaactggtatcttctactaattcaacagcccctttaaaacctgcaatatacggctttaaatcaactttattacctgtcttaatatattttattactgaatccaaagatcttggtaaaatattctgtttaaaaccactagcaagaccattcattgaaccatttaaaactagtataggcaaacttggaacgtaaaatactggttctatttctgaaccttcaaaattctgagaaatcaagacatctttaatatcaaataaatcattaatatattttttatttttaacataaacatatcttggtgctgctggctcattaataaacctcgaaccaaaattacctttaccttcaagcaatggaatattattagaaccagtatagcttgcagccatattttgaataacacctgaacacgaaccgtgcaagtattgtgtataactttgaaccatattatcaaatatactaactttagtttctgtatttaattttttgtctaatgctgtgttaatgatttttctgcttgaattttttaaaccatcaatagaactagctatcattcttaaagtactataacaagaataattagttaattcatttagaaaataatcttgaacacttttgtgaaccatatatctccttttaaactttagtgtattataatataaaatatcttaaaatatcttaaaatatcttaaaatattattaaacttttagattgatgaattaataattgaacaaattcttcctaataaattagaatcattattaattctttcttggattctattttcatctttaataatataaccttcttttttagcgtctttggctgcttgtttaactgctttaataactaacctagtctgaacaccttttgcttgatattctaatgtattaagtttaaaacgacgtttaagatcttttaattcttcttcataacttaatataatatcaatatattcagtttctaatttataaacattattttcagaatcgtcaacatctggtacccttttgatagttcccttgatatctgggacttcgtaaccacttggttttgattcttgtgtttgatttgtatgttcactaggtgcttctggtattaaacttggcgcttcttctaaatgcattgtatccactaaatcaggaacttcaatatctgattcatttttaatatttctgagatctatatattccttaaaagcttctgaatctgagctagctaccatattttcgttattattgctggtattactaacacctgattcgatgctgttaagaacatcaccaaaatcatttaaatctgcgttttgctcgtttactccattaacttctatgttgcttgcaggtttaacaactaatggttcttgatattctatttcaggtttcttaacaggttctattgacaagcttgctaacaaatcatcaaattcatctctcatttttacctccttattttgaaatatttgtaatagcttctaagatttgttcataagtagaatctaaatcttcaggtttggttctaatatacatatattcgggtgcaaatgcaaaagattcgacattgtgtcttaatacactatgactaaaaccaattaccacttttgggtaatttgcgtaatcttttttaataaagcttacaaaatctgtgttaatatatattaatctatcaataccacgaactgctatgaatttttctttgaagtatttagaattttgatagtttatattactattatctacataataataaccactcattgctccttttttatctgtgaaagtataacacatattgaaaacttgtttgtctttcaaaacattaatattacaaactgctgataatttaacagttgtattttcgttaacttgtattaacattgtatctccttttaaaattaattctaagtttaaacctaaagtacatatttaacactatagcagcaagtttagatctaagtttaaaattaatctaagccgtaaaaaaggtttgagctgctaggaagctcttaggtctacaatacccttattgtatttaccgtcaccgtgactatcaatccccttttaaacagctatgtagaattataatatatttgaacttaattcttgctgaaattttagaactttagtttaaaattaaaatataatattttataatagtttagttggttatatattgtaagtaaatctttttatttcataaccttcaggttcataagattttgttattctagcatttatttgtttcttaaaaaaaccattgtgatcagcaatatcatatatattaacaatatctttagaatcgtgaagtcttaataatctaccaatactttgagttattgtgacataacttttgagtggactagcaagcactaaattatgtaaattcttaatatttactccggttgaagttgtcgcataattagcaactacgatagcattgtttactgaatctattaattgtctaatagtttccctttgcgaaccttctatcattccgttaataaaaaatacattatttctttgttgaaacgccaaatctttataagtctttttatcgtagtttaatcctctggatttcaagaacttataaaataaagttagaccgtgttcagtatgagaaaataatactaaagtgttacctttgctgactacagtatcgcctattctttgaattaaattatttcttggatcgtattcttttaattgtttcaattggcttgaatattcaccttcaaaattaaatttatatttaagatctattatattaataatagcatttgtagccagacctctatctattaaacctctgggtgtaatatatgttcttggtaaaccaaaaatacttattaatctcatagcatctatttcattatctggaatagtccctgtcaaacctatcttatacttagcattaatacacttattacaaatatcaaatatttgatctgctttggctgtatgtgcttcatctacaataataaaatctaaatcatttaaggcttctttaaagtttttaacagattgccaagtactaattgttaatggtttatcaaaagatttaatattattttcaccacctattaatcttgtttctatatccaatttataatttattaaatcattattaaattgatttgttagtgaaatgttgggaacgagtatcaaaccttttaatttttttaatattagaatcttagcaattaatccaataatgacgcttttaccagcacctgtggctgctctaatgaataacttatgaaattgcatagcatcttttatagcttgtttttgataatcataaactggaaatggttctaaatgttttataattatttccaattgcgaatctaatttttcattaatttctggtttagttgttatacccaggtattctaaaacaccgtttggtacaatttgttggttgttgaaatctttatagaagtattcataagctaattttggattcatttgagcccatatattataacgaatatctttcttaaatattaatttagctttttggtcatcagttaaagatattaaactaaatgattcgtttaattttttaaaattattttttaacatttaggtttacctttaaaatctggacataatcctgcataaggacaccaaggacataatttatttggtttgctattccaagtattagattcaatagaattttcaatagattttatttgattattaagattatcttgccaataaattgcagaatcttgagacaaacttaaagtattttctaaaagatgttcaacataaacatatcttatttttatttcatttagtttaagtcttttaaatatatataaactatataaaattaattgtgtaaaatcttgataagatggttctttatatttacctgttttataatctataagctctaatccattttcagtcgtattaattctatcaatatagcctacaaaaatagcagtatctttgctacaaggttcataattagaatctaagaataattcatattctcttaaagattttctggatagtatttcttttcctaattcagaatcaataaatcttaatgtaatattttgtatttctggatcttttgaattaagaacttcattgtatttttcagtgttatgaaactcaagtatttcgtgtatatcagaacctttttttaatgctgggttcttttgagtttctggaaccttttcaatatatctataataatattgttttgggcattttttatatgtatctattttcgaaaaactatatattgtcatttagaacctttgtttacattttactagttatataataaacacctttaatataaggcttgtgagaatcccattcaaacaagcaattatcagatttaattagaactttaattttagattctttatgtagatctttcagaacttgtatcaagaaatcggcatcaacaccttcatctacgaacattttatgaagaatttcttcttctatattagttacttttaagatttttagaacttgttttttaataaagctttttgaatccatttttactcctttaaataatcaaaaacaaatgaagtaattctttgaaacttgaattgaatttaagctagcaaccttccttgattctaattcagtagcttttaataattttaaaatactagggtcaaatgcaaaaaaatctttttgaattacacgatttctatgtgttttaaaaatataacttgttttatgacctatattatatttttcacaataagcaacattaattttaaaatttttaatcatataattcaatggtaatttattactccaatctattctgggttcattaaaaataattttcatattcttagttaaattaggaaagtctctgtgaacaaacacacaattacctattcttactaaatgtttattagtaacagactctggaaattttacataccattttgaaatattagtcatacttatatttaatttatccgctatttctgcagttaacatataatctttggttacgaagttcattttaaccccaaataaaataagctgggtatgctatcatcattactacggctacaactgtgtaaactaagtcaaatgtaaatctattatcacctaattttgatttaaagtttttcatttaatctcctttatcttttgatgaaataattataatataaaataacttaaaagtttcttaaataatctaaatactaaatatcgaagttaattaagataataaataacttaaaaatacatagaggccaaaatgtataaactattattagaaaattctcttaaggagactacaaacttaattagcgaaggtatagatgcagatttttaccaagttatgttaggtgatatcttaaaagataaaatcaaatcgtttataggtcatcacattgctgaagttcaacctatgatgcaaccatctggatatgttttcgcaagacaagaaactcaagatacatttaaaattattaaaaaacaaattgatgttgatactaataaatctattatcaaaatatcacaggaagcttgggaagatttattaaatttaagtaatcttaataaagccggaaatgaacaaacaccagaattattcattaactgggtcaagtcttctgcagcacacaaagaaactgaaaaaattataaatcttattaaagaaaatgcagttgaatcagaaggtattacgttagatgataacaacgattctaaacaaaatgccgaaacaaacttatttcatatatctaaaaaggtaaatgatttagttattaaaatgaattcacctaattttagaacatacgatagtttttgtatacttccacaaactggtgtaggtggtatattatcattaagttttacttattcaagaatagatgactcaacagatgaaaatagagcgaatgattatttcttaggtaagattaataatacaagatattatttaaatccaaatcctgatgataataatgcttatgtgggtttaaaatctcataaagaaaagggtgttaattcgttgatttatagcccatattgtatgaacttaacaactgcttataattataaatcaggtgaaagaactgtaggtatatttacaagaaatgcatatacaatacaccctttacattctgcaactactccgatgttatataagtttgcaattacggaagcttaagagattcttaagcttctaagttttacactatagtgttaacacataacactttatagtttcaagttttgcattgtagctgaaacgttagcttctctttctatatccgggattacaactttatcaataggttctgtgtttgatgcttttactggtttagaaccaaaattaatatctaaaacaggttcagtttcagtcatatcagctgaatcattttcaacttctttaataggtttagaaatcttagattttttaacttttgtttctggttctatcgtacaagcaccagaatcatcaaattctaaaactactctcttaacatttaatggaaaatcttttatttcaataatcatcttaaatcctatatttagtttaaaattaatttaatattaatttaatggttgtgttgcatctataaccgagttttcttctttcattatttctaaggaaacgtcaacttcttttatacaattttttatcatattggctctttgaatttcataacctatagttgatccacgatcttcgaaataccatttagtcataaaaaatgtaaaagctatacctgaaaaaaatcctaataaaaataacgttattgtgtatttaatgaaacctgaagttgcagatttaattatttccattttaagctcctttgactataattaattataaacttttattaataaaatctaaatattcattagaacttttgataaaatctttaaataaatcaaagttttttgttaaaaaattcttaagtttaatcttagtcataaaacgatcattaaaacgatttaaatcatttctaaaagtgaaagctctttttccaaaacaatcccaagcgtaatagttttcatagaaaatattacgatctcgcaaatcaaatctaattttgattctggtttcattatcctcaataagttctattgccaaaccattaggtacaccatttctaaaaaattctattttattgtgagatattgagatgccatctgaagcatcttcatctacttcaattacaccatattcacaagtagctattttagtaggataataagcactttctattatcgagttgtctttaaaaactacaaattgagttctatagtctacttttaagtcaaaatgtggattattttttaacattttagatattaaatcattgttaaaatcttttatttcttgtatttttgtgtttttaatcattttatctccttttttatttctgttattatataataataatcttaaaataagattaaaattatacatcattgcttatgaatttggtttttatacaagaaaaaatattttaatgtctaaatctaattttttattttcttctaaaaattagtttcacttaatatttctatcttaatattttctgatttttcaataccctcgtttataatagattcaacatattctctttcttttcttatttcttctaatttttcatccgtatattcattttctttttccttcaaaactttttcaaaaatttcttgtatttttgatttttaatcattttacctctattatataataatcttaaataactgattttaagcttatttaaaacaagtttattttacgattttatattatttattcgttttaaacattttttaagctttggtgctaatttttgactgatatttgtataatgagtaaacaccatagtattaaaattgaaatcaaaggtattattgcaaacaaataaacacaattgatctttttaccattaatataataaaaaccaacaacactaataataaaaagaaaaaatataataaatgaacaaatcaataaatttaaattatttaaaatcattaaaatcccgtattgtgtattaaactaaataactcacagaattagtaaataatttataatttttatcgtacatttcttcagcaagaattacttgattattaatataagaacaataaaaataacctactatactacgcacttttttattatttgtaaattctacataaataaacaaataattaccatcggtatctattccaataatttttgcggttataaattctttaactatactttttgtattcaatgatttaacaatatcatcgaaattttgactcaaatctatactattcaataagtcagtcaattcattactaaaatctttaaaatctgaatccattttatctccttgtaatattatataatatagaatcttaaaaatcaattacagtcaactacaaattatattttctaatatattcatcaattaagtctggtgtcacatctgaataattattagaattattagaattattagaattattagaattattagaattttttagattctcaaagaattcaagtaattcaatatcttttatggtactaatccaacttaacaaatcaatatttttcatagtcttctactccgtaaaaattcaaacaatctaatatttttattgtttcttcatcataatcaatttgaggtgttatacaattaaaattgatattctttaagtatttaacattgtatttattaaaataattcaaacacataccaacattacaacttttgaatttacaaacttgataatcttttaactttagaacttcttctacagtcaaagtttttcttgaacaattttcaatgattctatctgggtaaacgtgaagtctcaaaccattgcagaccataccgagataattttgactcgcaaactcagattcattcatatatttcttagttccttgagaaatcattacgtagtctctatctgcattaaggtcaacgcctgctacatttttatttggattactaaaaccaaatcctgaaatatgagtacaaataatattagtaaatccttgagattctaagaaatctttaacattttgagttctttctattaaatctggttttttatggttaaaaaataatttaacttcttttggtaaatctatgtctaagaaatatttaagtctttcaatatattgattagaattaatttgagaagcgtgataagttgtaactaaatctaggtttctatattcttttagacgtttataatgatcttttatatataatagatttgttaaaattgttacgtcttttagatccttaaataagtctaaataatcataaagataatcacacattagtggttcaccaccacataaaactgcggattttaatctaggaaatatagctttaaccaaattaaaacattttaaatctgcttcgcttttagtatttttagcagcattaaaatctgtaaaacctgaattacaacaatattcacaactaaaacaacatttatcggttgtcattatcgcagctcgaataccttcaaactctaatgttccatttagtagtttttcatatgaacattcagaacccgagaagtctattttattcattttaaacctttgtgtgcttttaaactttaaactaaataatttataattgtgtcggacccatccaatataaattgatccagatctgtttctaaacgtctttctaaaccaggatctttataattgatattccataaatcaaaatctatacctaatattctacattctattataagtctaggtgaacaatcaaaatgtctcataataggcgtatacacatacttactaaaattaaaattcttgataggtttgtttgtcgaattctgtatattcaaataatcactatacattacaatatcaggataatctcttattagatcttttatttgagattctgataatgccctacaatttttagtaatatgagcaaaaggtttatctcctggtatatgatttaaatggggtaacaccttcttagtataatttattcccaaaccaggatatattttatgatctgctaaaaaagtcacatattctggtttatcttcggattctaaaaaactaggaccacaagcaaacgaaaatactttacctagtaatttagacttatattgatttaaaaaccaatacccaccatcggttactagtatatttctagctttaattgctaatatcttagtatctaaaaaatatatatcatttaaatcaaaatctacactatagtgtccttttacgaaatcattaaaagtttctttagttactacttctggaattaaacatttaacattaacacctttatttttaaaataccagtaataatctaatacttcaaataaatgtcctgataatccgtgcattttagtattattaaagtgaaaactatgagttactaatatatctgctttagtatctaatatcatcgtttaatcccagtttttgtgtgattatgaatgtatttcaaatctttaaatttataatagcattcatagtttttctttttgtgctttcaaaataaggttcatcacaaaatttatatttttcattcgcaatatattttttagtataatataacaactctttcataaaatcaatttgtttttctaaattattaaaatctaaatcttcaatattgtttacatttagatttaaattactaacactttttaatttatttaagcaatatttgttaaaatcattgattttagattttttatattctgctaaacgatcttcaagactaggtttcttcaaacctatggatttacgttttctatcatataagtaagtattacatttccatattctaacaccagctctaaataatcttttaagccttgatatttgtagacttctttctacaccaaaatcaatatttttataatctaatgtgatattaccgcgccaatcactattggctacaattacatattgtttgtctgtaacagcaatataaagtatatttgggtttgtttcaatttgtttagcttcgtagatttcttcaaatctagcttcgttaatattaaatgaaggttttaaacgttcaagatttttgatagcacacgtaatttgtctttgtgttctattgaaatatgctttgtcgtttttatatcctaaaaatatttttgtaatgtgtttcattttatctcctttatcttttaatgaaataattataatataaaataacttaaaagtttctgaaatacaaaccgaatcttaaagtttaagcttaaaaagtcttaaaagcttaaacctaaaagtttttaaacgctacaacctccagacccacaaccttcaattacttgatcaccatctgcatcatctgtagttctaaaattagcataatacaatgatttgacacctaaattgaagcattctataaattcttctataacatcttcaatattaacttttttagtttctacgatattataatattgatttgtactaatactttgatctacatatctttgtattgtactcactaatttaagataatctttattattaaagtcaacaccccaagcagtcgtataatattttttggctgttttatagaaaggaaccaactgttttacagtagaacttttttctgttttaatagttactaattctcttggaggttcgataccaggtgttgctgagcttggctttgaactgttcccagcgggcggtacagctgacaagcttgaatggcgcataccgtatttagataattcttcacgaagtgactcccaatctaattttgttttaaattcaggtttaatcccagcttctaaatatctttcgaatataaacttattatcactataaaaagattcattatataattcacaagcacctcgttcttttgctaaatctattgaagttttaactaagttaaaataaaataattccattaaatcattaatatgttcgcgtgcttcttttgtattgtaaaataatttcgatttagcaagatatccaaataagttagaaacaccaatacctaatgttctacgttttgtagctgagtattcaatttctggcatagcaaaatcagaaatatcaatcatattatctaagaacctaactaagaaatcagcaacttttgggatgtcagattctttagaatgtccaaaatttatattacctaagatacaagttcctagttctcctggtatacccctataattatctaaactatgactaggcacagatatttcacaattgtgaacacacaatccatttgcaaaaaagttatgattatccttaacttctatatcgtatacaggtattttttcagtttttttagttatttttatcatagcacctcttttattgttattataatatataattacttaaattgatattactaagtgattttagtacatcttgtttgtctaaatcttttgattttctgagcaatagcacaagaaaacgcttcctagttccatcaaaatccgttctaatttcatttgaaatatctataggagtatactttaaatcagtacaaacataaggtaataattttatatattttttcattaattcttcattagtcacaagcttaataaacaatgtataatgttctttaatataatctcttagaacacttaatacataggataaaactaattgagaatttgtttctattttatctgggtttaaaatctttaaaatatcctttctgtgtttgagttgtaacaacaattgcttagtatcagaaatttttaagatattttctatatcagttacaaaagcaccaaaatgtggttctacacaagtatggtcacctttgacaccccttctcctttcaattataacataatataacaagttattgtgtctaaatgtagccattcttaaaatagccctttctttgaaacttgccatttctaataacctcttctggtataccgagttcttcagacatttgcttaatcaccatatccattttctggcaatcatccaatactttctttgctacccacgcgccattaaaagcatataaaaactctgagagttctaatatactattaaaatgtagtggtaaatagcctgatgtagtatcttcatttttaataccaattaaatcttcattttcgtcgaatactaatcctaattcaaagaaatccattaaatatgtttttctaaagaaattaagattatgtttattcggtttatctaaatatgttatttcttctaaatacgggaggaacattctactattgtatcactttctaaaagatgttgagcttcaatataacccctttgggttaagaatttatgatcactagtgcaaatgaccactttaccattgaattctacttcaaaaacttcagcttccggatttgttaaaacagctgctagtacttctttgtattcatatttttttgtatcttgattataacttaaaacaagatctccttttttaatatctttgagaaatttaggcccttgtgaagtttcaacaattgtatcacctgctaaacaacaaagatttgtcatatatagattttctttaaaacttgaattaacgaagttatccgcaaaaacaatataaactctaccagtaatcattctctcatttataattaaagataataaatcataagcattaattttctttttacttttattaggaactttagcgctataatgtttatataattcatcgaatcttttataatcacctaaggcatcatataaatctaatttgggatccttattacctacagcattcatatggaataaaaatatatcctctttattaagagctttttctaagaaccatttattgatgataatagtttgatcagtatgtctagccctattttctaaagatcctttagaatcacctagttgtgaaaataattctatttcgtagtgaaagaaaggcattgacagattgcttgcaccgcccctgccgtgctgaatcagcgcagacgtagcagattcaatggctttaacgatcggcagcataccagtatgatctaatcttgaaggtttacctactggagctcctaaacctctgatgaaacttgtattgatacctaaaccacttttagcactggtgcattttaaaacagcttctaaacccctagcaaagctttcaactgaatcaccaaagtttaataaattacaagatataaatttcttataacttgttcttgctccattcataataggagtaggtaaagaaattttacgctgtgataataattcatacccaagtttaacatatttttttctatattctatatcggtattataaaaaatagccattggtatcaatataaaaacttcttgaggaacctcaatgcattttttattatgtttgatcaagtacttagaatacatttgatttaatgcgctgtaaggtagttcgttatctaattcataattaattaaagatccaaaatagtcaagctcttcatcactataagcattaagatcttcagtatagaaaccttttttaatacgttctttaacttgtgatttaaaatctaatggtgtgtattgtttataaacttcttttctgagtttttgatttaataatctaccagcaactaactcataatctggagaatcttcactgattttttcttgtgcagatttaattaaagaatcttgtatgtctacacttttggcaccatcaaatatttttaatctagcatctttaataatgctaataatatctacatcgaggttttgacaagcaaaatgtaagtgtttatgtattttttcagcatcgaatatttcacgttctccgttatttttaacaatatgtatagtgtctaaattcaaattgagtcctttaatcgttggttaaatatttatgattcaatcatttgtgtatttaaagctttgatataatcgggtataaattatatcaaagcctgttgttttaaaatctatcccttagttctggatatttttcaaaagacttgaatgactttgttaatatctcacttgataatcttttaaagattctagctagtctgaaatgtatctcattttctgatagcttagatttttgaagagaaccgtaattaatctctaaatccaagatatattgtttcagattcgaatcttcttcaatatttccatagaaaatatgatacaagtcttccggtgttatttttgatttgatagttttgttttgtaaagatcttactattcctgacatctctcttaaatgttttttattatttaaattatcatcatatactaagacttttaaaatatgattaaaaatgttgtctgaattgttagtaaatttagagatcattacatctttactaaaagcttgttcatataagtattctctaaaagatgttgaggaaatggtttcttttattatcattttaatttccttaactttttaattgaagttattataactaaacaccgcttaaaagaagcttaaattatggcctttaaacgacaaatgttagctccaaaaatcgaaaataaatatacaaaaaagtaggataaatggcaactgttaccttaaataaacttgctagtgttattaatactatcaaatggagtaaaacctctgattttatagttattatgaaacctattaatgctactttccaaaatcttataaactggggaaaccctaccgaaacacaaaatagtatagatatttgtttaaaaagtattaatttgccacaatataccggtagatttgaagaattattaattggagggacttgggttttagcacgtggtgcagacccagtataccaagtggatatgaccttcagagattttgataatgctagtatgtatcgtagatttgtcaatgcttttcaaatttcaaaaggtaactacaatgatgtctgtgcttggctaattcaggtttatttaagcaatggttctaaaaacatcttagtaatggagacgcaggatgcattgttgacagatgtttcacaaatacaattatctcaagataacaatgaaattatagaattcaatgttagttttaaaatgaaccaaccaaatcacgataatacagatattaaaaatattcaattagcaagcacttccaacacaaccgggaatgatagtgtacaatctaaagcaagttcatattttagtaatatgttaaaaaatggattaagcgcagcgcagaatgcagttcaagatacttttgaaaatttagtatctaaatggtaaaaaatatacaaggaaaattaaatggcattagaagcatctaaaataaaaataatagatttcgtatacgaaacaactaaaacattaagtcaaattacaaaagaagctgttgatgaaatgcagggattagttgctaaaaatgatggtgcaccagtatatgttagagtaacagacgtagatcaaggtagagttattttaataaactctgatggtaagatcataaataatactagtaataatatcgttcaggataaaagaatagatagacttataaaatctttagtttaaaggtgaaaaatgcaatttaaaaaagttgatgttttaatatcagaaaatctcacaaaagaacagttaaaagaaaaagttctaacagaacttaataaaataagcaaagaatcaaatcctagtattagttatatcgctaatattcacgatatagttaatggtaaatattggatttgtatggattctgaaactaaggagactatggaagcatcagatgaattaatagatcttcaagcaatttttagacatacaactgaaaatccagaagaagcttcaaaagatttattatacagttctaaatatatagaagataatttccttcgaaaaataatttttgaaacttataaggaagctaatgattctaggcttaccaaattagaaactacagtaggtactaatgaaaaagatatagaagataaacattataaattagaaagaagagtgacaactgctgaaaataccattgctgcaaataaagaattagaagatactaggtatagtgagtatacccaatttaaaaaaaatatagaaaataacattcttagcatcaataataatttaaatacaaaagcaaatctgggtggttctgaaacgcaagtatttaatgttgcagacccaacaagtgattggcacgctattaatttagcttacgccaaaaagaattttaatgtagatttaattaatactcataagacagactttaataacccacataaaacaagtattgctaacttaattgatgcaagtattgttgacccgacaaacaatcatattttacaatatgattcaaatactaaaaaatggaaaaatgcagttctaagtgtagatttatctaattattataataaatctgaagtagattctaaattagatactaaagccaacacaagtaatgtttataataaatctgaaattaatactaaatttaattcatattataataaatctactatagattcttttatggaacttaaagcaagtgccgaatctgtttatgataaatctgaaatcgatactaaattgcaagatgtgttgacacaagcggataacagatactctacattattaacacaaaaattagaatggactgtcggagagggaggtaattttgaaaatatagatgatgcaattaatgaaatatataaatatggtaagtctatatatgatataacattaaaaataaagaatggatatactattactaaacctactacattttataacttacctttaggcgtcaatatagttggtgaaaatggaagaagtgatgaacttataatagatttaaataatacagcttgggcgcaatttgggttatatatcgtgatgtgcgaggttcatatacacgatattacaataagagcatcttctaacaattgctcatcaatatacatatctactggtacaaatggaagtatatataatgttgatttaataggaatgtcactcactaatttagtgatagcttcctcaggaaatatagaagtgagtaacattaatattcaaaataattatcaaggagctgaagaatgctatgatttatcagtattaaatgccaatcttcaaataggtgctaatgttaaatttttatcaaataatcctgaaaaactagtagctattagcgcagcgactaattcaaagataagttcagtatggtggcatacaggtatagatataagcggtaattataaagttgggttacaggtagttggtggaggcgtaataaataatcctagcattgctatgactggaaatattggaactaaattttcacaaacacctgggcaatggacaacatcaggttacatttcaacaaatatataggagtaaaaatgatagtagcaaaaaaaactttaagtgaccaaggtgtattaaattcagatgtaattaaatgggctattgaagctaatactgaattgtgtgtattaaacagacctttaaccacggatacaagtttatctgataagtatatcataaagcatatagatgacattacacctgaagaaattcaagcgggtacacaagcagtcaaagaatactgcttagctaataatcttatggatttgtattatgaatatgtactaaatactgcaagtgaatctgaaaaacttaatataattaaagaaaagaagaagtttgaaatacaaacaaaaagggacgtagctttagaatctggttttgtattcaaagaccatacattccaaactagggaaaaggataaacttaatattaacggaatggccgctaatatattgttagatatacaaagtggtactaattcaataactgagattacttggattgacttgaatgatgaaaaggttaattttacacctcaagaatttttaacatttgtttcaaaagtaaccgaatatactcaggaagtaatatttaaagcgaatacattaaaagaaaaaattaattcatctgaaactgttaaatctgtcgataaaattaaatgggaataattaagtttattagtaaatgtgggtcatataaagctatacgtcttataaggtttatgtctacttataaggtttgagctacaaggaagctcttaggtctgtaataccacaacgatcatatttaccgttaccttaactatcaattcccttaaacgtagattaattcccacataaaggacaatggagcctaatgagagactcgaactctcaacctttcgcttacaaggcgaatgctctaccagttgagctaatcaggcattatattcagtcattgtatagagtttaattctatacgatgactctttaactttattaaaatgataaattatgtttaaaaacataattcaaagggcttacaccagcttttttttgcatttcttgttactaagttattagcaactctgcttatttttttaagctcgtctagtaaagattctcgttttttataaagaggttctaactttttctcaatattctcaatttcactgtcgtattgttctaaacctttgttgagtttttcattatcaacgttatcgggtgcaatctgtgcagctaagccacctagtttaaagtaagctgtagtctgtgcagcttctagtttacttatttcggcttgcaattccatcttttttttggctacttcttgatatctatttctgagttcctctatagcagacacatccgttttcaacgcttcatttaaagcaatattgtttaaataatctttaaatgtcattttaatcctccaaaatatatttaaatatatttattggttatataaacatatagtatcacaatttaataaacatgggtaaaacttacaaatgatttttaattgtgtttacaatcatcagttttagttatataatataacgctgacatcataaacacatttaaaacttctactgaaatcttaaatgtgtttacagtctagtgggttaccaattacccgaatgcttactaatgttagaatggtcggggtgaaaggattcgaaccttcggccccttggtcccaaaccaagtgcgctaaccagactgcgctacaccccgaaaattataaattttcaatcatatttataattaaagtttaattaatttaaaaaggattcaaactgcaacttttacattaacagtttgaaaatcctgattagaatctaaccgtttaaaaaaaaactttttaaacaatataattatataatatataaacttaaagtttaattaaatttaaaacatttaacactatagtgtcaatctttatgagactaattaaagttccaatcagttttaggtttttgtatttctaattgtggaacgtttttaatatcagcattacttaacatttgtatatcatttgaaactatatcttctatacgcatattattataattaatatgcatatcaaaacttgaagttctaccattataacgattcttagttattttaaatctaatagtatttttctttttaagatcttcagtttgtaataagaaacaaatccaatcagcagtcatagcagtacccatagaatctgaaatagcttcattgttagaatctgtattatttacagctgatctatttaattgagaacaagaaaatatcggaatattttctgtgactgcaatagcacgaacttcttcaccaatggccttaatataactatataaacctgcacttgcagaaactctatcagatttcatcaagcctaagtaatccaagaatattgcatcgaattttatattattagctttatacatttctaataaagattttaaatcatttgaactaaaagaaccagctgggaagttttgaacatataagctaccaataccagatctttttagttcttcaaacttagttctgataacactagggtctacgtcttttaaagcattaatttgtatatctaataagtcagcatctattctttttaagaactcaaaattagataattctaagctgactaataatacatttaaaccttgtttaagaaaatcaccaatgctggtactcattaataaacttttaccaatacctgcaggagccataaaaatattcaaagttccgttaagaaagccttctccgatatactcatttaaagtattgaatcttaaatatttgataccttttcttggattttgataataatcaatgcgttcttctatattattatattcattaccaagatctttatgaatattcacaagttgtgaagcatctataagatctttggctttttgtttataagtttcatcttttttatcaatgaactcagcacctaacattaatgcttttgtgaacatttggtccttaatgaatttaacagttaaatcatctaagaattctttattgatattttctgagtttctagcatcattaagtttagtagcaatctgggttcttgcttctttattgggaatatctttaatttgaagtgctatttcttgaatgctaggagttgtattataattagaataaaaattatctattaattcatagattttttggttaccaaaatctgtgaaaatactaggttttaagattggccttactttattaaaaaaatctttagattctataatattttttagaagaaccgattcaaaattatccaaattaaactcctttgatttagacttttaaaatttaaatttaaatttttaatatgatattatatataaagaacgattaaaatttaattaaattttttactaaagatctagcaaattacactaaagtgttaaatgctaagatctatagtgtattaacattaaactcggatttgaacctgttttcttaattcaggatcaccaaaagcacccccgtagaattctgaagtaaatcccccctcagtgtttcttgcacctctaatccattcacaagtatgtttaatattacataacttaacataaacatcttcagtttgtgctgcttctttaattttattgtagatttctttagtcaaatcttcttgcaaccaataacgcctcgagacgaaatctgctaatctttgtaacttagaaatacccagaacataatctttaggtatataactaactattgcataggaatcttccgcaaaatctgtattaaatggtaataaatgatgactacaattgcttgctatgttaatccttttagtaattggaatcttagctgcgtctttatttggaaaagttgctattctaacaggtttcataaatctaccagagccacactcagtatcatcatcagtgttggcaccagccattagcttaatgactctgcctggtgttcctaaattaccattttcaaaatctgctttaacatttgggtcttctaaatcaattttaagtatttcaaaaacttcttgtaattttttagtagctaatgctctcataataaaatgagcttcgtttgaaatactttgattggtttcaaatatattttcactagctttaaatggtttgatatttaaatattcttctacaaaatcttcataagcttctcttgaaacttctggaaattttttctgaaataaactccaaataaatttatcttcttttaacattatacctccttaactttgcatagattcgagcatccaaatatatttttggagacgaattctaaatgttcttaagatgtcttctgtaacagtatcttcaattttaatagcttcttgaataagaactgctactgaattgtcaactaatttaaaatcatttattaatgtgctagctatggtatccaaatcaagttttgtagcttgtagatctaaaatatatggatttttcagatcgtggatttcttgtatattaacacagggtgttaaactcaattgaaccaatctttcattgaatgtatcaaacgactcttgaaaaaattcataatattcttgtgttatttcgtgaagtctgtgaaattgattgcctttggctaagtaatgcattccatttaatttaataaagatttgcatacacgtagctgaaagttgttttaaattatccatttattgttccttggtgtaaaatctttaatctgcaatttttgagatcaaaatcttagaaaactcagattcaaagagaattctaaatgcgtttttactctcattatatttaatctttaaagtataatttgttaccggcagtttaacaaaattttcaatattgattttcagtttaaaatccatagttgaatgatttaaaaactctttgctaaatgtattattagaagaattaaatctattatgtgcatctaaatacaaatataaatcatttgatttaccttctatacttaaaacatttaattcgttgtaaatacttgaagcttgtttaatttgttttatgacttcaatactaatgtcaactctggcaacttctggaaaattatctaaactttcaataattgaagctttttgatcaaagttttccattacagacaaatctgaaattgtataaacactttttgtacccggtgtttcaaattctattgcattgtttgttcttgtaatttctggattatcaaataatgcgaacatatgaacaaacttatttaattcatatataccagtatctgggaattcttggcatcctaatttagacgcatctatatttacaagcatatctatagcttcagaatttaatgttgttattggatacttaagaataactttatcagttatactcgacatttttgaaagttctttaatgaaatcttttgtgatcatttaatctcctttggattttgtttgattcttggttgtaattctactcggtttcctgcaagttgtatatttaaattatccgcacctaaaacaatgttttcactttgtatgattaaagatttattgaattttatatgaactgcagaatctgaaatcttgacagaatctatcatacctaataatgtatctaatatgaggtctttagaaacttcttttgtttcttgaaatacaatatcttggcattctttaatacaagtttcttgtgatttattaagaatttctgattttggtacaaaacttaattcattcatagttctcctttctattgaaatctaacaatattataacatattagcacttaaaatgtacttaattattagacaatcatatcggttcaaaatcgttatttaaacccactttaatttcagcattaagagtttagttcattaaattttgacattgttttattcacgtaatttgcttggtattttccatagtatcttgaagccgctgattcatacttattttttgtattagatacctttggtaaagatttcaaataactaagtatatatgcagttccttctatattctttttccaatttttaagatcttttttagattttaaacttgtattagatttgagtttatctccccagaaatcccaaacaatagcacccataccttgggcttgtatttcttttttaagtgttctaacataagtaggtttatggataacgtcgtttctaaatcttgattctttccacagtattgcgtataagaatgctggatttattttgtattttttagattgtttccatatttcatcaagtattagagattgttgtttatcacttaagtgatacattgacgacatatctttcattaaagatatttttaaatcttgaactttagaacttaaatgatttaaattaattttggtatcatttaattcttttttggttttattaagttctgtttggagatcttgaattttaaattctaaatttttaacttttgtattattaatatcaagcataaaataaacaactgataaaataataatcaaaattattccaattttatttagtttatcataattcattaaaatctcctgttaatgaagctttatattcgtcaatagtttttagcataggataagcttcttttataatttctaaagcagtatcagtaagttttgttctaagtattaaaacataatcatatctaagatttaattcaggatctttgagttttttaacatcgataattgcattatcttttaagaagcgttctccaaactcgttaaattcttctaaatctattttagattgtgggtatttgtaatttgttaaaactaagttgtattctgagtcttttaaggaactcaacattttgtatttagaaactctcatattatctccttttgataattataatataaaatatcttaagagttccttaaatataaaattatttagccaacgataaatacagcaggttctgtaaatttattggaaagttcctcgtttaatctttgtatttcatcttgggctaattgtctaatatcactataattaacttgcgaaccattaattaaaggtgctgaatattttcctaagactacactttgcatcaatctggcttgagccacagacattgctttgacccattcttggtcatatattttatcgtgttcatctggtatgtatttacatttagcttcaattaacaaaggcccgtggtaattttgatatattgataataatcccttatgagagttaaactcgaaattaatacgttgaccaaagtatttgtcgactaaggatcttgtagaacttaaagtaactaagtaacttaaagcaacaccagaagtagatagtatataattagatagattttgatctattaatccatttaaatcagaacctacaaaaataccactttggcatatttgtaatatttcttcaacttcaggatctacaaaataattgccttggccctgacattcaaattttatatatcttgttaattctccatcatatgcaacattacaaaacatttgaactgttttttcaatacagtggtctaattgattatctgtaagttcaacttgtaattgtggatatccgagttcttccttgatatattgcctaagatctgataaggttaagattcttttcatcaagcttctccataaacttctttgatgttattaagtataagttgaatattaggatcttgtgaatttaatgtaaaatcattggattctttaaatcctttagtattaatgaatatgatttcatctgggttaatcacatatttttctgattttatatcgtctgtaaatttaagatctttataataaaaagttcctaaaagattctttttaatagaagttgtaatgtcttctataaaatatttgagagataaactcgaaatcacagaaactctgatacttggtttatttaaatgtccagttattggattccaaaaatctatactttcaacgtgaaattctttagtagctttgttaattttctgaatttgtttagcgttttttgtagtgtaattaaatcttatcatatagccatcagcactggcaaatctaatacctattaattttgaaccatttgaagtacaatgttcaacctcattaactaaatagaattttgcattcaagattcttgtgaatactttattgtattgtttaacgatggttttaatgtcatttctactaaattcttcagcttcttttaatctataatattctaagaatctcattataaaccttttaacttatttatttttggtattaatcgagcattttagatataactatatcgttgtatatagatctcttatcaaaatcatatctatcttcgaatctataatatgaattatcattttttgtgaatttagaaccttcagaaatatattcacaatcaatgccttggtaagcacattctgtaaattgtcttgggtgtctatcataagttctaccagttttaacatatatgtacttattaaaatacttgtaaatatccggtataaaattcttagtcattgtgtaatgttgaaaattatttttaggatctttgataattgctttcggatacattttaagaatatttaaataactcttgcagcaattatccatacaattaacatatacattatctaaatgattaaatattctgtgaatctgataatatattttattaatataatttttatttaaaaaatattcatcaaaatattcagtattttctttgaaccctatggtgctgttagcgattacatataacttatttaatttaagggattttgggtgatttatattatagaaatcgtgagtatcgaataataaaactttgttaaattctaaatcatatggatctttatatataaaattatcaaaacattttggatctacgttgtatttaatgcttaaaaaatctttattgatatgactgtacaatgaaacaaatttagtatcaggatctaattcccaaagtctataaaaatattcaaaagcatcgaacatagagccattatatttgaaacacctagttataacagccctattaatcattattttttaaaattaatgtcgtctattgcagaatcaagatatgcaaataaaacaaacgaacctattaaaaagaaaacaataaaaattacagcaaataataaattataagctaaccaaatagtgccaaataataatatcattatagtaataaaagaataattactttttaaataattgtatccttttaaaatataagatttaatataattgtaaacaccgagtatatccattaccattcctccaaagtttcagtttctttatgtaaattataattaagtgggtctgtcattatttcaagtggttttaaaaagaacttattaaaattagtatcccaatctatataatctttaaatacatttgcaaatttttcattattaaaagcaaaaatgttagattttaatgggttaggttctctaagatatagcatacgaaccttttcgcctaattctaatggttgaaactcacctgtatttagactatttatataatgatttgataccaagaaagctcttgaattaatcggtatggatttatccacaccaagtttatatttgctagaactgaccgaagatatcttagcaatatccattagattttgacccaggtataatgatctaatattttttaaccattctttaagttcttcttctgtactttctaatataatattgacggattttttaagatattttttagaaaatgctggtgtactggatctgacaatatcgatacccattgttttaagataaggttcactgaacctaacaccttcagaatctataactttcataaaatatcttttctttgctacaaacacagcagagcttgcaatcgcttcacgctttgcagaaattcttgaagcatctaaagcattaaaaatagaccctaattcttgtgagcttgtgttaattaccggttgtattttagtttctataaatttatcaattatatctgttgctaattgtgggtcttttggtaatttttcgtttataatattaggtacttgaacataacaactgttatgaactaatatatcattagcaaaaaaattatgattagaatctacttcaatatcatagacatctaattcttggatacctaaagattctacttggaaattttcagttactatcaaataaactcctttaaatctaataaattattcgattttatatattctataataatattacttaaatttgtattaattctaagttcgttttcccaaattattataattttatagccattatctaaagcgtgattaatttttctattatctgcttctcatatttcctcagtagtcaatgtcttgtcaaatggattgggattgtcgtggctattaaatattttaggatttgcgtgaaatacatcaccattaaattctattattaattttaattctttgatataacaatcataaaaatacggagttccgttagaatttaatactatttctcttgtttttggttcataataaaaagtataattatttcctaatttggattccaattcttcaaataattttgtagccatttttgaataacctatacactttttgttatttaaaaaattaagccacttttcattacctaggtattcaccatattttttaataagattttcacgagtgattgctttacttgcgttgatgttataatatttctgttcgcctacaatttcaccatatttttcaacaaagtattcttttgtatttgtgtatgcctgtctatgtctataatcctcccattttttattacctaggtcttcaccgtaacgcattattaaatttttcttagtcaccgctctggattgattataacaatctacttcataatcactcatacccagcacattcattttatattcttttgtatttgtatatgcttgtctattacaataacttgtccattttttttagcgctccggttttaccgtatagcagcaaacatttatatttcgttataacacccttagtgtatttgcgtaaacgtcggtatcgcgcgtataaatttttaggtctgtattcgctaaacgtgagtaaatatttgtacatagttgtataaggcaatttaccatttttaacttcagattttaaaaattgtttgaaatcgttaaaatatgattcagtcatttaatattattaagtctcctgttttaatatctcttggtttaacctcaattaattcagaatttcttaaaaccataatgctatgatcttcggttacgaccacttctttattattgacttttattttaaaaaattccttcttaactttatgtttcattatataattaatttttttagtttcaatttgtaagtttttatttacagaatctgtaaaacaattatctactaattttacattattaccagattttgtaacaataggatcaacttttatagaatcataaaaatcttctattttaatatttttaccatttactttaataattgaatccccaacaacggagtcagtatcattataaattatataatttccagaaccacataaatcgcacaaaaaattattgatatttttactcataagatttatataaaatcttgaatttcctgtgatagctttagcgatttctttattatatagaataaaatgtttatttccacaagctccatataatgagttaattaaaatcttaaatgtcaattgattgacatccaattcagttgctaatgcttggtatttttgtattaattcaggttctttagcatcttcagccatttgctcatattttaacatttcttttttagctgcttttctaagattgaaaactaattctgttaatattggtagaataccttttttagatttatcatacacagatccagttaatgatccgcaataattatactttataagtaaatccgtgtattttttataagcttcgggatttttataataattattaatatgatattgttcatcttcattaagatctaattcatttatagcttcttgtaaatcatttggcaatttataaaatggtataaatgtttcagaacttaaattaaatgccataatttgactaggatacatactggtaacgtccgctgaaaaaacccaatcatatctaccaattaatggttcagctacaaagccccctttaaattctacatcaccactaaattcacttggatttggtaatactattttatcttgcattgcataatttcggataaatgtactccaaggagttgttgttccaagtgtttgaggtaattgaatacccataatagaagcaatactaatcataatatcagataatttaattgcattatctattctatataataagtatgtatctataatactataatgaataaaatattctttagaaattctttttatttcttcagaatctttagcattataaagtttatattctaaaatagattctttgctaggttcaacttctggtctaataaatccttcaccggttctaaaaccatcaaaagttttaaaacaatcgtgattaacttttctttcacctaattcaacttctgcaatataatctaatgaataagattctctcggtttaagtctaaacttcttatagatatctatagtatccatatagaaaacaccgggcgcttttatactgtattttttagttccattatctaattcatttatttgaaattcagattttccaaatggactaaatccttcagttaaacctaacttttcagttcttctccaaagataagcaaagtcaaaaccttcaccattgtgagctaatactaataaaggttttaaagcttctataagtttaaataaagcaattaataaattatgttcaccttctacttgatagtatttaagtttaaaatcataagtcctatcatcgaaaatatatttagaatctttagtatgagcttcggtgtcaaagaactcatttgtaaaaatataatttgtattcgttaagttatgatatacttgaattgaaactattctttctctacaagcttcggtgtcaataggtgagtgtgccgtagtttctatatccagataaaaaatacttatatttttattatattttgaatcattgagtttccaatagttctgcctaatatgttcagcagcaatattagtcttaccataagtttctaaatctttagcttgattagcttgaacttttgttagtttaatatttggatctaataaaaatgtatattctcctttaggatcctcaataaaaacttgattcttaagaaagactttttgaatttcagacttattagtttctgtattatagaatctttcataagtttcaaaattacctaaattgaagcaagcttcgaatagtttcatatttctcctttggttctaattttagtgacttacactaaagttctaaaattaacactaaagtgttgttgctttacactttagtgtaaacgattagaatattataatatattaaaacttaatagtctataaattaagaactaaaatgttttagaactgttgcggcttcttgaactgctttgttacgatcaacacaagcagaacattcattacaaggtttattaccacctttatagcagctgtaagtccaatctgggtttaaaccattagatataccacggattgtcaaatcagtttttgtaatatttgtatacggtgcgaatacctgaactctgtcttcggttcctgaaccaatggctttaaacatagcatcgataaaatcatatctacaatctggaaatacgttagaatcaccactgtggtttgctatagcaataaatctacaatcttctgattctgctatacccgttaagatacttaagaatataccatttctaaacggaacaattacatttgaaacttcagttgaaccagcttcgggaactgctttagaaccgcttaataaagcacttttaaaagttccaaaagcttctgttaaatcgattattctatgttcgatttcagcacctaatttatttacttcatccaagacttttttagcagctgctagttctttttcttgatgatttgaaccgtatttaaaacttacagcaatcttaatacgatctttaaactcaaatagtaaagcacttgagtctaaaccaccacttaggcttaaaactgtatctttcatataaatccttttgatttgaaatattgttattatataaaattaaaacttaaaatgttattaatttttagtgagtttttagtattatagtatatactaaaaagccaagcattttttatactttttaatattgctttaagttttagatataatactatagtatatactactaaaaagccaagcattttttatactttttaatatt

SEQ ID NO: 9 - DNA, 35781 bp, Camplyobacter Phage CJLB-13
tagagattacataccccatcccttaagctcatttttagtcttttcattatgacaaactatgcataaactttgcaaattttcttcactcagtttctcgccaccttgtttaattggcacaatatgatctataatttttgcaaactttccacacttcgcacaaaatggatttttatttataaaagcatttcttaattttctccaagctgtgctgttataaaaatctgaacttgctttgtctcttttaaaacaatcatatcttttgtttgctattttcttaaaagttttatcacattcttcacaagttcttaaatgagtttgtattttcttaccacacttgcaaagtttataaattgtcatttttgtaaaatcctatttcagtttttttagaaagttcaactttaaattcatatttaaaatcatcataaggcttaatcacataacaatcatatcctatctctagcaattttataaaccaatcaggaagcaaaacaaaaaaattatttcctacttgtttgattttaaaaccacttttaagctcatttacatttctataaaaattatcatacaaacctaaattacttgcaaaaagcttaacgggaactgcattaacaataatatcttttttattaaacataagaagtctttaagtaattaacaaacgaagctttaaggaatgatatttttatttaaaaattataatatataaaaaataataaaactattaatcaaagattaaattagcaattatggaatacttattgctctttactaagaaagcaaaaaaacaaaaaccattttttatatttttatacaaacactattatattaaaaagcactggcaaagattatcgtattgtttttaatcggattttaataaaagcacatatcatttttaatcggattttaagaaatatgtttataggcattttaatcggattttaatattaaaaaatcatattagaaaactgggttatttaatgggttactataaaatataaaatatctattttataggtatttagatactttttttaatattctgctaaatccaccattactcttttttatcaaatccctattttgctttaatatattaatcaaatgcctataataaaatgttttaaagcttgttctatatcgttcttttatattccaaaatgtgctataatgttcttaaaaaagtgggtcacttttccaaaaatgggttacaaaatgggctactttttacaccaaaatagacactaaaaaagagagaaaaattaatggcaaaaattaacaaacttaccgatagttttttaaaaagcattaaatgcgaaagtgataaaaaatttataaaatttgctgatccgagtttaaaaggcttatatgtttttatttatcctagtggtaaaaaattatttaaaataagacaagcaaatgatacttatataaaaataggagagtatccgttactttccttagcagagcttagagaaatcgctttaaatgcttttaagctaaaagcaaaaggacaaaacataaaaaacgctaaaagacttaaatttggcgatatatatgatgaagttttagaaaaatgtaaggctgatggattaagtctaaaagaaatacaaagaggattaaaatacaaaaatggcgtttttaagaatttcaaagatgtagatatagaaagcatcaagcgttcacatgtcatcgaaacacttaaaaccatagagcatcaaatccctacacttataaaagctaaaggctggattaacaaaatctttaaatatgctttgcaacttgaaatcgtagaaaataaccctgtgacaagtattgataattccatagtttttaaaaaagcttcaaaagtaattcatcagccaactctactagaaaacgataaaattaaagaatatatattagccttaaaaaattcagatcttaaaaaaacacataaaaatctaatgctttttaatcttttgactgcacaacgccccggtaatgttataaaagcaacttgggatgaaattgatttaaaaaatgctatatggactattaaagctgaaaaaatgaaaatgagaaaagaacatattatcactttaaattctcaagcgcttaaaattttaaaagaacaaaagaaaatgaaagtcaatgattatatatttgctggaagttcaaaaaatgggtgtaatagcgagaatatcacctgtaatatcaataaacgactaggatataaaggtattcaaagtgcacatggctttcgtgctatgtttagaagtttagccaacgaacatcaattagatcatggtgtgagtatggatatagccgagcagtgtttagcacacgagcaaaaaaacgccattttaaaagcttataatcgtagtgaaaatatagaattaaaaagaaagttaatgcagtggtggggagattatatcgaaaaacttgcaggggatttttaaatcaccttgcaagtttgcaaccatttatcaatttcggctttttcatatttaaaagtagaacctattttaatccctttaggaaaattaaatttattttgatttactcgcattctcattttgcgaatttttagcggagtaaatcccagatactccgctacttcttttgttgataataatttttctatcttaccaaattttgccatttcatactcctttctctaaatcaaagcctaattttgcaataattgctttttgctcttcatagcttaaaaaattgctgattaaaatcaaaacatcaccaaaacaaaagcgattatagctcgtgctttgttctagcactttaatttctaatgtatcacttaaactctcaagcgaagctgttattttccaatttttattaatagcttttaacatctcatcgtttgcattttgattaaaagcattgtcgtttcttaaaagcaacatttcttttatcgtttgctttaacatttcttgcgtattttctagctctttttctaatgctattttagcttttatgtattctttgaattctttcattttttatcctttctaacttaagcaaataagcttctttctatgtgtttaaacataatttcattagcacttttaaaaaagtcttttttaatctcaaagccataagctttgcggtttaaatttgtagctgctaaaagagtgctaccacttccagcacatggatctataacaacatcacctgcatctgtaaaaatagtgattaatctttctagtaatttaacaggcttttgtgtgggatgtactttaggaataccttcatctttttgccaatccatgcagttataaatcatctttccatcattgttaaattttggaagtttttcacgatataagattaaagcatattcacaatttccaactattttcatatttgcttttaaaacttgagatgagctttgttttctaaaaaccaaatttatataatgattaaagccatattttttagctacttcaattaacattgtttgttgttcaaaagagcaaaaaacaatcatgcaaggacttttaccgcattctttaggttcttttataagcatttttgagcaaaagtgcataaattcgctaactctaaaatcattatctgtatcaaaaaacgccttgtttgcttttttgctttctccatttttattatccccatttatataccattcaggagatgaagcataagcattgttgcctaaattataaggaatatcagctattacaagctgtgcttttggtatattatatcttttaaaattttgaaagtggtcgttataaagctgtgggtgaaacatcatcacttcctttttgattaaataaattaggctcttttaaaaaggctattttttccattatttcattaaattcgctctgatagtctttgatattctgatttaatatgcttctttcatctttaactctttgtatagatctatgaattgctaaagctcttttggttaaaacttctatctcttggtttaactcaccttgatttaattcctttaactgctctaattgctgattagtattttttttcattttttatccttttaattatattttcaagttttaaaagtccgcgttctaaaacttcttgttcttctttacttcttgcttttagctcatttattccttttgctgcaatagaataaaacaccaaatcaattcgtttgtaaaactctaatttctttttgtattcttctcttagtctttgtaaaatgttttctttttctttttcaaataaagctaaaacaaaagaatctgaaaaataaaaacaaagtcttctttctttattttcccctacaatctttgcatctttaaaaaagtatttaagatcattatttaaaacaagttttgctaaatcataagcttctaattctcttgtaatattcatttaacacctcattgtataagttttgctaagctcccttgtgatcttttctacttcaaaagtagcttttaatttattatcacattcagggcaaaagccatctaaactcacgctttttacatcgcctataatttcatcaagacctttaaaaaatttagaatttggcacaaattctaagttgcattttgaacattttattgtccctttaaaaataaaatttactttcatattctctcctaacttgccaaagcgtaaggcttaaatgtcttagcccaacgtggattgtttaaatactttgtttgctcaagtatcactctcatattaaaatgccaaattcctatcattcttaaataatcttgcataagatccaatgcatcattgatatcattttctattctatctaagaacttatcctttatcttcaatgtaagctctaatcttttccatcgcacaaattcccttttaatgttttctttgtgatagtgcttttgtttttcgtatttatcataaagtaaaatgcgttctaatttatagtatttactttgaggattgttgatatacatacttgttttataagtatgaaaatcgccaaagattttaagtttgctaaacctttcttggtgtttaaattctcttggtttagatactgctagatcatcatcaaaatcacaagcaatatccacactataagctttaaacctttttatcattttgcttaaaattttccacacttcagcttctatttgtttactaggctgataaagcccattaaattgcacctctatgtagtaatcttttgcttttttattctttttagaaagctcaaagcaagccttagaattatctaatataatgatagtatttgaaaggcttttatttctaggttttatattgatataacgcattttaaaaggataaaatttatcattggtttttatgcctttgaatttgtcttttgcaaattcatcaatgcttttatttcttgttgtgcttcgcattttttcaaaaagcccccatcttttaaggtatttgtaaaaggtttttttgttgataacgaaacggaagctgtcgtatcctgtgctatgatttgtttgcataaaatatccttttcaaaaccttttttcattaaaaagccattgctacttatctttacaagtgcatagccacgcattgctaaactttctattacctttgctctttgtgcttttttaaatgcatcattatctttttgtatgggtttaaaactcatttttttccttttttagacattaaatgagtgtttagggtttattaaaatgtcctaaacactgttaaactggtgatttatttaatagttgaaattttttcttcgtttttctaatttaaatactaatatatcacaagcttttttacttagctcatcattagtgcataaaattttagttttaagttctcgcattaaactttccacccaaagaaaaagctcatcatctctaaaaacaaaaagctgatttttggcaaattctgcttttagtttctcgtatttttccccttgtatatttttaagcttaaaaaccttttctttagtctttttgtgcttttgtttttcgattaaaagctgatattttaaagcttttatttcgttttctaggtatggtttgttactcatttttaagctccttaagttctttttcaagcctataaacttttgccgataaaacacataataaagtcgctaatactaaaactataatttctaaaatcatttttaactccttttttgatataatagaaaaggtaaaagatgataagggctttcgccctttgccttaatgctttcttgcgttgataatggctgttatcaagcagattaaagcagtgattaactcgagcacatcactagcgttcatcttttactcctttcttttatttcaaaagtaatttatctttacttttgataacacaattataacataataattactaattgtcaaggttataataatttatttttattttttgtagataaagaagtaatttaaatttactttgtggattaattttcgttaatccacgctttaaagtcttttttgatagcttctgctttttctaattttgcttctagttcaaaaatttttttaagcatattaatagcgtgtgccatttgaaaacttattttttcagtagaaatggcattttttactgcaccttcaccaaaacctattaactcggctaactctttataagttaagccttgctctttacaaaattgttttaattcttcacttgtcatttttccctttcttttattctaaagatattttatcttttatgttaaaaattctatataaaatgattttatttttatcgtttttataatactctaaatctactaaaaaattaaatccataaggatttttcaaaacttcttcggctattttctcatcactaaaactaacatcaaccgcataaggacttaaagcatcgcactttgccttatgttttgttttattgtctattttatttgtagttttatacatcgttatcaaagcattttcatgtatcttttgatattcaatttcctttttttcgcaaatgtaattagcattttcataaataagctcagcttcatcactatttattctcaaaagttcttcacctttatgattgataaaaaaagtattttgatttatagtaacgggtgcaaatatattttttaaattattggcattatacttagtaaaatgcggattttcttctatttcttctatactttttgatttgatatttttaaaagatatgataagttctataaattcatttaatgcttgaataggtgcaataataggcaaaacttctcctgctatttcaaaaaccaaagaatatatatcactaccagtttcaactttttctaaaaaaattttactttgtgttataccgtgctcttttgatataaaactatccattaatttttgaaaacttaacaaagaattagccattatcccaagttctatgttttcttcatggataatttttattttaaaattaacaatattttctttctcttctgtcattaattctccttttaaattaaaaaatcttattagccaaagaaaaaacaaaacctacgctttgctttatagcttctttatcagctaaatctatgctatcttttagcttttcgcctaaagtcttattgctttgcattatattacctcttttctttttcctcacaaacaaaataaacttttacattcttatttttattgattaaaagaatttgttcgtgtaaattttcaaaaggactttctaaattgtcataaaatttcaatccacacacaggacaatttttaatactattgtgagtatctataatgatttgcgtttcacaatttttgcactctagtttaaacttttttatcttggcgatttcttgttccatcacattcctttttacaaacaaaataaaattctgcatttttatttttgctaacacttttgaacaattcagttaaaatttcaaagagattatatcctaaattttcatctataaactttattccacattgcggacaagttttaataacattacctatttttgtaatgatttttgtatcgcaatttttacattttatttttaattctgtaattttttttaaattcttatccatatttaaaccttattttattagttcaaaaagcaaaaccacctatgccactaaataaatcaagatggtttattttcatttaataattccgcattttcgtggatattgcccacaatttctagttcttctaaacaaaattcacttagtaaatcttcatcccattcttcaccatcatcaccacattcaactaaatagaaagctccttctttaaaaacaactttatatttaaaagcttcatcttcagaacaaccttcaaaagaatataaaatatctccttcataaatcttatttccttttttatcgtaaaatcctgtaaatagttctatttcaactctatcgcttggcatttgaatttcatctttaaaagtttcattgtctccatattcgcttaaatctatatcaacttgctttcaaaatcgcttttaaaatggctatttgccctttacctgttatttttgtcgtgcttacaagtctatcgccattaatggtgctaacagtcgtttcacttaccttaaaaagtccttgttcgatgtatttttgataaggtttattatcactcattaaaaatcctttttcacgcaagatcttaaaaagtcttttctcgccaatttcaagattatttttttcgtgtaagatttttgcgtaatctcttatcaaaatagcatcatttgtgttttgaatgcgatttgcaaaatgaattaaaggtgcattttgttcggcttcgttttttaggctttgattttctacttgaagtttttcatttttttctaaaagctctaattgcatttgcaaactttcttttaatgaaagcggtttataactttgttttttaagctcattttctaagtattctaatctatcgattatctttgctcttagttctacgctatacccactcactaaaatcaatacttctctttttggtaagcgataatacttgtaagattgcttattttgtgtgttttggtaggtgtctccaaatttggatatacccccttcaaccactttttctaagtaagtttctatatctcttataacatgaaaatgctccttgcctgtaagctctgctatttccaaagaagttaagcttatttctttattttcatcttttttaaaaagttctaaattcatttattctccttaaaattttttagtgtttaaatgaagacttaagagccatcttaaaagatggcttaatttaagaagaaataaataaatttgaggactttaaaagaattctcattagtcctcatttaaacactaaccaaaacataggacctgcattcaaagtctaaaagacttttggtattttggtaaattaacaaagctttaaaaaagcccactttccacaccgtcgcctgtgagtgcaatgaatataagaacacactagccataaaaggctagtgaagcaatctaaaaaatatcaaacctttaaagttcgcaattgtaggcgtttatccacttaacgcaacttttgcaaaaaccctttaagcacactttttgctatcactttaaaaaatgcgattttaaagtgcttagataaatgtgcttaatgaggcttttaagccgcctctatctcttctaataaaactttaatttctctcatatatttttcataggcttgcttacggatttcgttctttttatactcgctttttagcttttctatgcgttttattagtctttcatcctctcttaaacccagttttaaaagggctatttcaacctttgcatttgtaagattatttgaaagccaactatttaagacattgtgagctaaatttagttttaaccctgcttctgttatgctactaacacctaatttttgctttatcgcttgtttcattttgaaacctttatgctgataatcgttttttcaaaaagtccatcactcacagcttctatgcttatctcatcatttgtatgtaaaaaattaagtcctttttcaaaaacctcatcactaaaattaaaacactttctaagctcttccttttcttcagtttttctaaaacttaaaacatctaaaattgatcttgcttctatcattttttacccctaaaaactttataagttaaaacttggcatactttatgctttggttaaataattattttattttgtaaaattaattatgtgtagaattatatattaattttaaatatatgtcaatatatatttttaatttttatattaattataaatatattaagtttttaatataattataaaaatactatgcaaggaattaaaatgtcagaaaataaagaaaatatttcatttgagaactatgaaaagaatttaaagctacaacttgaaagtaaaagaaaagatttagatattcaattgacaagtataatccctggacaatttcaaactataaaattatacatgtggctttgcacttttataatagcaggtgacatcactatacttaataactatataaaaacaacccatacagatctatttactattattctttttagtgtttcaattatatttctaggatattgcgctttcttttccttgcttgccttaaaaataaataatacaatagcttttccacaagatcaatacggtgagatgtctaaattaaattcagataatttagaacatacaaatggaattaatgccatgatatcttctatattagatgctttcgataaaaataacaaaattattaataatatgagtaaagatattggtaaaatttatgtttttcttgttattggagctagtatatctttttttgctataataacaagtggtgcacaaatcgtaaaaggagaaataattatgtcggacaataaagaaaaagtaataaaaccaactccacaaactggaactactacacccataatcccaaaaactagaggagataaacccgagcaagaaaaaaaataatttttaaggcgtaatacgccttaatcaaacaaaatataatacccgaaaaagaaaaatacaaatatgagccaatactccattttcaaatccttaaaataacataatacaattttaatttaaaacttggcatacttattgcttagttaaataattattttgtttttaaaaattaattatgtatagaattatatattaattttaaatatatgtcaatatattttcaaggttatatttatggaaaattattatgaattagtagaagaattaaaaactttttttaatgtaaaaagtttagaagaagtagcagagagattaggatataaaaaaaataatgcaaataattggcggaacaataaacaactttcagctcaagcattgaaaaaatactatgagttaaaaaaggctaataattcagtctctattcatcaccacaaagatactataaccattcgttattttccagacatttgtgcaagtgcaggttttggcaatgcaaatgaaaatgaaaattttcagcttataaacatagataaagcttttctaactgatgttttaggagtgccttataaaacacaatatgatatgattaaaatttatggtgaaagcatggaaccttttatacaaaatggctcttttatcatcatagatactactaaaaattcactagaaaagataagaaatgctgatgtagtaatttttcgcgataatgataacgagcttttttgcaaacgtattttaaaaaatgctttcgatgatgatatagttattagcagtgataattttaattttggagataaaaaaataaaaaaaagtgctttaaaaaattatgtatttataggtgtagtggtttgctcttgtaatgcaaagatatttttaaatcaaattgaaagggtatgaaacaaatgaaaaaacttataatcttatctttattatccactctagcttttgctgattatacacaatacaaaccaagcgaagattttgccaagtattttactaaacaaaactgctcacaagttttggataaattttattatattaattgttatgattattctttaaaaggcactaaagccgtagcttatagattagaagcggataatttaaaaggcgaacaaatcaaaaaacgcccacgctttgaagatgatacaaatattcctaaaaaataccgcaccacatggagtgattataaaaacagcggttacgacaggggacacactctttctaatgcttcaatgagaaaaacaactcaagctcaaagaagcacttttttaatgagcaacattactccacaaaatccacaaatcaatcaaagagtttggaataaaattgaaaaaagagaaagacaagtagctttaaagcttggaagtttagaagttttaaatttggttaattatgacaataatccacaaagaataaaaaacaatattgctattccaagctcttacactaagattttaaaaggtgataattttaaagaatgttaccaagtgcctaatcacgatgtagaaaatgagaatttaagaatatataaagtaaaatgtgacaatttttaattaaaaaggagtaaaaatggaaattgcaggacttgtgtattttatctttgctgttgtatgtgcttttgaactttcttatgatgctaaacaaagaaatatgagcagcttatggtggggtatagttgggtttttctttggcatttttggatgtattttgtatttagcggttaaaaaaccttatagacgagaacaaaaaatatctaaaatgagagatttagaatttttaagaggattgaaagaaaaaaggtgtatcagtgaagccgagtatgaaaaatacaaagcagaagttctagaatagatgtaaatgaggatcattcctcatttaactccttaatctttctaatctgtatctcacactgtttgtatttgtaaaaaagcatagaataagcatttaaaatatctagttcattttttgctattggcttttcaagaggacttaatgttagtagttcttgcggaatttttactttttgaatttctattttggttactacttgttgagtttgcatcccacaacctatcaacgacatcgttaaaaagcttggtaatattattttcattgcttttataaatgtattctttaacatattgcaccctttcttgtacttgatttttttgattgtttgcttcatttaaagcctttaattctgttttatgaatttgatttaattcttttaatttttcttgattattttcatttatttttaaagccaaagctaaatcactttgacttttttctaattttgcttgagtgctatcaagtcttagataaaaataccctgttaagattgccattaaagctaaggctatataaagctttgcatttccaaataaaagatttatcatatttgttttagaagtttaagtaaggtttttatataatacccctaagggttagccgtaggtctgaccccctatggctaaattccacccgcgaaaggtggtgatataaatgtcataccagaagtttataattataattatactactttgtgtaattatagtcaaggcttattagccttgccccgcaaaagcggggtgtaaactttaacctacttaaacttttatctcctttcatgctaattcatttgttatttctaatttaatgtcttcaagatttttaccatgcattaagtcgtaaaattctttgcaagcctgcctgctttgaccgacactttcattattattatccttggtaagcccaagcaagatacaaccttgtgtgtctttatcagtgtttccccagtgtattaaaattgcacgacttgatggcacatcatcattataaacatttatcattgtatcatcatctttttttgtaatacttcttaaagtattttcaaatcgtgaaggactatgtctttttaaattataatttccttcaggtattcttaaatctttgccactttctaaaccttctttgtcttcttccaaagaaaaacattcaaaaagaattttatcatcatcatctaaaaccttaaatttaccaataacgcaagtttttcctgtgtatcttctattaattgttattttcattataattcctttctttttattttttgtattttatttttagatttaaactcatttttcttcttcaaattcaaataaaaaagcattatcaccataggtagttttatcaatttctttttttattcctataaagcttctctcgactataatttcattttgaactctaagggctttttgcatttttatatttgaaagattgacatttccataatatccagcttgcctataaaaaagactcataggaatttcatttgtaaaaagctctatacttacactattttttatattagaagcccaaagacagcattcatttgcattgccatcatatttttttaaagcattggtaatattatgccaagcaggatcattataaattccgctcgttttgatatttccttctatttgatttttacttggttttgaaagaacgctaacttcagtataatttttagattttaaacccattccatctttagtgattaaaaaactgccttcattaagtccttttataatttgcgtagtgcttgctaaagaattttcaaaaccaaaacgcaaatcacttaaacatccgccatattgaccactatttaaatttgtatcaaaactaataataatcaactcttgtgctgtaatattttcatttccaagcaaattaatccaacttgtgtatttatcatcacttgccacacaaagccaaagttgttttacattttcattataagttataattaaatcattaacattagcttttgtttttggagtgggaatagaattagatacttttattccattaatgcctaaatttaatttcatatcttcgagcatctcttctataataggtttaatttcttcttttgttggtgtttgagcctttaaactttctaaaaattcatcttgactttttcccgtgttttcttcattttcaagccaaagttcataagcacttttaccatcagctcctttagctccatcttgcccttttaaatttttaagctgttcttctgtaaaatcttcataagtaaaaggatctcctttatcaccttttaaactttcttgattttctaaaacaacttttaatacaacttcttttaaactctcttcattgatatttgcattgatgccaagctcttctagcaaggcttctagtttttcttttaattcactttgttttataaagttaaaacttgttaaaacttcatttatagcatttttaatactttcatcgcttggttttactccatttttaaaaagttcttttaaaatttctaaagcttcactaaaatctttattgatttcttctgtttttatggcaatttctcttaaatccacgctcatcttatcccctttattaaacatttgatctgatgaaataaattacaagagcaataaaaaacaaaaatcttaaatttatttatttctaaagcttgcattgcttcttttaaaacaagatcagcaagtttgtaatcttttcttgattttgctttttcacataaaaaatcatgcactacacaagcactaaaatactcacttttaaaaggtggaaacaaagaccaaaaaaggcgtggaatactcgctccatcagttttaaaaccttgtggtacaatgcctttgtaatttggcaaaataaactcataatcttgtatcacttcaaacctgtccttatcgtatggctttacacaaaccctttttaattctgttttagtcattgttttccttttttttaaaaatacttcttaattcatcatttcttatttgagtaagcttaacaagcctttcatccattctcataagatctgtttctatagcttctagcttgtcattggtttttgagcaatgtgtttctataaatttaaccaaactatcgctacttgctctggatactgcaatttgttctctaataagaacattagtatttttggtttcacttataagttcttttgttctttccccagcttctttatgtaaagttttatataaatgccatgcaatcccagctaagacaaaaaccatcaatcctaataatgcagatccacttaaagaaccgagtatagcaccttcttttattatattttcagtactcatttttcactctcccatgcaattaaatttaattcttctaaagatgtggcatttttcactttatttcttagttcatcatttttaaaaataatactttcagtatatttagcgataccaaccccaaattctaaaaattcttctttgttaaatgtaatgattttattatctttatcaatccaagcaatattttccaaaggagtattattgagatttgctaacattatctcgctaacttttccgctaatattaatttttgcttccgtgtcaatttgaaatatagtatttttaaaaggcataaacaaaagcttttcttcttttatagcttttagttcttctaattttaattcttttaactcttctaatgctttttctttaatctcataagaaataatataaagattattttcttcatcataagtttgaatttggcgaagttcttcaattttttcattaaaacttggaatttcttcttctttaactttagcaaaaccaagctcttttaaaagcttatcatcgcaagcacttaaaaaataagtatcttgtgcatcaatttcaccttcttcgttttgtatttttacatcttttaaaaaaatatcatcatattttaaacttttattttttaaatcataaaacatatttaccctttcttaattccagtataatgttaaatttgctcttgggtttaatctatccccatcatttaagttccaaccagcacttgcatttgcactaccgctttgccaagaacttagcattatttgcaagttgtttatatttccaaaattgaattttttctctactttgatttttgcattggcagtgtaatatttacttaaagcatgcaattctacactagagttaaaattgttccatgtgatatgcaaagtatttgcagaagttttattagacatatttccagtcgtccaaacttcgcctaacataaccacttctttattattaatatttgatggcaataccactgcttgtttataaatcatgtctagctttaacatataattataatttgcaaccgagcctcctaaagatggaggtaaatttagtgctatgccattattagaaagaaggaggcagttcattttaagtccttactaatcttacattattcgaagctatgcaaaaataagcaaaagtttcagtgccactaaatccactttgagctattctaaatttaaaaggggcattaaaagctactacattttgacaattatttatggttattgttccgctttttcctactcctccaaaattagctattcctatgcttgttcctgcatttgctgttaaaataaaatgttgagcttgtcttaaatctagatttatactgccagttgtgccaagatttttaattccaccaccataatctacataccattttctagttaagtgattatcatttgttggatcggcccgagaagttaatgcctgattaaaagtatttgtgccattaaatatattatctccatttaaagtcttatttccatttaaagtctcatcaccttttaatcctactttttctttaagggcatcactaagcattttttgactaaccaaacttttatctttttgtatttgttctaattcattttgtttatgatttaaatcttcttgcatctttgtgatttcttgctctaattgcgtctttttctcattgaggttatctacattttgtggtgggtcttttgctaatgcttcttcgatttgctttttaatattttctaattcttcctgtttattgcttaaattttgttccagatcctttatttcatttttgcttgtttcttctttttcatcttcttttttcaaatcccctataagtgaaagtataaagtttatattttctttttcttcattaaaccaaataaaagcatcaagccctagatcagactttaaaatccaagctgtatcgttagtcactcttgcatagattaaatactcatttccttttttccaaatttcgccaagttttgcctcacttggttcttcttcgctttcataagtaggtgtatattcgcttgggttttcagggctagtccaagaattgccacttgtggttttaatataaacaagatattcatccccttttttccaaatatcgccaagcgttgcattttgtggagcttcttcttgattaaatgcaggttctaaattctcaggcaaggatgggtttatccaagcttcattcttcaacactttttcacaaagataaaattcgcctacttgtaaattaacatcatccataggcttaaaccaaatatcattaatttttctttctttaggtctttctttttgtaagaaagtgatttgtggatttttaataaatttaaagattttagcctcatcagttttaaaccaagtttcattcacattgggcattgtaggttcttcatcacttacataatcaaaaggataaaccacttttttataaagttcttttagcatattaagtttttcatcgcttaagttttcatagttttgtaaagcttcttttactttttcatcaaaagcatttaaattttctaaaatgtgctcatcaatcctatcttttgaagcataaagccactctcttatggctgtaacatccttagtagcttgacttagcgtagcataaagctctgtgcttcttatttttgagttatcaagcattgttttctccttttaaagttaaattaatttcgttttgtgaagagagtatgtttgtgatattttctaaagctttttgggcaaggtttatatctcttctttgttcttctaaactcaaattcacatcatctaaatttagggcttcttcttttcttagtttaataaaacctctttccataataaagcgttctaagcttaagctatgagttagagattgagaaatagcgatataatcagctccaacgccattgtcatttaatctttctatcatctcatagcctttgttttcaactatggttaggcattcatcggtaaattcttttaatctttctttagctttttgctctaaaacattttgaaaatctttgcaaaaattttctatttttaagatatttatatttgttttactgtcaatttgctctaaagccaaattagtataagagatcatattagagtttagctctatcaaggaagcacttaatatatttatatctttaataaaatcattaagttcttttgaaaaaggaacaagcgcattaacaaagttattagcatccttgtcaaaatcaacaggattagccatatcaggtgctttaggtaaagtattaatgaaagatattttattcattgaaatttccttgcttttatttttaaaaatttcttgttttggctttcatcttccaagcttacaatctcatatttttcatctctaaaaactagaaaataagaaaaatcaagctctaaaaatctaagctcaaattcatgcgtagcgactaaagataagccactatttaactctttaacatccgcacttagatttttacaacttgcataaacttctttaaaaagtaaatcttgcgtaaaatcgctttctaaaaactcatttttgctttgttcttttttgtaaattttaactctatgcttaaatccatttgctttcattgccattgccttttaaaaataagctattttgtagcgagtgattaaagcacttgaaattttaggcatactcacaccatcaaaagccattaaaacataatttttaagccacaattttatgtcttgtggcaattcttcaaaacctaaatttacaatcatattcccacaacctattgcataaagcacaccaccatttgttttaaactcggctttaaaatttgcattttttaaagcattaaaaggagctaaaatcaccctttcattaaaaaattcaacttcataatcatttaaagctaaaatgcgattggttcttgtttcaaattcattcattccagcttttaaaaattgttttaaatttgcatcaaaaacatcgctatcaattcttaaaaagtctcttaattcttgaatgtctatgagttcttttttgctatcttttaatgcctttaatctcattttttaccttttttatcttctttttcgttttgtttttgtggtttttcttgcatttcttgatcttcttgtggctttttatctgtatttgatttttcatcagtattttgtttttgttcttcttgttccacgatttccacaatgcctttttctaagagccttaaggcttcactatcttcaagtaaaacctcatcaccttttttataaaaaatattaccgcttaaacaacacttgaaaactacttttttcatcttccatcctttaagcagggcatacaattttacaaactgccgaattatccataagctttgcatcaagtcttaaacgcactttaatacctattaaatcattttgagagtaaagctcattaagtcttgtaaaactcatacttgatctatcccaaatttcataaaaactaaaatctccaaaaaatgcagggactttgcttgcaccaaaaccatcaacaccagaacaataaactacctttttacctaaaattgtgtcatagccattagcacttaaagcaggtagccacaatgggcgattatcattatctgtaagtttataaatagctttcataaactcatctcctacaagccaagtggcatttttacgataagcactgtctaaactgaaaaaagcatctatgatatcattgcttgtaataccttgatttgaagcaagtgtaaacgcttttttagcatttttaagtcctgttggttttttatttccatctccattaataaaacttaattcttctgtttttgaaatcttttcagcggcttttcgcactataaaactttcaagatttgcaatgttgtcactcaagagttcttcgctgattttaataataccgccaagcttatgtgcgcctatacttaaagaactaaatttagcactaacttcagtaaagctttcctgttcgccaagccaagaaaattcccccatctcatcaaaaacaggtataatttgattgctagagcttttttgcactgtagcaatctttctaataacactaagatcatttaatttttctcttattttactttgcaaagttgtagggactaaaatcccaccttgctctgctgtgctttcatttaaaacatttctttttaaaatattgtcaatacttccatttcttaaataattcacaaaagaacgcatatgattttcttcatttaaatcttcatcctctcctttaggattttgtcctaaaacagggcttacaacctcatttaaatatttttctctttctagctctgcttcagctcttgagagttcttttcttttactttcaaaatcttgcattaaagcttcgtattttgtgttttcttcagcactaaagcttctttgctcgtttttagccttatttgataaagccaccatttgttcgtgtaaatttcctatttcttgtcttaatttttgcattgttttttctccttgtttaaattgatatttctaaaagtttaagttctcgctctctagcttcacttaaggctttgattttctttttttcttcatcttcttcaaagcgttttttagcgtttttatccgcacctttccaaacagcgctgagttcaaaaatttcaaactctgtaactagaacccttttaggcgaactttttttatctacaacttgctttaaaactctataaccaattgacacatcgcttaaaattccatcttgatattttttaaagatatctaagcttttttcgtctttggcaaagatacaatcacaaactaactcattattttcaattcttatattttcaattcttgcgatagcattatctacgcttggtttatgatctttaaaaagagttttaagattttcaaatctcgcaccttttacatcaagctcttctatatagtccccaagctcccaatcaaaacgcaaacaagcattagaatttgaaaccatgacaaagcttaaagacatattttcttcgctaacgcttctaagtcttgcggtatctgctcttatgtttttaaaactcattttaaaatccttttttgaagttttataaggattttagaaaatttttaaggcgttaaagtgcgtgttagaagatattttttattttttaaatcaaaccttgaatatttagtttatattgcatataatcttgatcctctaaaggtgcagaataatcttttaaaattccaaaagtagttaattttttaaagcccaattcgctttcatctcctataaataaggctttagtattataaagtcctgctattaaatcatcataataatcaaagtcttttttttctacagcaactataaattctaagtattttgctttcttaccagttactacatttgttactccccattcatttgttgaagtttttgagtaatttatataagtgctatttgcaggatagattgtaacacctgcaaattctttttttcctattaaaatatgtcctacattacaccctattttagcaggctcaaaacttattaaaatttctgagttaataggataaggtaaaaacacaaaatcttctttattgactttaaatttgctaaaaaaatattcccaccaagtgcgagattttttataatacattgatttttcataaatgattttgccatctaatgtttctatctttatttttgaaacatctaaatttaaaaatgctaaagtatcaaataccccatctactttcaattttacactccaagctttatcgcattttgtttgagtatttaattcatcatcaaaaaaagcattttcattgatgggtgcaaatttaacccatttatcaaaatacacatcaggttcttcatgcgtatcttcatcacttgcacttacccaaacaaaacctttaaattgcactttttcattatttttataacttacttccttatcccataaaggcgtttcatcttttttagctaaattttgtaaaacttcaaattctaaaggtttaattatagtcatcttctttccttattaaatattttctgcaatttctctagtttgtttagttaaaatacttaaatccatatttgctctttttacacttttatctacattgtcaatttttgaagcgattaagtctagtttttcttcaaaagaattaaaacctttattaatagctttttcaaaagcgatgcctattttttcaaaaactccacttgcatcgatttttaaacctttgccattttttaaaggaattacagcctcaggataaccattctctccaattaaagcatttgtagggcgtgtaactatcccgccatctgcaaaagctttcatttttttgtaaggatttttaatctcattatttaaatctttatctatatttacctgattattttgatattgcaaaagtgcatattctaaatttttaagcgttgtttctgtaagagaggcgccatcttttatagatttaatcgtttcttgtaaatatttagccatagggctttcttcgcctaaatactcgatcatttttgcaatttctgcttcactttgtgcaataagagtttttttatactcttttaactcttctaaagtcatattagaagtgtcttttaaagtttgatctaacttttcttgtaattttttattttcttctgtaatggcttctattttatcttgtattgaatttaaatctgcctcaccacctaaatctttcatttcatttgccattttaagcatttgtagttgatactctgcaaagcttgaagcttgatttttgatctcgtttgctttttgcgttgcagcgttttgcaaggcactaaagcttgaacttgtaagattgccatttttaaaatcatttttagcttgttttaaaattttatcgtagtttagcgccacgctctcgcttgtagctatgctttgattgattaaattagtgctaaaagaacccaaagaacttaaaataccaagttcgctatttaatttacttaaaagtttattattttcatttaaccttacttgatctgcttctttgctttcatctttgttctcatacgcattaataagcttttctacctcagcgagtttgtttaaatgttcgcttgaaaagattaaaccgccttgtttgtcgcttatttgtttaaattgtgtaatgatatctacaagctgttttctaagttcagtattacccgtgcttaaaaattcatttaaaccctcataacctaaacttaaaagcttatcattagcactaaaaatatcctttagcatttctttttcgctatcatttaaatcatcttttaaaccgctcattaaggttgcgtaagaattcattagatgattaacttcaaaaatactacttgaaataccattagcacttaaaaagctttgattgatttgcataagttcttgtgttttttgtatgatagaatttaaaagatttttaacttgttcttgtgcttgcgtataagcttgtgttaattgttgccaaatttctaaattctcagggctaaaatcttgccttaagctctcattgaaagctttattaagtgcttcggcactaagttgtcctaaatctttaaagctttcttcacttaatccaaaaagactaaatccacctgtggaatttctcatcgcagtttttaaagcatacatggtatcatcataagctatttttgcttgttttgttggatcatttttataaatttgatttaaaatgctagtttgcatttgcataaaagtaccaaattgattagaaagttgctgggcatagcttatattatttgcttttgccttttcttgtattgctacaatttgtgcatcgatttcgcttttatcatcgatatttaaaaagctttttaaaagtgcagtaggcaaagccgtatcaaataaagaattattagcgtattttccagctactaattcaaacttatctaaattggcatttaattttacaagtgttgcgtattggttttctaaaacacgattgatttctttgatttttttatcacttaaattattatactctgtccagctttttttactaaaccatcctttcttttgatagtctacataaccttgcaaattagaatttgtaaaaaaatcactaaaatttatattttcccaaagttgtaagccgcttcctgttactttggtttttccaaaaataccgccaatgactgatcctaaaagcccacctactatagttccaatgccaggcattataatactacctaatgcaccacctatcgcaccacctgttcctgcgtgagtatcagccttaaaaagccaatcacctaagcttcctatgccataacctagaagtccgcccattgctgcattagctaaagtgccacctatatagcccaagcccccaccaaaaccaagagataaagcattacttgcaccacttaatcccatacccgccaaagaagcaccgtttgtaaagcttgcaccaagtcctaaaaaatttgccaaataagctgaaccattagctaaaagattactgccaaaagtgcctattgaattgatataaccttgtaaattatcaaataaagaattaaagccattgcctatactatctataatatttgtgcttgaattttcaatagtagtgctaatatcagaacttgaacttaaaaaatcactaaaaccatccgcatttaaagcatcactaaaacttatttcacttcctgcattttgactactgccaaaccaattcataactttatcataagtggcgcccgctttatctatccattcgccactcataatgccatctaatttacttgcaccctctataatattactcacattattaaaagcattatttcctttttctatggtgcctgttttatccatgactacctcaacaccattaaccacaccttgatatttgccatcactatttaaatttaaaccttgatttttagcaaattcaacaactgagctaaaagcatttgtttgcgagtgtgaattcacattaccaaaagcaaaattaggcattaaaccgctcaatactccagctcctgccttagataaaaagccactaagtgatgaaatataaggacttaaaaaatcttgtaaaatggtttttcctaaatctttaaacaaatcttttaaggtttttattttcccatttataacatcaaaaaagctactttctatcgttttttgcatatttgctatcatttgattatagtttttttctacttcgctcatggcttttttactgtctttgcccatttgaaaataagcgtctttattggcttttatcatctttttaaaatcttcttctttgatgagattttcacttaataatttgctgtatttgtctcttagctcaatttcttttaatgcccaagcttcctgcttattttctatactttcataaaattcaatcattaaatttttagtatcttcaaagtctttatttgcactttctagatcaagattaattttaaggctttcttctgcttgttttaatttgtttttatcaatgcctaactttttccatacttttaatttttcattaatttggcttaattttttatcgtattcactcatgcctatttgtgaaatttcttttaaggcttcattttgttctttgatgcgttctgccagtttttgattggcgatttctttttctttttttaatctttgctcttcttgtttatttatatattcttcataatgcgttctttgagctactaaagcgttatattgctctaattttgctaagtctttattccaatttgcattattcgtgatttgttgtatggtttcgctgataagctcatattgttttcttaaattttcggcttgttcttctgtgctttgcggtatccttaaagctttcaaactttccatggctttgctaacactagcagggagattatcaatagcttctagtttaaattcttgctcctttgcttttttggcggcttcttcggctagttttaaatttgcctgtatttgttcgtaagcttttctagcttctttattcatttttagctgttttccggtaacactttcaaacatataatcagtgccttttaaaacactttctacaccttcttttatataccaaaaatctaattttgatgtgatttgagctcccaaaacacttccatttgcttctaaggcatccatttgacttttaagatttttaacatactcatctaattcttttgaacttttgttttctagctttctttttgatgttttttctaaagctttgtcaaaattatcccaattcgtataaagcttttctataaaagtcatcaaagctataagcccagcagttggagctaaagcctttgtaaaatttaaagcagaatttgctaaattactcatagtgccttttatggtgcttaacaaaggatttctttttaagatactttcattaattaaagtttcatttttcttaatctcttcttctaaatttcttatatttttaagggcttcttgttggagtagcattttttcagcacttatcattgttttttggcttgtagaataaaaaggagctaaattgctaacctcttttgctttttgtggcataaggctttgcaatctttctaaatctttgatagcatctttaaagctttgtgcttgaaattttaaattcctttgatttataacaagttctttcatttctttttgttttattattaaatcatcataatcttttttaacattcttaataccattactaagacttgtaaaaaaagatgaattcttaaaagaattaaaacttttaaaagctacataagcaagtcctgcaccaatagccaaatctttaaaagaagtagcaaattcggtaatagctttaatgcccgctttaatttctttttcattatctttaatataagtgtttatatctataagcgagcttttaagagtatcaaaaataggttttgaaatttcagcttgtaacatttgcatattagcttcaaatttttgcatttgcttttcataggtttgcgttgtgtagtctgtatattttgttaactctttggttttttctataaataaatcaaaaagcttaccatttttctttgcttcgctcatagcatcatttgtaatacctaaactttcagcaaatcttcttaaatctccacttgcgctaaatgccccagctcctaaactatccatagtaattgaaagttgattagcactcatggaagtatttgaggttgctatcataatactttcaaaagcttttttagcttcatcaaagctcatattatttaaagctgtggaggcaaaagattgaaacatacttgataaatcctgcaaagaatagcctgttttagtatgcaaatcattaaaatctttaaaggttttttcactgctttttgtagcggctttccatttttcaagttgtgatatggcttttcctgtggtatcaatatttgaatgcgtggtggctgttataaaagcaagttgagtttttgcagtctcaaaacttttacttgcttctataaaagagctaccaaaattttttatatcaagtgctaaagttttataaccctgataagcttgtgttaaatgggcgttcatgtcaattacgctttttgaaagtcctaaaaagcttttttctatatcttttatgtatttatttgttgtttgtgtagcatttcctaattgattaaaacttttatttaaacctccaatactcgctacaccgctatttgtatctacgctaacgccgattttaacatttttagccatttatgttccttttagtttttttgagtagaatttaagataaaaaatggagtttttaaattatgttttttccatatatagagcttaatttttttgcttttgtttttatttgttttgtcttttttctgatgtggagcaaaagccaaaaaatatttaaaaatgaaaaatttcttaatgattataaaagttgcgaaaaagagcttatcgcctttaaagaagctcatgaaaatttcataaaaacaaagcaaggtaaaagtgtgcttatgagtgcttttgctttggaatttgctatcaaaaataatgcttttggcgatgattatacgaaagaatttaagcaaattttgcaaaattatccaaacgaaaaagaattcaatatagaaataaatcatcatctatcctaaaagacttaaaaagtcatcttgtaattttttaatatcgattttttgattttcgttagtattttgcttagtatgttttaaatgagagcataataaaaagtcttcattagtcgattttacacccataaaagaagctaacatattaagtaaaatactcatttgcatttcgtttctatcacttgctaaaggctcggtgcttaagaaatacatccactcgttaaactcactttgtgttatactttgttctaactcgcctatggtttttcctaatgcaagggcaaggcgataaattaatcgcccttgctctcttgctttgggacttcatttgtaaattttaaaatttcgtctgcgacttttgcgataatgtttaaaccctcttgattgagattatcaaaggttttttcatcgatttttggagctactaaacactttaagatgatttcttttctaaaatttgaattcttcttaataaaatcgatgctgattttatcatctttattttcttgtatttctatgccatttttttccataatctctaattgttcgagcatagaaagttggcgaattgtgaatttttcatcaataccttcgattaaaatttctttttctcttaaagaatgttgttttaaaaagtcattgaatttcattttttacctccttttcttaaagcatcgctaaattttccatttaaaaaagtttgcattgtggcttcacttgctatgcctgagctttgatctatggtgtattttttgcgaatatcttcatttgcaggataaagaagtgttaaggcgtttggataaaaatataatgtttttccttttaattcctcataagtctgcccttgttctggttcggttttgctttcatgaataatattttcatcattttctttttcccaaactttatcagcttcttttgtggttataaattcattgttttcgttaaaagtttgtgtactaggatttggtacaacacctcgcacctcatcaaaaacataaaccattctttcatcgtttaattctggtttttcaagtgtgctttcttttgggtaaaaataaataattttaccttttttatcactcatcacatcgcccacatttaaagcttttgtactgtgttctatattttgactttcttcaaatctaaaaggtgtgatgtctttagcttcgcctattttttctgctgtgatatttgcactgaatttattatttgcttcgctttgaagctcaaagcctgttaatttcattttgattttaagcatggtttttctctcatcattaatctctacgatgataaaaacttcttcattttcttcaaaagctttttctaaataatttaccccctcatagctttctaaattaccatctttaacaaatttataaagtaaattcatatttacagtagctgaagtttttttgcccactgcgttgatttcttcataatctctatcgttgattgggcttagtttttgactttctctagttccacctttaagacctgaaatacttgttaaaaatcctgcttgaatagcttcttttcctaaactttccatagcacgagataaaactaaaactctaagcccttgcacatcaggggcatctgtaattattttgtcttttgacatcttttctccttatataagtaatgtaaggagattttataaaaagtttaaggcgttaaaatgcgtattaagagatatttttcataaaactatatttttgtattttattttctaattttttgttgatgaaaaattaactattctttgtcttgaagtaggacatagaaaagaaatttataaacgataagtgataaaaatctcactcgtaaaaaatccactctcttcatctttatcttctccatgtattaaaatttcaataggttttttataaaattttaaaataaaactttcaattttgctttttaactctcttaaatctttgtattttggagtataaaggctcaaattaatttctaattctttgcttaagattttatcatctatacttaaatttaattcttcgcttgtgatttcataaattaaaaatgctttttctagctttgttttttgccttgaaagtgggtaaatttctatatttaattccttgcttagtcccattaaaaaatcgcttaaaaattccttcatttaaaatcctaatttgtctaactcagcatttagttttgttgtaaccaagctttgcatttttgggtctattttctcttttgctttttgcatggtataagtgccttttacaaaagtgttttttccgcttatatttggttttccttttgcactttttttcactccgcctttatgaaaaaatccatactctataaaatgagcataatacgcactcgcaaaataatccattctttgttttctctcatttttctttgcttgtgtccattttttagcattttttaatttttcaaatctttttatacctacttttttcattctaaaaacaaccgaagcagcacgataaacacctttttctaaagtataactagaaactgccttaacactttgctttaaaagtccactttgtttaggaatattctttttataatcatttgtgatttcttttgctacttctaaagctccttttttagccgcatttggcaaagcttttttacttatgctttgcaaatctttcattaattcgttcaagccttttacttctatcattgattgcctttttgtgtgtctttttcatctattttggcgagattaagcggtattaaatgatcgtttccattatcaattgggttcatttcttccaaggctcttacttcgtttatactcatcacgccattacttaaagcttttacatagctttcccaccttgaagaactatcagctcttaaaatagcgttgatattgaatttaaaataaaattcttttctttcattttggtttaataaaaagcgatttagggcttgttcgattttagttgttagaggtgttatggtttgcaccatataatttgtctcttgttgttcgatatttgaaaaagtcgcacgacttaaatctccaagtttgtgcggtgggatattaaaaagtcttgcgatttctatcacttgaaattgtttgctttctaaaaactggctatttttattcgcacttgtagtttgtgcataacttgctccaccctctaaaatagaaatattataagcttttttttggctataattttctttaaaggattgttttaatctcgaatatgcctcttcgcttaattcatttggtacagatataacgccacttgtaaaacttccatttttaaaaaagctaagtccgtgctgttctatagctgttgcaagttctgtggtatttttgctttttctaagcggtgcgataccttttactccatctttagtatgataaggcacatttaaaacctcatcataatttaaaacaatactgccattttttgagtaagcttgataaaaatactttccattcattttaaagatattaatgtctttattttctatgagttctatagaattaatcaccccgtttctttttttaacaggatataaaaaaccattgccataaattaacatttgtaccataaaagcctcaaagagtgtaaaaggtgtcattgtttcatttggtgcgattttgatgagttcatataaggggtgattagaggctagttttgatccatcagttgttctttgatataaatttaatggcaaagatgctatggtctcgctaatatttgagattgcggcaattactgctgaaagttcctcagcttttattttatcttctaataaaatttctaagctattaacaaattcattatttcgtgctttttttgtaaataatgatcttattttattgaacatgcaaaacctttattttttacttattttaaaaaaagtttgaggcgttaaagtgcgttttataaaaaaaatgatataatttctcagtgatcataagaattgtaaaactttaaaagtaggttttagacttcttctgataaggagagttggctcatttacgagttaccccgccatgtgcggggatattattttctttgttattttttctctaattgtttctaaatcttcttttttgatttttccattataataacttattattcttttagtatcaaaggttcttacttgtgataatagagctacttgctttctgtttttactatctgtgaagtgatgataaagaaaacctgttttattttctattttgcttgttaatggaacgccaacaaaaagattaacataatcctcaatgtatattttgtttaaaactaaaaccggtcttttgaagtcattatgttttccataaacttcactgcctatattttgtcctatgctaacccaataaatcttacctatgcttattattttattttcttttatttgtagttttttcttttcattattccatttatcaaatttatcattacaatttatcaaaaaaactccttgaaaaatataattttactcatttttacttctaaatttattaagctataaaaaccttatacctcttttttcataaacattgatttttggtttttctatgctgtttttagtggcgattgcagtgactaaagccgaaattgcatctatcctttcacttgattttttcttatcaggctttatgttttctcttgcatcttgatcaataactaaatttgaattacaccatctaaaaataggattgttattgtgatttaaagtttgttttaaaactctgatttggtattcttttaaaggttcgctaatacttgcaaaaccttgtctaatctgaacgcactctatattttcatcgcttaactttttggctacttctaaactattccatggatcataacctatcattttgatatttaattttttatttagagctaagatatcgttaattaaatagtcataatcaacactattacctggcgttagagttaaaaagccaagttttgcccattctaaataaggcactttatctcttttacttctctctcttgcactaagttctggtgcataaaatttaaaatccacatgtaagattttatccacttcgcaaattaaagctaaagcagttaaatcagtggtagcagatagatcaagtccaacataaacatcgccttttaaatcaagttctttaaaactgcattttaaaaaatcatcatcttttataaaagaagtagcatttgaagtccatatatttaaatgttttgttttaaaactcacctcatcatttgcgtttgctaaagctttttgataatattctcttaatttttcaagctttacgccataacccaaagcaggattaactttgatccaagttttttcatcgttccaatcatcatcagcatcaggctcataaatctttgcataagttgatgggtcgtttataatgccatttttaacttgtttgcaataatcatattgctttttcatctctccaaaatgattatatcctgctgttgaaatgactatacataaagaatttacacgacttgccgttccttcttctaaaaccttatataaatccccatttttggcagcgtgaagctcatcgtaaataaaaacataaggtcttaagccgtcttttgtctcacttgtagctgttagaacctttataaaatcttcaaatttagcgtttttcttacggatttctctataggttttatattgatagcacattttatttaattcttcttcttggcttaccatagatgaagcagcattaaaaactaattttgcttgttcggtttcatttgcggcacaatatatttttttacccttttctttatcaataaataaaaaataaagcaaaatagctccgattaactctgttttaccattttttcttgggataaaaagcaaagcgtaagagtatcttctggcgtttttttccttagaataagtggcgatgatatcgatgataaactcgatttgaaaatttaaaagctgaaagggcttaccggctaattcgccatcggtgtgctttaaaagagaaataaataaaaccgcttttttagctattttctcatcaatataaaagggcgagttttcaaattctttgtttttttgtttaatataagctaaagcgtaatttaatatatcttctcttgctcttaatttatccataatttaactttcatcttctaaaagcacatcaaaagctgatttttcttttttatcttttaaatttagccttgcacgatttggagagcctatgcctaaaacttttgctaagcctataatatttttagtcaaagaattaaaagctataagttcaggcgttacaataggcgttcctttatctgtgcttgttgtaaaaccttttttctccatttccttgcttgtgcattctaaaaaaatgagatttttaacataagttttaataatatcattttctaaaggattataaatgcctaaattttctaaatctttgatagttttttgtgtgagttcttgctctatggtttctaaatttaaaggcttaaaatcatcttgcgtttgtatttgttctgttttatttgcctttggcttttcttttatcgaattttcatcaatatacaaaataacttcgttttgt

SEQ ID NO: 10 - DNA, 30270 bp, Camplyobacter Phage CJLB-13
atatttcatagtatatactatagtattaatattcgcttaaaattttaagtatattttaagtattttcataatataatactatcaatagaataaacaaaggttaaaaacaatgaataaaaccgataaaatgattgaagctatcgaggatacactattaagtccggaaaatttaggaacacatttctatgttttagaaactataaaaggatttaatttcagtattaagttcgataaaataaatagctctattaaatattttactaaaagtaaaccaattaattttgaatctaataaaagtccaaaaattaaagcacttaatgatactattgatgaagttagtttaattaacaaattggttgaattgattaatattaaatacccagaagatgaccatattgagttctttttgacattatttcctattggagtaagcaagtctaatgattctgataccgcaggatatgcagtcataatgtatgacattttagtcggttcaaaaccactagaatccaaatatgaagattttgataatgttttagattattgcactttagctggtatcaaaacgaatccaattattagaattgcaactgatttagattctgctttaagtgttcctgtaaatggtgattctatgattccatatcttttcaataatagttcggagtcgatacctatgtatggcatcaccatcagaccttataaggaattgcaatacaaattaagatctaaaactcatagacttattattgatcttgatgagtctaatatgccagtaggttctaaaactgaagattcagaatttcttaaatttttaaacatagaatcattaaatgttgtaaaatctcaaaatccaaaaaatttagaaacagagctaatatattatataatagaaaaaataaatgaaataaaacacttaagtgtagaagaaattaaaaatctaaaatcaaagtactcacaaagagttaaagatttcatctctgtgaactaaaacactaaaatgttaagtttaaagaactaaaatataaatcgaagaacgaaaggtgtaaaaattgtctatgaaattttttgtaaccggatccagtggtttcctaggatctaactttattaaaatactatattcattggattcaaatccaagagtaattggcttagatgtaaatccaggcgaatatactgatagtacacaaggtattaaaaatgctaagaaatctgggttgcttaaaaacttaattaaaaatagtgatatagttgttcattttgcaagccatttaggcgttcaaaatattgtagacaacccaaacttaccttttaaatcttttaaaaatgataaaattgttgtagacttagccactaaatacaataaaaagattgtatatttttctacttctgaagtatatggtgattctaaagattactcagaatccagtgatttaattataagttctaaattaagatctaattatgctttagaaaaactttttatggaaagatatatccaatcaaaaacaaataattatttaataataagaccttttaatgtttacggtcctggtcaaaatccaaataatggattcattgctaaagtattagcagcagctttcaatcctaaagaagtgattaaaatcagagtcgatgctgagccaaaaacagggactgaaagatgctattgttatgtagatgactttaataaaattctttataaattaattaaacaaaatgtcagcggtgtgtttaacataggaaatcctatggctagagcaaatccattaaatatcataaaaatattcaatgattttgggtataatataaaatataaattcgaaactattgaaaatgaaaatgattatgaaatacaaagacgagttcctagtattgttaaattaagcgaagttgttcatatcgattttacaaatttaaaaactggtattaaaaatattttgtattatattgacccaccattttgagataaaatttaaaacctaaaatcaacaaggagtaaatatgctaaaacatttaataattgcaggtcatccagatgatgaggtaattggttgtagttctatactactagaagattctgttggtgttctatacatcacaaatgattatagtactgctaacacagaacgtaataaagtcaaagataaattagctttggattatcaaaaatgtttaaaatattcattttttaaaatgcctgatattaatgaattagctgataatattaaagacgttttagactccattaaaccagaaaatgtttatgttcaccatccaaaagatttgcatcaagatcataatactattacaaaagcaaccctaatagctgctagaatgaatagaaatgattatattaaatctttaagttattattatgttgaaaatccatttgaattaaaagcttgtgaatttaaaaaaatagataaagatgaaaaacttaagtttttatctaaatataaaaagtatataccagaaaatcatatcaaaactattttagcttttaatgagttcgtagggatttatagcaatttaggttttgcggagccgtttgaagttgtttataagcgttcttaattacattaaatctaagaaaaccaaggaaaataatgagtgaaattataatgattcacgaagtaaatgataaagttctcaaagctgtagaatctttagacccagacagcataatcacatttgatgatggtttatatacacaatttcattatagaagtcattttgcgttatttaaacgtgttatattctttgtaaatccgtccataatttgcgaatcttccgagaaacaatctaaagagtatatacagtgctataacgcccataaaaaggcatttaaaggctgttttgaaaattatatgacattagatcaaattcagcaaatttcaagggaaaatatgtataattttgaaataggttcacattcttataatcataaatattttaaagattctaaatctttaataaaagatattcaagattctttagatttttttgagaatcataatatacctattaaatcattttgttttccgtataatcaagattcgagaaacccacattttacccaagcagttaaactaaagtttaaagatttggatatttttggtaataacagagtacctatcgaatctaagttctaaatattaaatattagactaaagtcttagattttagactttaacaatacagcaaattaaggagcttaagtgaaaaatattaaagttaaattaatagcagattctggtatcaatgtttttattgacgctgtcagaacttgctgggatagtcatagtaaatgtgatactaatggtgataatgtaggagaaaatgataaagcattaatagatagaatagtacacaaacataaacaccattctacattagaacatttgttttataattttgaaatcacaggaatttcaagactttgtttgcaagagttggcaagacacagaatggcttcattcagtgttaagagtacaagatatacactaaaagaacttagaggtgctgatatttctacattagaagatgcaagtaagtttattgttttaactgataatgaattagtagatgctgcaagccacaaaaacttaaaagaacttcataacatagtcaatacaaacggtattacccaagactacgccaagtattgtttaccagaatgttacagaacttcattaagattttctttaaatgctagaagtttaagaaatctattagaactaagattatctaaaggtgctcatttcgagattcggtatttggctaaattgttgtttgatgcattaccagatctacacaaagaattaattttcaatgatttagaatattcagaataaacataaggagttaaaatgtatgttacaaaagaagtagacgtagaagttgaagttgaattagatgaatttaaagacaatgacgtcttaagatatgctagggatttaattgaagtcgataaatctaaaatagtattttttgagggtcttatagaaccagaatttaattttgattttttaaatgatttatataatatagaatacaaaaaaaattattttgaatcatttcctaagcataaaaaattaattgatttcataaaagctaattattgattttaaaggcttagagctaagaaccaaggattttaatgaacgttttatataataatgaatatattgattttacaaaagaacctttattttttggaacaggtaaaaactcacaaagatatgatgttataaaatatcctatctttgaaactttgtttaagaaaatggctggttttgattggcaagaagatgaagtacagtgcactaaagatcaagcagatttcaatatcttaaatgaagcaatgaaacattcttatactagagtgttaaacaagttaattttcttagattctattcaaggcaggggtttattacaaactattggatctattgttactaacccagaactagaagtttgtatgacagaatggcaaagatttgaaatttcaagacattcaagaagttacactcatattcttagatctgtttatgctaacccaagtaagatatttgatgaatcttttgaaataccagaattattagaacttgcagatagtatttcaaaaccatatgaagaagcttttgaagctgtaacaaagtatcatttaggattaatagatactgaagaagttaaagtaaaagttcttaatatgttagtcgaaattaatatattagaaggtgttagattttattctggttttgcgacaatttggagtatgcattatagccaagggttaatggaaagaactggcaagattttacaattaatttgtagagatgaaaacctacacttagcaataactcaaaatctaattaagatattgtcaagatctcctgaagaaggctttataaatgcttggaattctattaaagataatataactgatagatatttagaagctgctgatcaagagtttaagtggattgattatttgtttagtaaaggtgctttcttaggtatgacaccagaattagccaagaattatattaaatatcttattaataaaagattaaaagctattggattcaaagaagtttttgctgggtttaataagaaccctataccttgggtggaaacatatattaattatgataaaaatgaagttctcccgcaagaatctgaaataacaaattataaaatggatattttagacactgaaattaaagattctgcttttgaaagacttaagaagaaattaaaaatctaaatttaatgctttgatgatatttactagatctgtagtattaaacttagttcgtttgtactttagatctaaatttaacactaagtgtaaacttctaagcttgataaatgtataaaatatttaaaaaaataattttattttaagtttattattataaaattatataaaattaaaaggagcaaaaatgaaagatttaacaacaaagtttattaatattatgttgaataacagctacgatgaagctctacacaacaaaatacaagaaaaattatttagttccgatttacaatgttcaaattgtgacacaggttttgaatcatttagacttgaactcaattgttcaattgatgaactcaaatcaaaattattaggttgtggatatcttgacgacactgacgaggatttgtgggacttttttaagttaaaagattctgatggtgattcacaatgggataattacgtttacagtttaccttcatctataagagagttaagcagcactacatttagaattaaagacggaaatactattgttttctacgatatggtttggggtaacgaacaaacttgccatttgacttttaagaactagtaaatattacactttagtgttaacgaacttaaacgacactaaagtgtaaacttctaagtttgctagtactattgaatatcagtatccttgaatcttgataaaatcaattttgtaatataaaattgtgaactttctattttatctataaacccagttaaaatatactcaccagaaattttagtgtctccttcttgtgtttcattagtattttcgttagatttaaataatactttgtattttgtgaatatttctggtgccttaacaactccaggtactactaattctaacttagaataatctaaaaacgatttataagtatcagcaaaaatattatcatcgtacaaatattcttgagcttgatattcaaaaccatcgtgatcttgagattctactggaacatcgaaatctaaatcttcaagattaattttcataactttcattgttttagtagctttatcaaatgcgattatttgtgatttcggtaatttcagagcttggtttgtgtttataatcttcctagataaaatatcataagggttgttaggatcttttttaaaatcatcatattgtatattttgaagttttaaattatttggtttgagttctttataaggtttcataataattttttgtttatcttgaaataatatcaatccttgtctatcacattcttcaaatatgaaatccaatacagattttcgtgaagttaaaacgaagttttcaattacgatgttgctagataattccaatttaacagaatctggattatattttaattttggtttaatataagtatcatatatatctttaaaaatatctgaaagttttttatttttatatgttttagctatatataatttactaaacaaataagatattaaatcttgaccttgtattgtaaaactggatttatcagttgtttgagttttattatttttaacaacttgaaactctcttctatagtaaccttcactagcatctaatataaaaggaataaatcgcatatcgccggattgatctaaatagtattgtaaatccgtggtaccattgactgtaaaataagacaagatgataaaaccattgaatgagatttcaccagattttgtttctccagtttttaattcaagtgatttacttgatttattattaagaatagataaagtaaaatctttgacatcacaagcgtgagaaaatagactttgagttcccggattcattagaacctaccaaatacatcatcagaatttgtataaaaatcttttgtttcttgttgttgtttatctttaatagaactcaattcatcgaaatatttttcaagctcgttatgcatatctgtattaggtgtttgcttgtctaataattcgtcagatctaataacaaaatcactttcaagttcatcagattttttaaatacataagttttacatttaaatttataaacatttttatattgattataaagaaatacgttatttaacccaaaacaatctaacgtaatttcggtaatttcaagaatctttccacttggaacgattattaaagatcctattaaatcgtgaattctggaatctggtaaagttacatcgtattcattcttagaattcattgaagattgaactaaattaaatgtggaaattttagaaacatataaacctatacttgtatctaatgggacaccaaattgtgtttgcaatctttcatattggtcaaactcttctgaattttctggcataccaaatatttcaaaacaagctctattgtccgctttaaaatgactaaaatcaccaaatgttaaatccctgttaatttttttggtaatgattaatttaagtggagcaccataaagtctaatgagttcttcggtaacagatccactcagatcatattcattagtatgctggttaaaattcaattttaaagcctcatttttgatatatttattttaagtaatcaaaataaataaaatcaaaaggttcaagatggacagcacagataattctaaagttacaagtattgaaacaaatcaatatataaaaaatccaaaatatactacaaaggaagctattgataaatttgttcacctattgatcctgggtagatacactgaaaaagatttatcagatgctttgaactattgcttaatacgtagtacagaaagttttgacagcatagattctataaaaaaagctatagaagaacttaagaaagattcagaagcttttaaaatattcatagataatacaaataaacttttagatgctatccaagatattaataaagaacaaactgctgaaattgataaaattaatgaattcttaaaaacagcagtaactttagatactgaacagactattgtaggaactaaaacatttaataagatttatgttccaaatcctacagaatctaaacaagctgctaacgctcagtatgttatagattatgttaaagatcaattaagtaaaactattggagatttaaataatttaaaaactgaatctaaagatttaattattaatgctattaacgaagttcttgacaatttaaatgcttataaagaaactataaatgaaactgctattaatcaaatgattgatactaagttaaatccattaatagaaagaatcacgacaattgaatctactgcggattacaccaaagaattagcagaagctaataagcaagctattgaagatttaaatacaaaagtagttgataatactagtgatataacggatatcaatagaagacttgaagaagctgttttctatagtaaaattgatgatactcgcaaaactatacaacttaaaaattatgatagcatttccggtgttagtactactggtgaaggtatcaatattgctatggtttctaaatgggataaagtagatttaggatctacccaaattcctattaacttaaatgggtcagaaaccagaccaacttataacgattctaaagaaatagctttaatggatgatgttaagttgaaagcagatgctagcaatgtttataataaatctgaaattgatactaaattagatactaaagcagattcaaatacagtttataataaagaagattctgacgctagatttgttagtttaactgagaatcaaaacattcaaggcaataaagttatagaaggtatttgggaatttaatggaatattgtctaaaccaaaacaattagcaactaccgaatatgtggtaaattatgctaaaacatatgctaaccaaaaagtcggagatttggcaagtcttaaaacagaagctaaagatacagcagtgtctgctatcaacgaattatttgataagattgaatctggtaatacagatgagccagttgatacttatacaaaacaagaaatagatgctaaattagaaactaaagcagatgttgacaatgtttataataaatctgaaattgattcaaaacttgatcttaaagcagacgctggcagtgtctataacaaatcagagattgatcataaatttgaaaacataactattgatgatattaattatgcgaagttaggtgaggaaaatacttttattcaagaacaaaacataaaacaagtaaatataagtgatgaacctacactagatacccatgtaattactttaaaatattttaaagataattctagtggtggtatttctccagctgattatgtaaccaagactgaatttacaagtggtattaataacaaagctgataaaaatcatacacacgttgtagctgatataacagatttaaatttagatagacttgctacaaaagaagaaacatatactaaacaagaaatagataataaaatagatgcaatagtaccacctgaaattgacttaactcattatgcaaagaaagatgcagctaatatttttacaaaagctaatacttttacagaagcaccttcggtagaagtagatgcaacactagataatcacgttattagaaaaaaacaatttgacaatagcataaaagaaataaatgataaagttaaatctgttgttggtgatttaaattcattaaataatgaagtttctaaagataatttagttaatgctataaatagtgtggatgataagttcaaaacaacggctaaaactaatgaatcaaatacatttacaggggatcaaacttatttagacaatattttactagaatctgttccttctgaaagaaatcacgcagttaatttgggatatattttagacaatcctggaggtataaaactccctgatcatacagcacttacacagaattctgttacagaaataacttttggatatgcaaatccagtatcatattctgcacaaacattaaaaaatgtattcttaaaagacattataggtaatgattataaagctattatggcagataataagtcttttacagtaagcccttcagaagaaacagttgtaatattatctagagtagattatttaaacaatatagattttaagtttgatattactaaaacttcagagcaacttaaagagtatgagcttaaagaaggtgaagtaagagttatattatcttatgatactgtttctgtttatagtaacggttacggatatggagctatgttttctagaaacgctaataaaaaagacggagatttaatatatgattattattttggaagtcaaaatgatataacaaataatagaaaagtatctataaaaatagataaacttggcattaatactccggatattgtaagtatatctatgaccacaaatggttcagaaaaacttacagttaaaactgatgaactaaatcctatagaaaacatttatgattctgcagatatgacttatattcatactcctgtaagcaaaactgtaggagatgttctgtatagtaatatatctcaagcaatcaaatcaatacatttattagaaaataatatatgttctttaaagcctgcagatatggaattacaacttgtaagacttaaagaatttaaacaaacaataaataatatattgcaatctatgtttgatgagagccctgtaactctaaaaaatggagattacatagatgtttcatttagtggtagtgcaagctatggaacaggatattgtgggtatgttaatataaaagatactataagagatattacatataaagcttataaagtatcttcaaatgcttttaatacaactagtggaactaaagttattgcagttctcacttctgataatagtaaaacaaatgtaacttattctgatagtgtatcaacattagaatcttatgaagtagcagaaaatgagatattattagaaatatcattttcaactgctaagcaatattctgctgaatacgggtatggagctatgttagaatattggggttctgtatctgatttatgttatgattattatatgggttcaaacctagatatgaactgtccatttaaaataacactactaaagataggaagctctgttaaagcagatactatacaaataggagcaccttcgtattgggctagttcgttagtaatacacttaagaaaaaatacaggaaaaattatagactttctagtttcaactggtagaaaagtaataggtagagacggaactgagagtggttctgtatatgatatagtagataaagctttaaaacctttaaaagtattaacatctgatgctcatcaagaaataaatggtgtaactagatttaataacaaagcttatttaaacatagatagtaataaaattacagatgataagcagattataaataaagaatatcttgatggaagtataaagactacaactaaagatatcataaatgaaactcctataataccttttacaaatattgaaggtaagaatactaaaaatataagacttaaaatatatgcaaaaactgatagctctagttactccactggagatacagttgtagtaagtaatcttaaagttaagcttaaaggagatactgagtttcttaaacctgttggagttgaagttactgacagaagtaatcaaaaagtaggattaaacttaacaggagatgacactgtatataaagatgatattgctattacagaaacaaaaccttcaggatttaatatctcaagtattgatttatctagtggtagtaatgctgtagctacagtaaaaacaaatggtgtatacgattatagtggagtatatgagatttgtaatcctttcagagagtataataaaaaatattgcgtatttttaagttctgatggattaaaaaatccttactatcaagtaactttagaaagctctaaagaagtagaaaatatacaattacaattatatggaacaagtgctaccaatcctttattatactctaaagaatgtataatagaaatatacactgatgatacacttataaggtcgtttaatataaaaaataaaaacgataatacaaataaacctattaatattaaactagattttaaagatggagtttctttaattcctatagaagaggctgtatataatttaaaaaatattatagataataactcatctattttatctggaaatggaaaaccttcattttcactaaaccctaataaaataggctctctatactctgatacaacaaataaagctgtatatatgtgtatagacaatacttttggtgctaataaatgggtgaatatagtaacaggtgatgaaattaaaccaaaccttagaaaaatagaaatcacttgtaatgtaaacttaagaagtggatattatggcggttgtatgagcggtgttaaaataggatttgataacgggtatgcttctacaaaacaaatagttaaaggattaaataatggtcagatattatggtcattagacggtttaggtaatctagctagttattctgaagtaggttctttatctcctagtggtaatgatatcaaaggtgatgttactactactggaatatataacgacccttcatatcattgtgttactaatatattcaaagagtatcttggaaatgctgaccagtgttcattatggtctgacgctagcactaaacaattaaaaataacattaatatctgaaaaagtccctaataaaattacttatgtaggtaacggacattatggtcagacttctgtatctgatgtaaaagctatatggtattatgtaaatgatgacggtatgaaagtagaagagtctgtagataatgaacttgaagttagtgttaatagttcagaaacaaacgatagttcttatatatatgcgttcaatataaattagatatgtaaggctgtattaatgatagtgccaactaaagactttttaaaagatattatttggaaacatcattattattttttgattcattttattaaagaaaacagagatatttatattgtctttataattataaataaagttcgataaatataattgtaattttatatttataggattgtacaatgatagaaccaaaaagagagcctacacaagaattttttgtatgtttattaaaagaacctagatgggctagtattgaagccgaggattcttaatggctttctttcattttaataccctaagaaaatatactggagctttgatacatttattttctaatttagaaatacaaactattcaaagtaatggtaaaccattgtattctatagttcctattcagtatgctaacagggaaagatttgatatttatagtcaattatcttataatcaaatgtttaatggtaatactcaagttttacccagaggtatacttttgtttactggtatgaatgctaatatcaacagagcaaaaaataaatttgctaagatatatagaaaatcacaaataattaaaggtgaaactaaaaaattaaattatcaattcaattcagttccttatgattttacttatcaagtaattatacaatgtcgtggaatgaatgaagctagtatgatattagaacaagtcgctagttattttaatcctagttattgtttaagaattaaagaagtagatttaccagattttggagatacctcttgtatattagaattaaactcgactagtgtagatcaagaatctatggatgaattaagtactaatattgtaacttgcacttttgatttaaccttaagaggtaatatatacccagcaataaaagaacaacatttaatagaattagttcaattgtttatgagtactgatttaccagaatctactgaagctaatccagtagtcacgagagtttattccgaaggttctaaagaaacagaatctggtattcaaacttttataaatcaatacaaagcggttattaaggatatagaattcaaccaagattatttactctgtaaaatagattctgaatgtgagaaacttattaaatttaaatttaattggtgggtcaatggcatcaaacaagacagcgaaattgaaaaattacattatgcaccacgagatggtgatattgtaaaagttcaagcatttactgatattgttgagagtgatatctttgaaaaagaattctattctgatgaaccaagatatgatttaattattaatgatttaattagggatgaaaaattcttagaatgtgattttactgacagtaatccatcaaatattaaatatacatttgaatggtttataaacggtgaaaaattagatttaacacaacgaattattaaatataaatctaaagttagctttgattgtgaatgtattattagaagctctgatggtagagaagctaaatattttaaacattttcataataatgaaataatttttaaagattcttttaaaataaaagattctatgaaactcgagctcaaaacagagttgaaatctatagccattggctacaacgattcaatgggtttcgatactaataatgattcaaatgataattaaggtttagaatgggtactttttcattttcattatcggatataaagaaacaattaggtcctggtttaggagttagatcaaatgcttacttactagaagttgctgtagtaggtgctgtttctaaaaaattagcagttctttgccaaagcacagcattacctgaaagaaatattggaaccactgacatattctacaaaggtagaaaatataaaatgcgtggtgaaacagacttaagtggtacttacactattaatataactgatgattctgaaatgaaacttagaagaatgttcgatagctggatgagagaagtagataataccacacctaaagggactaatgctttagcaggcttatttggtggtgctatgggtgacttaatggaggtagctaatggaactttgaaagcggttaatgaaattaaatctgcttgggagtttgatggtggtgtttcttggcttaaaaatatgattatgggcaagccactaccagcaaattatcaaacaaccgtaaacatttggcaattaaccaaagtcaaagaaaaactatatgggtatgctttgactaatgcttttcctattgaagtaggtgcagtagaagtttctgatgaaaatgaaaatcagttatctatgtttagtgtaacttttgcatattcagattttgaacctattgaagataaaggtgtaattggacaaatagttgatactgtaataggccaagaaggtcaagaaattgtacaaggtgttgaaaatctattggattaaatattctttagatttaaaaatttttaagttttaatattatataatatgtgaaaaatttaaatttaaaagatttaacactgtagtgtaaattattaaaaataacactgtagtgttaattattgaatatactaaaactgctaaaatcactaaaaatttaagaatattttaaggattaatacattataataacattgtaaaggagatcaaatggatatttcaattaaagaaatacaaccaagtcctgaacaattgaagcaatacaaagctcaaagaataacacaaagaaaacgcatcgtaaaaggtgggtttgagcacgttctcgtaacttcggattctgacttagatggtattcatataggcgctttattgatggggtttatagaaagatttaggccggaatacaaaggtagatttggtcggtttaacacgcctgttaaaatggttttaaaaggcgaaactcctattaaatggacttatgacatcacagaagagttaccggttaaatccggtgaaaatgcgaagtatttcaaaggtttaggatcttggcaaaaagaattattagattttgttattaagaaggatggattagaaaatatgatcgatgtctatgatttcgataatattaatataattaatgacttcttaggctctgaagagagtgataaaagaaagaattatattagaaatcattcttttagtatagcaagtctgtaattatttgattgttttacattttggtgatttaatttgattctaagttttaaactttagtttataatttaaagtttataatataatagaatcaatattaaattaagttttttaattttttataattggttttaatataatagattaaaactgattaatttttttaaaggatatttatggacattaattttgattggaattcaatgaatgcgggagctaacccattcgaatctaaaagttatgaaagtgatactcgtttttataccctagcaaaagatgaaaatggtaatggtgcagctttaattagattcttacctagtgaagttcacgaaaatggctcaatgagtaccattatgaaagtattcaaatacaatgttagatctaaaacttctaaaagatttatagctgagtggagtccaagtacaattggtttacctgacccaattcaagaaaagtgggcgtctctttggaatgctggcaaacaagatgaagcaagaagatatgcaaggtctacaagatacattgctaatattaaagttattaaagatccaaaaaacccagcaaatgaaggtaaaattttcttacttgatatgtcacaaacacttggtgagaaaattaaatctattttaacaccaaatgaacaagaattagcactaggtgctgttgctaaaaatctttttgatcctataaaaggatttaactttaaattgattgcaactaaaggtgccaatgggtttatagaatattcaaaaagtgatgctgaagcaaatccaagtgcaatttataatagtgtagaagaagcagtagcagatattaaaaataatgcttataaattgtcagattggcaaaaaccagaaagctacaaatcttacgaagcattaaaagaattgctagatggtttggatacaccagtagaatctaacaatttagattcaatggttcaagcagcgccagtaacaagttttgctgaaccggaagcaccaacagtacgcattaaaacagcaccagtacgcattaaaacagcaccagatgcaccagaagctaaagcgccaagtgctaaccaagcagataatcttgatgatttgatggctgacttattaaagtaacttatagaagctctgatgggcttcttctcaaggaagaattatgatcgatatcgaaaactttaaaccacttcaagattttgttctaataaaaacagaacctgttaaatttgaaactgaatctggcatcattacaaaaatacaaaaatcaaatctttatgaccgaccaaccaaaggtgttgtaattaaacaagggcctaaatgtcaatatgatttggttaataaaacagttcaatgggatatcacaaaaggtcaagatattgaagaaaattatattcttttgactgaggattcaatactaggaattatagagtaaatgagagctcagctttttgaattgcaccaagaactcaatatcaaggataatataatcttgttacattgtgatatgtttccttatgcaggaaagaacatcataaatttacgtatacaagaacaaactatgattaatgtagcagctggtattgcatatactggcaaaccagttataatctatggagttcttggatttgtttttcttaaagctctggagcaaattaagtttagtatattagattttagtgcgaaatatgctccaataattatgtataatgctggatatactgggtgttatgaaatgtatggcaaaggccacattttcaaagaagaattagatctttgtaaagtttataatattgaatatttcaaacctaataaagaaaattttaaaggtttgataaaagattgtttaaaaacaaatggtttcaaatatattttgatatattaaatcattaagcttttaagctttagcttatagttattaaacattttaagctttagctttattttttaaaacttttatagctttaaattaaaaataaataatttaaaactcaggaattttaatgaaagaattagtagcatcgtggctagcacgcagatttacagataatgactttagaagtgttctcaaaaatgtcgttctaaaagatggtataggtaaaggcaccaaacgcccagataatgctaccaattttgtgaatacaaaaactggtgaattaatagaacctactaaaattcgtgaatttatcaaagctatgaatgtggaggttcaaactcgcaataatttctataaaggtaataccgattatcaaaatgtttcacaagttccacaaaatggtgttttgcagggttctgtagttttaagcacaccttatactgctatgcaggttgttttagaatcatttgtaggtgatggaattataaattttggaaccgcagtccaagcagattttaatcaagttaaattaaatcaaaaatctttatttttagcacacggtaattattttgcaagattagaatttacagcaagtgcgattgctaatatttctggtggtgtaagattaacttataatcagtctcaactttggtatgatcaaggtagatcagaagttaatattaattatgatgctttaacaaaaatattagctcttgaagattttactgacgtagaaattggtatagcagattttagttctaagaaaattaaatggtttaataacgttaaacttaaagcaagtacattaaaattcacagtttctcaaaatacagaaaacgctaataaaacagttcaaaaacgtatagtttctgggtatttagattttacaattgatcaaactattgaagatacaatatctgagaaattaaaaggtgctttgatcacagctgctagattcaataaattcaaacaattattaaataaagctgaagttgcttgtttatgtgattgtaattattgtacttgtgattgtaattattgtacttgtgattgtaattattgtacttgtaattgcaattattgtacttgtgattgtaattattgtacttgtgattgtaattattgtacttgtaataataataaagaatacactgatagggttaattattggcatggtgttgtttgtacttgtaatgcgaatattacttgccaaactcaaggtcctggatatacaccagtttatgaaaacaaatatatgactgagtgttcttgccaaggggatagaagtgttccgcaatacaaccaatacggtcaaatatatggttatgcgtgtagatgtaatgctaactggattaattctgttagacaacacgctaccgtaactcaagtatgttcttgtaacgttgataaacaatggactaaaaatattacaggtaaaccaatttgggataaaaaatctacaggtcaaatcgataatattgtcaacaacaatacttcaaattcacaaacaagtactactgtaagagtttgtgtttgtgatacaaacgtcacaatagctgcacaatgtgctacaaatagaacaatggcttatgttgatgggtcaactggaagtcaaggcggttacagatgtgtttgcgatatcaacacaaatagacaaattgcttgttctgctaatagagaatataaatatgtcactgactatactcaatttcaaaacaaacaatacaattaaaactcaattaacatataatcagcttgaagttcttaaaaagagcttcaatgctttttaaaaatttaagatcagagatttaaaactaaagtttaaattttaaaatattaaagcatttttatataaaattatacaaatagatataattttatatcaaatattatatattctggacttaaaagtatattaaactaaataaatatagaaattattttagaattttcaaaaattgaaagttttgaaatttaaatataataaaacgagaaataaagaaactaccaatttctttatttctctaattttaaacataggattgatatgtctaaaactaaaagtatttataatgaagagatacaaaatattataacaatcaagctagactataagtcttctgatacagaaagaatacttgattgtatcaaaaactacaactctctttttagatcaacatattcattttatcagcaagttcctgacttaaaacaagcagaaacaacaagacttcaatctagattgaataatatttttcttgataagtggttttttaactcagctgtttttgatgttaaaagttttaagaacaagaaaaagaaagatgaaaaagttatatttggtggtaaaaagaatttctttgatagattaaaaggaaaaatttcaagagaagaataccaactaaaaagactgcttcctctatatagtgtaggtgaagcatctaagaatggaaatagaaaatcccaaatagaagatgaaaatacaataatttttaaagtctcaagaaaagaacatatcactctaaaattaaatggaacttctaagagatatagagattatttgaatcagctgattactttacaaataaacaaatctataccgataacctacaagctagataccaaatatgtttatatcagcttcgacttgaataaactcaaacacaatttaaaagtacaagataagattaaagacagagtatttggtattgatctaaatcccaactacattggatattcagtagtagattggaaaaacgatggatcttataaaatcataaaaacgggttctatttctttaaaagctctaaatgattatgatgattctttaaaaggacaagggtattctggacaaagtaaagaaagaaaatacatttcaaataaaagaaatcacgaaatcatacaaatagtccatcagctatctaagttagcaaatcattttgggtgtgagatttttagcttagaataccttaatacgaagcaaggagataaagaaaaaggaactaagttcaacaaactctgtaataatcagtggtgtagaagtcttttagtttcacaaataaagaaaatgaattgtctatacaagattagaactctagaggttcaacctcaatatagttcatttattggaaatcttgtatatagagttcatcagcttcctgattatgttctagcaagtatagaaataggaagaaggggatatgaattctaccatcaatatatcttaaaagataaaaagatggagaagaatatcatctttggaaactatgaaaaagataaaaatctttattatctatcattggaagaaatcggtattaaagagtcttttaatagttttatggagatgtattcttttgtaaaaaattctaaattgagatatagagtttctctagatgatatagattcatctagagttttcaggaaactttttataaaatcttatacggaattttataattttttataagttttatatgaagtttatatctttttaagtcaaaatatattataattattttatcaaagctgtatataaaggagatataatgaattatttagaacttaaaaatatggcggagaatttaaaagattctaattataggtcaacaaaattaaacgattttaaattctatacttatatattgtcagattataaaaacttcaaagaaaataatacttttttcataagaggtttaatgatagattctaaatctatattaaacaaagatactttagcacctggtatatcgataccaataccaaaattctttaatattaatgaaaatgaagattggatattaccagattctacaaatcttgaagatttcactatagtgacaaaatacgatggttctttaatgataccttatgaatatgatggtataaaatttagaactaaaatgtctattgacaacgatcaaactaaattagctaataagtatatcaaaaataatccagatatattagatctaataaaaaataatccaggtacccagtactttttcgagttgatatcacctttaaatagaatagtggtagactataataaaactgaattaaaattaatagctgaattaaatcttagaacattagaatttaaaattcacgaaactaacgagtttaattttaaagatttaaatattaggactctaaaagatcttaaagattatataaacaccatatctaattacgaaggtgttatattgcagcataaagtaactaaaaaagtctacaagttaaaaacacaagaatatttagacttacataatactgtaactaatttagatttaaaagtgatatacaaaatgatattagaagaaactatagatgatgtgttaccaaaattatcgccagaagctgtggcttatgttgattctgtatctaattcagtaaaagttaagttaaatgaaatattagattctatagattctaattatattaaagctaaagatcttgaagctccagctttatatataaaagatttgaatatagatcctatagccaaagattgtttatttaaattatgtagaaataaacttaatttagacaacgtcttagatcaagttaaaaaatctatgttaaaatataacaaattgcgagatattaaggtttttttaaagctataaattatataatattaaaatcaagtcttaaatcaatctttaaaaggtttttcttaaatgaattcatttatatattatattgcagtttacggcgggataagtgcgattttgagtgtttttgcagtatatatttctcataagttttaaaggtataaaatgaacacaattaaactaacttggaatgatgttcaccaagctttgcataatcttacaaatgaagtagatcttaaaaattttgattgtataataactcccaatagaggcggattaataataactagtatgttgcaatacacccagggtgttaaattacctgtttatgtaattaataattctgatgtaatcaatattcaaaattataaaaaagttttatttttagatgatattaacgatacaagtaaaacaatatttaaaatccaaaaagttttcaatggtctcataacatttaaaacattatttgaaagatataatagtccatttaaaactgagactatcaatatcatcttgaatgatgtttggttaatttttccttgggatattaacccagaagttttaaatctaagaaagtgagtaattaatatgctagtaccaaaaataatcagaaattcaaaagtttatagatttataaaaaatatcattaaattcagaaatgaattaataatttggagaccttatgagccaatatttgatttaaaattgatttataaaatgcttaaaatcaaaagagaatattggcttgatgattgtggtggggcagcttatgaaggtatggaaaaagaattagatactttaaatagactcttaaatgagttagacttagtatttaaatattcatatgatggtgatggccaaactgctatgatccattttgacatttttatggaaatatataagaaaaatgcttttaaattttggtgttgatatgacaatgcgtgttagaatctaaaaatactaaaatatttaaattgcatttaatcataaatactatataatatatctaaaggagaattatggaatatttaccaaaatctcaaggacctaaaaaactttataattttgatattaatatgactcaagcgtgtacactaagatgtacatactgtattcaagattttaataaacaaaaatttgaaaaattatcaccagaacttactaaaaaaatgatagaaaagtttgattttctattgaattcagtagaattcaataaacattatgatggtattagaatttcattctggggtggggaacccacaactaacctagaaggtgttaaagagtttgtagaatactatagacacaacccaaaagtttgtttctttatgtattcaaatggttataaatacaaccacgtttttgattacttagaaacatttaagtatatgccaaatgtcgggtcagaaccaaaattcttgactcaaatatcttatgatggaatggcaagtcacgattcagatagacttaatttacaaggtaagggctcagcacaacaagttaaagaaactgtttttgaactagcaaaaagaaatataccttttattgtacatcctacgattgcagctaagaatttcgataagattgctattaattatttcgaatttaaaagaatgtccgatgtcttaggtattgaacttaattataaccctacgatagactatatgtctaaatatgattttacaaaagaacaattagaagcattgacaaatactttaaaagaagaattcttaaaaatacgtgatgctgaagttgagttctttaaaagaaaaggatattttaattttggttggatgaatccaaatagaagtatttgtacagcaggtgatggctattctggtattgaattggatggtaaaatgtatgcttgtcacggtgtttttagtgaagaatataaaccaaataatgttttaaatgatattaattttgagaatgtaaaatttactgaaacattgattaagagctcacaagatcatagaaaaatattaaatgaaaatatgcccaaagcttgccaagaatgttttacacattattgtttaaaatgtaattctacaaaatttggtatttctaataaagaaacctacgcagaaagatggactgattatagttgccaacctggtttatgttatatgtttaaattcataggtaaatatagaatagctttgatgaaatatattcaagcttcttagaattctaaaatagttctaaattgacactatagtgttctattttagaactatactgacatataccagaatccaaaaataaatatacaaaaagtaggatttattttgagtataataaaatcaactgctaggggtattagaggtacttatagagcaggcaaaaatgcagttaatagtgttaattctgcttataatagtgctgttagtggtataaacaaagtaaattctgctttagatcctatgaatacagttagaagtgctactcaaagactcaataactggatggattcggattctaaagtatctaagacaactcaaaaaaataatgattcaattgttagtgaattaaacaacgtagccaatgaagttgttagtgcagccaaagctttagatcctatgaatgctagaaaattaacagaaatttcagaatctcttaaaaatatttcaaaacaaatctcggatattaaaaaaggattaatagataatcaagatacagaaataagacaccaaggttttgataaaaacgttcaaaatgtttcagaatctaaagtaaatgtacctcagaataaaagtttttttgataaacttttaggttggttaggaggtttattaggtatatcggcaggtgctttattaccattattgggatcattaggaagttttttaacaaagcctttagatttcattttagatctattaaaaggtggtattaataaattatggactttatttgagccattattaggccctattatagaccctttaaaaaatggatttgaattcttaaaaaataaatggaactcattagtagattttattaataaaaaaattaatattggtgataaatggaaaatctcagataatgataatccaaaaaatccaaaatcaccaaaagtaagttcatctaatccagctaaagaacaatcttggatgtctaagaaatgggattcttttaaaggtgctatgcaaaatggatatgattgggcttcacaaaaagtagatgatttaaaatcatatgctagtaagaaatatcaagatattaaaaattctaaagtaggtaaaattatatctgcaggatatgataaattaaaagcagcacaaaaatatattgtagaaaaagctattgaaggatttgatgctgttaaaaatatggtaagctctgcttgggattcagcagttaaagcagcacaaaaaggctttaatatgcttaaaaagtttgctttagctcctatggagaaatttgttagttcagtaggtaagaaactatttggaagttctaagttattttcagttctacctagtatacttggaaatcttgaaaaaataggagcaagattagctgctagtggtgctaaaatagcttcaaaagctttaccaggtgttgggtttgctgtaggtatataccaagcttgggatttctttactcgtggtagatgggtattgggttcaatagcagcacttagtgcttgtatttcattattaccaggtattggtgggatcatatctatgtgtttagacttaggtttatttgctactgatattataacaagtccagatgatgtagataatcttaataaagaacaaaatgatttagtaaatacagcaaataaaatggttcaaaataatgatactggaggtattttagaaccaagtcaagtagaaaaagataaagcacaatctggagttcaagattcaagttctaattcaagttcaagtaataaaggattaaatgctaaagtacttgatggtaaatctgctaacgattttgctgcttcgtatacaccacataaagtggattctaacggaaccgttatagctgctaaaacaggttctatatataaaggtttgacctgggtagaatctgaaaaatatgatgctgaaaagcaagcttattttaagaaacgtgaagaaaaagaagcacaattagatgcgctttttgaacaaggtcaaaaagctatgaattctggagatactgaaacctttaataaattagttacacaaagaaataaattatctgatgaattatctaaaatgagcttagattctatcgattctaaatatcaagctattggacaagcaagaattaaaaaattgcaaagccaaggagctaatgcagatttatcggtatttagaactaatggagattcaagtactagttcagggggaactgatacaaaaccagattctacaaatgctagtgctagtgtagcttcgcaagcttctggttcaatctctccggcgcaagttcaaggagctcaatccacagaagcccaaggctcgagttcaggaggatctccaggagcaagagctgcagcagaattcagtaaaaaatataacttaggaactagagcaacaggcgcttgcgccaagtatgttagatcttatttgatggcagcaggatatccattatctggttggccagtagcagctgcagattatataaatttcttacctaaatatggttttacaccagttcaaggtagagcttcacaaataagcccagaagtaggtgacatttcaataacccagagatttggaaatcacaaatatgggcatattgctatttggaatggttctaattgggtttcagattttaaacaaaactcagtttcaatttatagagacgtaaatgctttcggtgggccggatgctaatataactattctaagagatacttcaggtcaaaatccatctcaagaacttgtaaatcaacaattatccaatatgaatagttcttttaaagttgcattagggggtggaggtgctaaaggtgctgtttatagtttggattctggagtttcaaatgttgttacaaatacagcaggcgctgcagctagtgttataagttctggtgtaagtagtatccaatcttttgctaatgctaattctattacaaccagaaaatctttaactcaaatgtatacagaatctggattaagtactagttttgggtcaagttcagccccacaagctgctagcccagctgcaaattcaacaccaaaagaaacaaaagcagatattaagccagcttcaaaaccagtagcgtcagtcccacaagctgctagcccagctgcaaattcaacaccaaaagaaacaaaagcagatattaagccagcttcaaaaccagtagcgtcagctccaaaagcagttcctaaagctgctagctatggtacaccacacagaggtcaatatgatgcagaaacaatggaagacttcaacaacttaggagataactttagtaaatccaaatcaccaatttctttacctggagattcgaaatctaacgttcaaactaacaatgctggctcagtagtaccagtaactcctgtagttaatataaagaataattcatctccaagtgattattcttgggcttctaaaaacagttttaaaattgctagaatgtttgggttagatggcatcagcgattacgaaatacttaatgaaggttcagaatctgactttttacaatcttatggtatgtctaaaagacaagcaattcaatcagcagggttaaacaatacagtacaaaccaaagttgctagtaatgttaaaacaaaagatgtgataccagctgtcaataaaacccaaataaataataccaatatacagactaaaacaaaagaaacttctaataaagatttgactgattcttttgttttgagctaaggttcattaaatgcaaaggattaaattttgggattatttggttctgtcagtagtgttatttcaggtgttgatttaccaaaagctacgaaaactttctcggccaacaatggtgctgaaattctaaaatttaccaaatctttagaatctgataattttaaacacaaacaaataatattgactgtttatgacccaaatgatttctataaaaaagtcaaagatgctattggtcaaaaaatgtcaagcctgatgacagcaggaacttcagcattttctggtgatgggtatgattcttcagatgctagccaaactctaaaagatgctggtcaagacattgtagatatgtcagcagtcaatatattatatacaatacatttaccattaatgaatgcgttccaagaacaaaactctcataattattctgaagatactggtattttaggttctatgtcaaatgctgctaatgaattatcaagtacagctagttctggtataattgaagcttatggtagatttggagattttggtggaaatacagataatatggcatttgctccgcaactaccacaagtagatccattaaaatggcaaaactttaaaggttctaacttaagaacatttcaatttacttttaaaatatctcccagaaacatagatgaagcttctaatatgatgcgaatattttggttattaaaaagaagttcataccctaaaaaagaagctggtggtgtcttattgataccgcctgcaagaataggtgtccaattttcaaacccactgctacataagttgatagctcctggtatttgtgtaatagatggtgtttctatggtttatgaaaacggtgatgatattgctgtgacattagatggagttccaaagaaaatagagtttacattatcattaaaagaattccgtcaaaaataccaggatgattggaattttgaaaatgctagtctataggagttagaatgtatattagtaagcaacttacaaattatttagataattattcgttcagtgaagctaataaaactgaagcagaagtttgtaatgttagagattacaggtctatggattatagcactataacaaaatatattaatgattctaatactattaatgttaaaataaatgcaaatgatttcattgaaagtgtttctaatagattgtataatgatcctaatttatgggatttattaatgcttattaataataaagatgccttgagtgatatgccttatgataatgatagaatagcagatatggctgacgaattgatagccaattattttaataatcctgagaaaccataccaaggtaatgttactgaacaattaataaccgaatacagggaatatttgatagatttattgacacaaaagaattatcaaaatatgattataaaagctttagaccctgcttatttgggtgacttcttaagactttttaagtacaaataatttaataagccaagcattttttatactttttaatattagtttaagctttgctttaagttttaagcatatgctgggatataatactatagtatatactactaaaaaccttagcattttttatactttttaatattagtttaagctttgctttaagttttaagcatatactaggatataatactatagtatatactattaaaaagccaagcattttttatactttttaatattgctttaagttttagacttatactatagtatatacc

SEQ ID NO: 11 - DNA, 2027 bp, Camplyobacter Phage CJLB-13
atgatactatagtatatactactaaaaagccaagcattttttatactttttaatattagtttaagatttaagcatgtactaggatatatagcattgttatatactactaaaaagccaagcattttttaagtaccaataaaactactaaaaatttttaaaaaagttttttatattataatatcatattaaagggtaaaattttttaaaaaatttcaaactctttaatattaaattagaatattaataaatttaaaatttatagttttttattaagttatcgtatttgatagagtcgttttgagatttaatccagtagtaatttaatgcaagctcataaagctcaataaaaatagcgctgtcgtcaaagcttttatcttttttaagttcttttaggtatttccatccgacccatttcttagattttgattttaaaatacctaaaaacacttcttccttagctctctgtttataaagaggtagcttttttaccacctcatatattggttctaaatcttcacaaaatatcattagtttttagtattacctttccaaacttgtgtatatttttgtgaatatctcttcatacgagctttatgttgtcttctatattttttaaggtatttaagcgcttttttgcgttctcttctaccttcaccagtttttctaaatcttgctcttaaaactgctgatcttttccaagctgatctttttctatcacgtcttaattgtttagtatgtgcaatatctactaattgttcacttaaatcacttaaatcattagcttctaaaatcatagcagcttctttaagaacttcagcatcatcaaatgattcatctactggagttgcaccatattgttcataattgttagcttcatactcagaaatttcttcgagaacttctaaaacaagatagccaatatcttcaaaatcttctgctgataaaatttcttctttggaagcaactatatatccattatcgttaagaatacttataattaatgcaatcgtatctggatctaaagaattaattatatcgtcgaattcttcctttgatagtggttcaagctctgaatcatcgccagaatcatcttcatcgattttagaatctttgcgtttaacaatatctgctttagtggtaggtgttgtatctatatcaccagaatcagtttctttgatttcagggtctttataatccagcacttcacagctagaattctcataaactaggtttaataatgtgtctttgaaactcattttaagtccttatttttaattatttttaataattcataattcgtctcagcccaggatttaaacttgatccagttctctgacaaaatcttagcatcttcagcactcaacgaataatattctatgttatttatttttattacagttagattataatcttgtgttataggcggttctttaatatccggtatttttgggtatacaaactcagttctaacagtggtacagcctataaaaataaaaggtattaaggccaataaaaactttttaaacttcataaagattccttatttttggttagatatttgagttttacctatatttcctaaaaataaaggtatacctttagctgaggtaatattggtgtctactttagatatttgaactttacaatccttgactgttacatattttgtttcagttttaataggtttattttcaagttctttaatgttgttaacaagttctcgattcttttggtcttgtattttatttaaattaacctggatatttagagaagtttctaaacctttgtttttggcttctaagctcgaaatagttgtttgtaattgagcattatcatatttaagccatcctatatatcctagcatagcaacaataatgaaagcaatagctacatatttttgcatagttcctcttttagtttatttatatactaatacagctatcataattaaatcttaaactaatattaaaaagtataaaaaatgcttggctttttagtagtatataacaatgctatatatcctagca

SEQ ID NO: 12 - DNA, 1017 bp, Camplyobacter Phage CJLB-13
agcaatattaaaaagtataaaaaatgcttgagtttttacagtttatactatagtattaaagcttaaagcaatattaaaaagtataaaaaatgcttgggttttttttaattttcaccataatatatgtaatttaagtttactttaagtttaaatatgcaagactaaagcttaataaatacttaaaaatgaagttcaaacaaggcatttatataccaaaaaacccagagaaatatatacatagttatacaaaaatgaatgaacacactgaatatcctgtttataggagttcttgggagcttagtttcttcaaattttgtgattattcaccctctattactaaatggtcttctgagccagtcggtataaagtactttaatcccgtcaaaaaacgacaatccacatattatcccgatgctatgattattcgtaacgatataacatttttaatagagattaagcctaaatctcaattaccaggttctaactcaaaatccagttatgataaactttcagcggcagttaacgaagccaagtataatgccgcaaaatcttattgtgaagcaaacaatatgcaattcataatcttaagtgattctttctttaaatcttgattttaaagttttaagctttttttggttttaaaacttaagtttagtattcaaaaatttttgacctttttaatataatatattataatatattataatataaaaacttttttcaaaaattttagtagttttacagttgtttagaatttgttttaaaatctaaactaaagtttcagtttaaaacttaaagcaatattaaaaagtataaaaaatgcttggctttttagtagtatatactatagtataatgcttaaagcttaaagcaatattaaaaagtataaaaaatgcttggctttttagtagtatatactatagtatatgcttaaagcttaaagcaatattaaaaagtataaaaaatgcttggctttttagtagtatatactatagtataatgcttaaatcttaaact

SEQ ID NO: 13 - DNA, 157531 bp, Camplyobacter Phage CJLB-14
tcagcttcaaatttcaaaccataatcagttaattttaatatataatataataaaacaaaatcataaaaagatttataatgttaagcaaagaagaaataaaatattttcaaacacataaaaatgaaataacagacgaactcttagaaacaattagagctcaaggaaaactaggaaaagcacaagccttagaaatcttagatttacctaaagactctgacaactattacttagatgcgtataatacgagaattagttataatgggtctcgtggtcttaaaaaagcttacacaaaattaaacttaagtccgatacatatcagcgagcttgaaaaatgtgcgaatgatccactttatttcttaagaaattatgttcgaatgactacaccaaaaggttttgatttcgtagattctaggccataccaggatgaatttatacaattgctgagcgatgattctatcgaaaacgtgatatcaatgcagcctcgtcaaagctcaaagtcaaatactaaaataaatgtataataaaagattatatcatttataaaatatgatcattgttatgatttaactttagagcattatcacctttattacaccaatggtgttttaagtcataattcatcaaagtcaactacaacaagtgtaaaacttgcacatttatactgttttaagaaagatcttaccataggtatagttgcttatagtggtaattctgcccgagagttcttagataaaacaaagaaaatattaataggtttaccaatatggatgcagccaggaacagttacttggaataaaggttcaatagaatgtgaaaataatatacgtattttaacggatgtcccaagtcaagattctttcaggggttacagttgtaatataatcgttgttgatgaatgtgcatatttagatccagcctcttggatagatttcactgatggtgttttaccatcacaagctggcttagctttcaaaaaattagttattttatctacacctaaaggtaagaatcatttttacgatatttggcagggtgctggagatactttagatacttctgttaatggatttgtaaaacataaagtagattggagattagtcccaaggtttaaatctgatggtactaagtatgaaccagaagaatttaaacagcaacaaattaaatccagtggtctagtcatttggaattctgcatacgaatgcaaatttgaaggttctgcgatgacattgatacctagtgaaatattagatacttataaaccacaagaaccaatagaagttgataatattaaggattctaaaatactaatatacgaagaaccaatacccggacataaatacgttatgggtgttgacactgctaaagaaggtgctgattttacaggggttcaaatatttgatactacagatttaaatttcagacaagtagcatcagcaaaacttaaaatagattatatgttattaccagagttactcaatgagtatggtttaaggttcaatcaagctttaataattgtagaaaataatgaaggctctggtcaagtggttgctgatattctcaaaagagattatgaatatgagaacttatattatgacgtcaataaacaaaaacaaagattaaaatatcctgggttcagaactacaaaattatcaagggatgttattttacaaactgtatcaacgttagcacaagctaataaattattattagtggacaaagaaactattaaggagtttggagtatttacattaaatgataatggtaagtaccaagcagctgtaggatatcacgatgatttagtaatgtcttgttgtttatgttttggtatttttacaaatgttaagaactttgaagatatgaaagaaattgtagattctttaaaaagttccgaaggaaaaagttttgagtatctaacatttggagcttttgcagatggtttaggtacagagccagattctaacactgataataaggatttgaatcacagtaatttggaatattattaaaattttggattctaaatgaaagaatatattaaatacaacgatagaaaatttactttaacagcttacaaagttaaaactgaaagagatttattattaactgcaagctcagatgatactgtatacagtaaagatctaaatgatttaaacttagacatttacttaagaatcttagaaccttatatagattctaatataaacatttatgatttatatccggaagaaaaattatttttactttatagattaagagcaacttctgtttctgaccaattatctttaaatactaggtgtgattgtggttgtacttttaaatctaacatagacctaggaaaaattggagatctccatagtattgatacaaatacatacccagatttgaaagacgtttatagcccaaatttaaccgacatatacagtgattcttacttagaatctaatattatggattatgattcagaattagatacgtatttagaagctaatactactaaatttaactttattaaagttgttaaatgttataattgtaagaaagatcttgaaatcgatttaacaaacccagaaatatataaaaatatattttcagagaatcctataggtgaattctacaaaagtttgacaagattatcatttctaggtaagtttaccatagatggtattttaaatgatttatatccatttgaaagagaaatctttataagtttaataaatgatgaagtagaagaacaaaataaagcacttaaaaaacaatcttagtctttaagtgcttagtgtgcgctactttgtattgtttttatctaatctatccttaatgctttcattaatttctacagttatttcagattttaagtcattcttgacttcggacttaacttcagactttatagcatccttaacatcattcttaatattttcagcaagtttagctaaatctttatttttttgtttttctttgagttgatcaataataacttctggttttttagaacaaccaattaaactaccattaagatcttgttgtggtgttacataatttcccgtcgataagtataaaacaccgtctacacaaacttgattaattctggaatccgaagttccacgaacttctttgcctgttttatcgctggaataatcagatccacaccctattataaacaaagctaacaaagctataacgaaacattttagattcttcatagaccctcttttaatattatttatgattttatgattttatgatttttgatttaaaactttagttttgaattaagaatgttttaagatattttataatataattactcaaaggagattgaaatgaaagaatttttttataatttaatagcacaaattaaaggacttaaaattcataaaaatgaaaaagatacttggtatttaaaatgggatttacacaccgggtattatattgaaggtttaaatactaaacgtagattatattgtagtggttattctgatagtttaaacaaattaaaatatttgtattgaagctttgtattagtgtgaataataaaacgttaagaaacttttaagatattttacaatataatatcataaaggagatataatgattaagaaactgactgatagagaacatattctaaaaagacctagtatgtatataggtgctatagattctacaaatacagaagattttattatagaatcaggtaaaattaaatacactactttgaattatgtacccggtttaattaaaataatcaatgagattatcgataattcagtagatgctgcaattagatctaaatttaaatctggcttaaatatcagtgttaaaatatctaatgatactgttagcattgaagatgatggaactggtataccagtaataaaatcaggtgaccactatatgccagaactagcttggaatcacgctaaagcaggttctaacttcgatgatgatgctaatcgtgtaacaataggtaccaacggagttggaagttattgtacaaatgtttggagtattaattttaaaggtattacagacgatggtaaaaatagatatatttttaaatctaaaaacaatgctgaaacttatagtgaaaatatagaagcttctaaaaaatcaggaactttagtagaatttaaaccagatttagaaagatttaatcttaaagaaatcgatgaaactcataagaatataatctatcaaagattattaaacttagctatttgttacccagaaattaattttaaatttaattctaaaaaaatagattttaaatcttttaagaattatttaaatatgtttagtccagattttgagttatacgaaaatcaaaatattaaaattggtattattccaaatgaattggatgactttaaacaatttagttttgtcaatggtttaaaaataccagacggtggtgtccatatagatactattatgagcaatgtagttcaaggtataagagacaaattagttaaaaaatataaaagtattaaacctggcgatattaaaaataaattaatgattgtttgttttattaatgaaatgccaaatcttaaatttaattcgcagtctaaagaaaaaattacaaactcagtaaaagaatttaatgatttttctaatatagattataatttcatcaataaaattcttaaaaataaatctattatagatcctattatagacatatataaagttaaagaagctttaaatgcagataaagcccttaagagtgtagaaaaatctaagaagttaaaatcggaaaaatattttagagcaacaaaaagtcaaaaatatctttgtatttgtgaaggtttttccgcttatggtggtatatcacaagttcttggaaatgaacatacgagcttctatgttcttaaaggtaaaccattaaattcctgggatgtcactaatcaaaaatttgcagccaatcgcgaattatctgaattatatcaaatactttctgagaacgcagaatttgaagatctacaagatggtaaattctatgaagtcacaatagatggtaaaacatatattatgaatgcaaatgatacaattgaaattaataatattaaatataatttcgaagatctacaaaaaggattgtaatgagaccagttagaatagcaatttcaggagctcaatgttctggtaaaactacattaattaatttaatgaagaaacatagttattttaagaattttgatttcatagaatcattttctaataaaatagctaaaacaaacaagaaacactcagaaaatacaaacttagcaacacagttgcaaatgttgcattatagtgttaatgctttaaaaaatataaatgcacccactgtgcacgataggtgtattttggatgttatagtatatacaggagccaatgaagacatcgatttaaaattattcacagattctttaataaaatattataaacagttcgattttatttttgttttagattctgaaaatataccattagaatcaaatggtgttagatcaatagatcctgaatttagatctaaaataaacaatatttttaagaaagtagacttagaaaacgtcgttcacttagattctaaattagacccagattctaggatattaaaaataatcgaagctataaaatctaaaactaattaataggagaaataatggatttgaatctttatatacataaaacaaatgaagatgccgtaataccagaaattgcttataatggaacttcagcagcatttgatattacttgcaccgaaacaactgaaattaaaccaggagaatcaaaagttgttccaaatggattaagaatttcaattgatgaaaaagatcctttttatatgaccgttcatttaagaagttctttaggttttaaaaaagatctaattccacatattggtattattgacgctggatatactggagattttggagttaaaattaataatattggtaaagaaactatagttattgaaaaaggttcaagatatgcgcaagttttaattcatagaaaatatagttttaagttcgccgaacttaataattctgaattcaaggattttgaagctaagcaagaaagagggtctaaaggatttggatcaagtggtaaatcttaaaagatttgcatattttaataattcttaataaggatttaagtatgaatacaataaaattttatcatagacaaaaggaatatatagttcaatctcaaaatattaatcaacatacatttaataagaactataataaagttctagcattattaaatgaaaatgaaattaaatctattaatgaatgtgaattaataccagcgggtaaaactgatattttaaaattatctgcaatgggtagtgatgggttaatacaagagtttgaattaagattagaaaacgtttattaataggagatataggtgttagactttgtagatattaagtattttaagttagcagttcctggaccttataaagaaagttctttggatattgctgttaaatgtccaatttgcggagactcaaaatataaaaaatctgttaaaagactacacctatatgaaaaacaaggagttactttagtccattgttttaatggtgattgtgaattaaatactcaaatgagtttaagtaatttcttaaagatttataaaccagaattattattgccgtataaatcagagaattttaaatttaaaattaattcaattgattctagtaccaaatctaacatagaaagtaataatgaaatagagactatgaagtcttgttttgattctagtgctagcaatacaagtattgaaaacattgctagctctactagcattaaaagctccaacaatgggttcaaatatattaacttaacttcagtgttagacactaatacaagtaaacaaatagagtttttaaaatctcgtgggtttaacgatgatactattaactttttagatttctataatggaactaaatcttttaatttaaatggtgtttattatggaatcaaagactatcttgtaattccattttctaaagactctaattattatgggttctatgcaagatctttaactgaaaaaagatttattaattttacattgaatcaaaattatggagtttggaatctatttaatgttgatttaaataaaccagtttttatatttgaagctattctcgatgctttgtcttttagacaaatatacagaactaatcaaataatagctttaaatacttccacaatagcaaagaatgttttagatttaataaagtaccctttcttttgtttagataacgacaaagttggaattgaaaaaatgataaaatataattcgataccagatagtcattttatatgttatccaaatgatttaacacaaaaagattttaatgaaatgcttcaaaataatattaaaatagaacttgtttttaagaaaggcttcggcgctttattacatttaaaatctttattatgattttaattataaataaagctaaaatatattataattaagaaaatattaaaaggagttcaatgacagtagatttaaaacacgatatttgggtagaaaaatatcgtcctcaaaaaattgatgacttaattttaccaaatgtttatttagataaatttagaaaatatattgaaaaaccatcaaacattttattaagttcagtaaacccaggaacaggaaaaacaagcacagcacaagccattataaaagaaggtaattttgaatctttatatattaacgcttcattagaatctggtattgatactatgagaagtaaaatattacaatttgctagtactgaaagctttgatggaaaacctaaaattgttttagcagatgaatttgactactttggccaaaatggtcaagcagctgcaagagcacttatagaagaagttgctgctaattgtagattcatattaacgtgtaattatgtttctaatataatgcctcctatagttaacagatttgaagtatttgattttgatgttgttcacgcttctaataaacaagaacttgttcaaaaagcttttaatttactaaaagaaatcttagataatgaaaaagtttcttatacaaatgaggatcttgttaatattattaagaactattatccaagtataagaggtatggttgcttgtttacaaaaatgtaatttcaataataaattagttcttgacattcaaaaagattctgattttgaaggtttaattaacttaattagatctcgcgatttcgataatttaatgaaagtagtttatggtttaacaaacccagatgctttttatgaatatgcatttaaaaaattagatattcaaaataataataaaccacaagctatcataatactagctaaatatcaataccaaagtgctttctcaagagatagaaacttaaatttagctgcttgtattatggaattagcaccattattgtaaggattatatatgattttatatgatttaagttctttgattcacagagctttacatactagtattaagcaaatgaatccacataaaaaagacggtaaatatattactgaagaattcataagtgggactatttttagaattatagaagaattattagaaaattatagactttatagaggtaaatataatactatggttatttgtatagatgatcatagtgttccatattggagaaaatctttatatccagattataaagctcaaagaaaaactcaaagagaagaatctgaagttaattttaaagaagtttataaacatattaatatactaattagaattctaaatgattatacaccatttaaagctattggtgtcccaggagctgaagctgatgatatcattggtgtattaactaggaagttctgcaaagcagaatctattttaattctgagtcccgataaagactttaaacaattgcataaattaggcgatataaaacaatattcagcaataactaataaatggatcatcaatgatgacccagaaggttgggaaagaatacattgttgtttaggtgatgctgctgataatgtaccgcgtgttgtggatttttctgaatttacacctgagtttaaagcttattatcaaggaactgaattagatttctataagttagatgaaaacttaaaactaggtattattaataattttaatgaagtttatcctgatgttgaagtttataaaaaacaaagatttggtgaagctgctttaaataaaaagattaaagagtttggttctttagacgccttcttagattctaacgaaatatatagacttaattataatcgtaattataagttagttatggatagtgaaatacctattgatattgaattagaaatcttaaagaaatatacagaatctagtacagattttaatatggaaaatcttaataagtatttttcattttataatataactacttgtagtcaatggtttagtcaattatggaatgaaatgagtaaacctatagaaatgacaccttggaatgtggattttagtaagatctaaaatcccttcatatcttaacaaaaacagggtttaaatcaattttaaattaaaggggtaatatgacattcttgactggaggaaatggttatttagccagtttattgggtaaaagatcttaaagattctttgcatttgttataaattatattatagatcggaaataaatatccaaaaaaggctcagcagtgaacgtaagattacgtattattaataatcagcaagtaccagaattaccaagtttcacagattctaaagaagataacttaactacagacgtcaaattagatgtcttaacgcaccaagaagtagatagaaactttgctaatattattacgtggttaaaaactgttagtgataaaataattgagcaatctacagttctaaaacaattagatcccgaaaatatggagaaacttttagcagctgctgaacaaatacaaaccattactgatgatattaaaagcttagaaactaaatacaaccaagttaataatgatttaacaaattataaaacttcaaatgatttagctttatctaagaaattagattctataaaaactataaatggaactgatatcacaggttcaggaaatgctgaaattaatataacaagaactcaattcacaaatcacttaactaatattggcattaatgaaattggtagcatagctatattagattcaaaaacaactttggtttttaataatttatatgcaggatctggtttatctacagacacttatgcatatatgcaaggtacttggaaatgtactggtaaaataagtgatactaaaggcttattcatcagagtatcgtaatcaaaaacttaagcagattttaagcatttatataatataataacaaataaggagatttaatggtattagaatataaccctatcaaattaggtaatagatctattaaagttcgtaattggaaagttaaagatagagaactctataaaagtaaattaaaaaatactagttccacagaagacgaacttaaagcaagatatgaatgttttgttacaaatgttttagaaaacccgacagctttaaataacgacgaattagaatatttgtttttattgttaagaattataaatcttggtgatgatttaaattacagttggtggtgcagaagttgtgaaaaaactactgattctaaaattaaattaagcaaattatttacaacaaaatcaggtaaaatccaagatattgatattggtgatatcaaaattgaactacaagatgttcaaaatatcgaactctataataacaaattaagaacttcagattcaccaagcacagatgatttgattttccatattaaatcaattaatggtgataacacaaaaggcttccaagatattaaggactacttcaatgagttagatattaatataatggataagatttctgaagcatttgaaaaaatgatatttaaaattgaatctagggaacatacagtaacttgttcgcgttgtggtgctagttcaacttttaatttcgatgtaataccagatattatacctccaaaatggttaaaacgttaagaaaggattaaattatgagtatgtatataacatatatagatcaaggtgcttataatatgattgtttccgcacaaagagacaatgcttttttgttaccggggtctagcacattagaagtttttgacagtaaattatttacagcagttttggaagcattagcagataaaaaaacttgtaaattctataaagatattgacgtgttaactttagaaaacttggaaattgacgagagcgctaacttagttaagaattcatatattttccaattaacttctgcaattagtcagatttttacgagaataccacaatatacttattttagattccaatatcttaataatatatttgcttcacaaggttattttataactgatgataatcgtgaagagatgtatattaaaattcttgaaactgataatgataaattaatcgctagtcttgaagaatatcttaagattgtgaatcaattaaatcaatatgaaaaaatgtatcaagaattcttaaatggtttagatgaaatggaaatgacagatgatgaagcaactttagatcaaatcttacaagaagctttaaattattttacgaacgctcaaaagaatttcgtaactatggattataaaggatggttttcaacaattaaagcagattatgaaaatcgccaaaattcagctcagccttcaaatcaggctgtctaaaaataaagatctaagataacttagatctttctcactttaacatttaaatttctaaaattaaatttctaaattcaaaaaactttaagttattttattatataataaaacaaaaggagatataaatgaataaccaaaatgcagaagttttaatgaaagatattttggaagctgaagctaatatcagtaagtttttagattcttggactttaacagtttttgaacaccaggtattagtaagatttttaactaatgagtttatcggtgctaactttaatgatcctgaaactctaaatcatttaggaaatagagctaggttttatattgaagaattcattaaataataagctatatttaacactttagtgttaatttaaatataaaactaaaacaatttcaaaaaactttaagttgttatattatataatatgaaaaaggagattaaatgattttcaaaacacgaactaaaaaagttccattctatgaattttttggcgacaccattcaaggtgaaggaccaagattaaaatctgcagtatttgttagagttgcgggttgtaataatacttgtaaaggttttggatgctctgcagtagctccagatggttcagtagtaacaggttgtgatactattcgtgcagtatctccaaaatttaaatcacaatggaaatactttgataatttcaaagatttaacatcaattattgacccattagtcacatttaaaaactctgaaattaaacataccaaagacattattttaactggcggcgaacctttattatattgggatactaatgttattcaagatttcttagcttattatatttcaagaaaacatcaaataacaatagagactaatgcaagtttggatattgagttctttaaagaataccaaaaagaaattatgttcagtatgtcagttaaattaagttgttcaggagaacctaaaaagaaaagaattaatataaaaacaatcagtaagattcttgaaaattgtcctaaatcttatcttaaatttgtagttaatccagaaacttgggatacggactacactgaaataaaagaaatactttatgatttacctatatatactgaagtatatctaatgcctatgggtgaaactcgtgaattacagattaagaatacaccatttgtgtttgaaaaatgtgctgagcacggatttagttttagtccaagagcacatattttagcttttgatactaaggagggtatataatgttaagtaattatgcacaatataatatattagaaacaactggtttaattattattaaatttttgttattattagttgaattaggcttctatgtgtcggctttatttttagcagttcttagcattatcagtgtgtttaaaataccaggagtgttttataagttattcgtttttattgttttaggtttagcagcgtttgcttgtttaagtttaggctatactataggtttaactaatattgaatttatatttaagatttaaggagttaatatgaacttaataattggttttggtgtagtcggacaaagcttaggaaattattttgattctaaaggcattgaatataatataatagatccaagatttaatgataaagatcttaatgaaattggtttaaattgttatagcaagatttttatatgcattaatgtgttgaatgataatattgattcaaatcaagacacaaaaacattatacgaaattttaaataccatagaatcaaaagattttagtggtttagttgttattagatcaacattgttacctagtaatgtagattttatagaatctgaatacaatttaaaatttgtaacctggccagaatttctgacagaagttgaatcattgaaacgagcaaaatatcacgtgataggcgctaataatattatgtatgctaaagaaattgctgaattaatagatacgccttatgatttttgtagtcttagagaagcaatggaagttaaatacgctagaaatgctttaggtgctttaaaggtattattctttcacgaattaaatgaagctgggttcaatgttagaaaaatagaattattattaaatgagttcgaagattttgattctcaaggattaatggctaagttatgtgtagatggtaaaaaaggttttggtggtaaatgttttcctaaagatgtccaagcactgatgtttgagtctaataaacaatctaaacaagctggagatttctttagaaatattttagaagctaataatcgacttagatattgttataaaaaatcataaatatattaaatttaaaggtgttaaatgaatatgaatgtacaaaatccaaaattttcttttactgaagatcaaacaaaacaagttcttatgacagcctatcatctaagtcaagcttcagaatatattcaagaaactaacggtatgatgtctttaatgtttaattctatggctattgaattattagatcaagctggtttatctcaagcatttttagatgaattaggatatactaaaacaactgagcctaaaattcaacttaataagaaagaacaagcagaagtagactctttatttgatgagattttaaatggatctaaatctacaccaaatgtagaaactgaagttaaagattcaaaatacaatcacgagagttgcgattgtaacgattcaaaaggaatataatggttcaacaagaattaagaaaaataatttttatattatttgatgaacgtttactttcacaagttgtagaaatgttcgaaaaatacgaatatatcatagaaaataacccagagggtatagaaacgagaactgcgtatttaatttcgaaaatatatacaactgatgataaatctaaagttttagattatttaaaacaattgggtgaattagaagctactgatatttttccagatatcaaaatgctccaatgtaaattagctatgaattgttatgaaaacaatttaattgaatatagtaaattaatagcaacatttgataaaaatgatttggattacgcacaagcaaataacccagtagtttacaacacaccagcgttgtacagagtttctatcaatggtaaagattttgatgataatattaataatatcaataaatgtctgacttatttaggtgataaggttgtatttagacaaacaattgataaagtagatagaccaagttataaaaattaccttaagattagacattctttagaacttggtgattatgattatgggtttgatgcagttaaagcattacaagaattattttatcaagaaggtttagatgctaaaataaactctgttaattataaagaacttttaagtgattatattataataatggattttatgagcgctttccaattacttggatataagtttaccgataaaccagaatataacaaattaaagcaaatgtttaaagatattattatagaattaagtgtagattctttattaattttagaaacttctcaagaaaatgttcttaaaacgctcgctgagactaaaaaacgtcttataaatgatgtaaaatatgatgctagtgaagttgatgcttatttgggtccaattttacaaaggattaaagacagtggtaaaagatttaatagataaaaatcaagccgaagttcagttaaaaatacaagatttgcaagacatcagagtgggtataaaatatgctttgcgttgtgctaaaaagattagtttaaattctgaatctaactcaagtttagattcggatttaagccaagaagaactaaactttttagcttgtttaacttgcttacctaagaccaaaactaaaaacaaaggttaaaatggcaggtaaactaatagtagaatttagcttagatactaaatgtaacttagcttgtaaatattgttatagtgcacatacaccaccaaaccctatgtctatagacacagctatgaaattctttgatagaattaattatatgttagattattatgataaagatagctatcatatttcatactttggtggggaacctttattaaactgggaagtgattgaagcaactttaccaaaattccaagaagatccaagatgtaccagctatgttgtgataactaatggtgcattattagaccctgaaaaagttcagttcttaaaggctcataattgtggaatttcactgagttttgatggtctatggcaaaatactaatcgaccagtggttgaaggtacttttgaaggaactttagattattttaagcaaaacaaagcattaattcatagcattacagatacctgtaaagttatgatacaacccaagaacttcacaacaatgactgaaaattttgagttttttgttaacgattatgaattcttaagacctgatttttgtttagttcgtgataacatttatactaaaagtcaaatagaaacatttgctatagaagttgaaagattagcacataaagtacttgaatatcaacataaaggaataccagcaagtgtaggattatttgatttatatgctttagatattttagcaggtgctagatttggtaaaagagaccacggttgtttcgtaggaaataacggttgtttatatgcggtagatggtaaattctggccttgtgagcgatacagatcaactaataaaatggttctatatagtccagaatctggattaaatctaaagaatcttaagtttatgtctaaatacgctgacccaagaaaattcaagaaatgtacgaagtgtgaaattcgtgagtattgtaatgttgggtgtacgcaccaagaaatgcgagaagctaaattcgaaggtagagaaccaatagattctgtatgtcatttatttaaacattcttttaagtgggctatgtttgtttttaagaactctactaaagaatacaaagattatctatatagaagacttgaagttggatcttgatacctttagtatctaacactcgagtgttatttttaaaagcctttaatcaaaatttaaacaaaattaggatataattaattatggcaaatatattcgaacaatttacaaactgtctcaaagacaaagactatgatgagagtttaggttttaatagctttatgttttgtagatttttagggtcaagccctagcactttacaattagctaatgctattaatatattatataaaagcttaccagatgaagcacaatataatttagtgagatacacaaaaaataaaccaaaatttataagatttgcgaaagcgttagctgaatcagaatctatcaaagaaatacaattaaaatataaggtaaataaagaagtagctaaattatatgcaagtattttagattctatgtgtaaatcttaatcaaaggagctatattagctccaataattaaaacattacactccattgaattctgaatgcaactgttgattcttttactttacctttaaaggttctcatagcaattaaatttgtaccactatacaaaccagcttcagtataaactacaccatcattagcacagttaaaagcatcttgcgcaatattaatagtataagttactacaggctctgcttgctcaataccagtaactgtaatatctactgtagagttattattagcaccatcctgaacgtttgtggcagcagtgttaaccatattaccacttggtgtaaaaattacttggttccaagttctattaatatcaccttgttcttgaccactgaaaatatcagtaacagacgcagtaaatccagtagtttcatcctttggtgttaaaatatcagaaccttgatgtcctttagtacccataacaaatctattaatagcattactttcattgataccggcaatcaatttagcaaattcagctcttgccacatttgtaataagatttttctgttcgaatttatcgataacattaccattagcatctaaactttcaatacaaaaataacctctggcaggtgttttttgagcttctttaaaattcatattaggcctttatgattttttgatatatttatttagtaataaataaaacaaaaagtgaatacaatgcaaaaagatcaaattgatatatctatattaaatgcaaacaaatatttaactagccaagcaagaaaagaagcttttatctatgataaagttaaagtagaagaaaaatatgatggtattaaagtaactatagttcatatagataaaactggtgattataaacaagattttattgtttcatacaaatccaatattatatatcctgatgagtttgaatacgcagtcaaatccaaaataagacctgaaagcattaataattcacaatttacatttattttcgatattcttaaaaaatgtgattcaaagagtttacctttaaattatgaattctttgtagaattcttgatgaaaaaacctacgttacaacataagtataagaagatgggtgcaattttattagcttatagcccttgtacttatgaagtcaaatttgggagattattcacaaaaccaaaaggtttctatacagattcaagagaaacttatgctaagaaattaggatttgattacccaagaactatatttgaaggtaatttcgctaattttgaacgtggtatcaaatcacaagaactcaatgatatttttagaacttataaaaatattcttaaaatagaaaacatagatttatatatacaacaaatatctgaaatgtttcttaaaatggaatctaagtatggtggtaaacctgaaggttatgttttaacttatcccggattcttattaaaaattcaacaaccttatcaagtggatcctaaagcaagagcagaaacacgttcacaatatcaaggagatcctgatactgaaaatgcttattgggctaacgttagattagcagctttaaatattattggagctagtaatattaaaggttctttaaacgaaatacttcaaaggtatggagaagctcttaagaaatataagttgaattttacacatcctaaaaagacacaatttcaaataaaagatgatattcaaggtaatatcaaaatgatcgttattaaaagacttaaaggaaataataactttttattcttaggcaagtttagaattttaactaaagctcattataatattattaaaaatggattaaaaaaatacgataatggtgtagtctgtttggtaacttcaaaagatactaaagaatttgaagatcttagattagaaatgttaaaatcttgttttcctgaaattgaaattatacaacatagtacaggaaatattattagtattatgaataaatctaaaatgaatataaatgctattttatgtggtagtgatagatataatgactatgtaaaccaattaagagctaacccagatattcaagttgtcgaaacgcctagagatactggcgctatttctgcaactgcagtaattgagaatctaaattcagaaattttctttaaaagaaatacaccaagtgaaatacattctatgtataataaaatattaaaaagatttaaaagcttaggtttagtatcatatttgtctaaagaaccagaaaataaataacaaaaatgacgggcaaggtttaaaatgactgagttaagattaaatgtagattctaaagatatcatagaagcgggagattataaatctacccaaagaggtatgttaacattttctaaaaatgccgtgtatttaggtgatggtaacaaagctaataaaattatagatgcagaaagcttaaaaaccgaaatagaaaaagttcaaaataatgtaaataacactataactcagcaaatacaaaatgtaaataacgctataactcaagttcaaaacacacctgcagttcaatttttaaacatatgtgataatgcgactgatttagccacgttaaaatcaagtgttacattaaaaaatgtttttgataattgggtaagacattctattatgaattctgctagtggtcctaaattagatgatgatgctggtcaagcagaagctgctaaatggtcttacatagaagcagaagatgctatagcaagtaatataaattcaagttattataatatgtttttaagtaatgacgtcaaagatacttatagtgtgcaaatatcagctgtgggccaagataatgatgatgatgttttaagtattgttgtagcagctaaaatgatcaatggtaaattatatacattaagcgcagtgagatctttacaattaaacgctttaccaggtggtacttcgtggggtttattttttaattattgtggcaacaatgaagaaccttatacaacttataggttattagcttctaaaggcaatattacagataattatcctaaaacaatttggcaagcaggtaaacatttattaaaagtggctagaactaaaaatagagtacaatgttggacttcagatctaaaccaagcattggatggcaactcattaattgattatacattaccaacaacaaaacctagtgttttatccgataatgaatttaatatattgaaagaattattaaattcaccttgtcaaatgggttttggtaattggtctcaaaatattaaattttattttgattcacaatcaggtgtgtatgatggtactataatagatatatcaaacaatcaaaaatggacatataatagttctaataaaacttgggtgtcatctacattagataactcaacaataccagaaaatgttttaattagttctaagaaaactaaaaaattgttttataataatggtattgaaatatcaagtttaaactaggatttaacacttgtcaaaccatttaattaaaactttcttaaatatggctatagccgtatcagtaggtataatttgttttttaattgatttttatatacatcatacattatcttggaaaatgttcttaatattttgtataataaccatatattatgatattaaattaatttgtgatgttgttaatgaaccgtcaaatactaatataaaaacataaaatataaagactaaaaatgcaagatttaaaacctcgagaactaaaaacttatgaaatagaagaacttatagttctaaatacaaaaactgcaaaagaactcagagattctatggtagaatcaaacccaatttgtcctttatgtggttctaagatcttcaatcctgtacttgatcacaaacatagtaaaaaacaagaaaatttaggtgtacaaggcgctggcttagtcagaaatgttatttgcagtacttgtaatattttcttaggtaaaatggaaaataattataaaagatatagaattcaaaacttgtctgattttttaagaaatgctgcaaattatttggaaactgatacaacaccatatgtatacccaagcgaagcaaaaaaattaaaagaaatttttccgaagtctttatataataaactgattaaagcaattcatttagaaaccaaaaaagatattaattatattaaaaagaaaattaagcacacaaaatatcttagccaaaaaacaaaagatttattaatatcttatggtttatattcttaaagtttaaagtataactaaagtttaaaagtttagtacataaatattaaaaaaaaaaggttaataatggggttattagaaagtataaaaaatagtattataggtgaaaaaatagatagaccattcttagaacaacctattaataaaatagatactacagttccattcggtagagtaataaacactttatctgatgatgaacctttaagattccaaaccttttttgataatgtaaatgacataacttatgttgataatctacaaaaagcatcagaacaagctcaaaaaattgatatctacagacaaactgctaagattgctgaatgttggagtggtttaacagaaattgtggacgaagtcgcatattgtagagatttcaaagatcctattaaattagaagttgatacttcgaataagaaaatagacatagcaatatctaatgcttttgaaaaaataatgaaattatttggaacccaaaaatatctacattcttttatcagacaatcttatatagacggccaaatgaatatattaattaaataccacgatgataagaaaaaaggtataaaagaattatattatttagatcctagatatctttggtatgatttaacagattctaaatacaaatacatagatataaattcttcagtagctcttaaaaacaatttcttagggaatcaaagatatatcaatatcaatggtaaagctccagttcgaatagatcaagctgctttagaatacgatatagaagaaatagttcatcaaaattttggtttgttttcagattctggtatttgtttaagtgaattagaagcttctgttaaaacagctaatcaattaaaaacacttgaagatttgttaatacctttaagattttcaagatcaatttcaagacgtgtgtttaatatagatttaagtgaattacctaattctaaagcagaagcttatatgagggatttgactaataagttcaaatataaaaaacaatacaatccagaaactggtgaagtaactaataaccaacacattgtcactatggtcgaagattattggattggtaataaagctggtgctaaaggtatgcaagtagatatcttagacgaaactggtaacttaggagaacttggtgatattatgttcttctacaagttattatatagatctatgggaataccagttaatagaatctacttagatgaccaatcacaacaaccattatttgatttgcaagcagatgctatcacaaacgaagacatcaaattcttccaaaaaataactaggattcgccaagtatacactgaattctttatgcaaattctaaaaagagaattaatttgtactaaagtttgtactgaaaaacaatttcaagaacttaaagattctattaatatatactttagtgaagaaaatcaatttattgaaagaatgaacctaacattgtttatgaaacgtatagatgcattctcaacagctaaagattttggaggaacagttttacctgtagatacgttatataaagaaatctttagatttaatgatgctgaaattaaaaagaatcttaaagctattcaaaaagaatctaagaatccattgtataaacaattttacagagattttgaaagtggggatgaattcagttcagattctgattctaatgatgaacctaaatacgacgattctaataacaatgttgataatacagataccgaagaagaatatgataaaaccggtttatctattaaaaaagactcattgatttaaaactttagttacattcagaaatttttaagttatattatattataattatttcattaaaatataaaggagcaaaaatgaaaataatagatgttatgaacgatttaatagatcgcgttagaaatgaaaaattaatatttacattcaacggtaaaaaatattttttagatcatgtagattcttatcaacacggtgaagattttggtctattctttagattggaactttttatattcaatttttaattaaaatataaaggagtttgaatgaaattaatagatggttattatgtagattcaaacaataataaatgggatgcttctaggtatacagaagagcaagctataaaagtttcagaatctttagtaaattgtaaagactgtgttaattgttttaactgcgaagattgctttgattgtgaagactgtacagattgtgaagactgcattgtgaaggttgtaagaactgcacaaaatgttgtgactgcgaaagttgtgattattgttataattgagtcagatgaaaaaaatgtggagaatgtgaagactgctattggattctaaaaaacgagaaaatgcacgatttaataattttttaagttctaatatattataattattaaaaggagatcaaatgcaaattataacagattttttaaatgaattaaatgcttcaaatagttctaattataaattagaagttcttaaaaaatataacaatgaaatcattaaagaatttctttcattagtttatgataaagtcaaatattcttacggaattaaaaaagtgccagaattccaaaataataatgaaaccatagatttcaatacaattaaaaatacgttcatagcgttgcataatcgcgattttacagggaataaagcaattagtgttgttcagtcattacttaataataaaactccagaaataaccaggattattacttgtattttagacagagatattcattcaggtatttcaactaaacaaattaacaaagttcataaaaaacttataacagaatttccatatatgcgttgctcactaatggataaatttaagaatattagatttccagcaatgattcaaataaaagcggatggaacttatagaacttttattaaaaaaggtgatagtgtccaagcattttcaagatctggtgaaagttatgatcaccctaaagtatattcagcattattgaatctgccagatggtgcttatattggtgaattaatttgtaatgaagttgaaggtactaattcaactgaaatcagatataaatctaatggtttacttaatagtttaacaccacctgaaaatgtaactttttatatgtgggattatttgactttagaagaatttgaaaatggaaatagtaaaacaccatataaagaaagatttgagtttgtttggagattaactgaatctttagaatctaatacattaactgttgttagaaccagagttattgataatatagaagctgctaatgagtatttaaatacttggttaaaagaaggtgaagaaggtgctatattaaaaaattgtgacgctgtatttaagaatggtactagtacagaacaaataaaattaaaaccagaaatagaagttgaagttcgttgtattgattttacagaaggtaatggtaagtttaaggatacttttggtgctattgtttttaaaacagatgatgaattaattcaaggtaaagtttctgggattagtgatactgaaagagttgaaatatttaaaaatagttctaagtatttaaataaagtttttacagttaaagcaacagcattgacaaaatctgaagattctgaaatatatgctttaatgcatccaagatttaatggatttagagaagataaagattatacagatactttagatagagttaaaaatatgggattaaaattttaagaaatcaatttagaattcaactaggcaattcactagctgcttgaattctaaatacaacttcttcaattaaatatttaggtttataataaacatctacataaatgttattatcctgagtaggattattagaaatatcacaaactattttaaaatcttctatattattatctgcaacataacttctacaaatttcttttatttttgaagctaaatcatttcttgtatattcatcattattttcaaatacataatataatgcagcattttcacattctcgaactaaattgaaatatattattctatttgttaatttagatccttttaaggtattttcacttaaagcgtatataccggaatatccttttttaacaatattaatatttaaatcatataaatcttttatttgtgattctgttaaatatatatccaaatctattgtatttaagaaactataaattgttttacagtgagatactgataattcttgtgaattaattaatctggttcttaaaccaacaatatcgcctatgcaattaacatatatattttgattattaaatggatttaattgtaatttagaaccatagtagacaacagcattgtttgaaatttgtaattgtttaatatattcttcaggtttgatacctctaggtatgcctacgaaagcgcagcaatcaccacgagtatctgctaaattgatagcagaatttggactttgtgtattagcaattataaaatcaaatatataatcgttagattcgcctacatttttatatgtttcatctatttgagctgcacttggtaaacttgcgtacccgttacttaatttaagactattagaaccgtaaaaaactgttttatctgagttaggttcatttccatcagctaagcgatttaagccatccacatagtgtatattaccatcatataacttgtattttttaggatcgaaaataatgaatatataattagaattttcattaatagtatctaccatatcctcagcttcttttaagatatatttttccattaatgtatcttttaagaacacacaaatacaatattgatttgaactcattgaattttgaatatcttttgctaaataattgctgtgtattaacatattattaagaacttcatattgtgtaaaaatacaaactgttaaatcatttccccactctcctgggtttctagcaaggattctcaagaaattattttcagaaattatacgtttacttctaaaatcatctaagttatctattctgacgtcaaagtcattaaatggatagctaatactagcattaactgaattttcaccaatagatctcgaaataactatttcattattatcatataaaaaataattataaatttgaaaccagtcatttatattatttttgtttggtttaccaaattttgttttaaaatctaatatagaataaacgggtgttaaagtatctggtgaacctttatcgaaatatccagcatagaatactcttcttggttgcgaataatttgatgttgaactggtatcactatcaataaatctaacacttgggactggcatcataatccttcatataaaaatatatgatttttaaattctataagaatctataagaatttaatcaaatattacaaagtaatattcattttttgtatcttgagaagtctattcttctcaaagatatgggataaccataaatccccacatattttggctatattgacagctgaatttatatctctatcaactttgaaacctgggcttaattctacctctctaatactaagattcgagtctagttctctttttcctgtaaggcagttagtctgagaagtatatgcctcattcacaagtaaaaagttcaatcctttattctctgctttatactttaagaaacccttaaatctactcaatagtccttcattttgagttgatttatttaaacttgttttatagtctttctttaattttttagtcttgatatctccgcaaatgatgttatctataccattaagaatgcagagatctactatagtctttgaggtcttatgaagatagtcttttcttttattagttagttttgcttgctttcttctgattgttttgttaagttttttatatcctcttgaacctttcttcttcttatctcttttagacttaagttcatttatagctctttctaaacctttaaatctcttagcttgtatcttcagacaatcgatcttatttgagtaacaagatgctatactgcttattcctagatctatagaaagaaaattttgatttagtgctttttcttgttttttctctgagaaaacaaaaatacaatctattctcttattctcatcaatcttgatgactatctgttttaaagtctcatagttgataagttctatatcatagtaagggcatttacttaaatctaattcaaatcctattgaagtaaagtttattttcttaccttctagtttaaatcctccacccggatagtatttcttttcgagagtcacttctccagttctagagttaacaatctcccccgtcttagaggaaagatttatgtccataatgataggactatattctctatataattttggaaatctagcagacttatcgttcttctttttcgctagataagattttacagcatttataacctctctagaggtattctgtatatgttttgaatgtaagcctattactttcgatctaccttttgtgattttagatagatctttaaaattcaaattttctttaagaagatctagacattcgttgtagatagcagaaagagattcagaatattgatatatttcttctttttctttatcagagataaagctatcaattcttatctttctagataacattctaaactcctttctttatatctatttatatttctttttctcaatttcttaaggttgtcttagtaacatatataattttagaaaattctccaataatatacatttaaagtctttttaagaaaacttataatataattatagatatttatatattcttatatatttcaatataaaatgaatgtaactactaaaagtagtattaataaatctactattattaattgttcatattcttggtcattatgtatcaacatattttatactttagtgtttactaagccaactagttcagattctttagattctaaagctatacctataaaatatttttcttcttttttgcttgggtttacacaagcataaccgtcatactcagcgtataattcatcaccggcttttacagaacctttaacaattactggtgtctgaccctttaaagctattaacacacctttacaatctttattaagaataaatcctggtttatctgaaactacacctaaaggtctattatgtttatagatgtcgaaatattcaatttctgaattttcattaatacctagaacagctccaacttcaaactctttatcggtttcgtagacctcagctaagtcagcgtattttgcttttaaagcagttcctataaaatcttgagcatacatagctttaaattgttgcgttgttgagccaattgtagatattaagtttaatcctggtaataatccggcttctgtggttaaccaagcttcttttttacttttacgagtttgtaattgtttagatttagaatcaacaaatacataatccgttaacaaatcatctatattagcaacactttgtttcacttcatctattaaaacatcgacatattttttagttgttacgtgagtaggtttagatacttctaaatctattttattgtcttgtttaatatagatgcctgcgagataaccatctaagaaatctttaaattgttctaaagaccatttaagatactttaagttaataacatcgtaatcatcgacaataggccaatctttatcattgtcagttttagtagggtaattatctacatctaaccaaggatataattcatttaaagtgacttttttccacatatcagagttagcatctggataatacccttgattttcgatatcactaggcaatgctaaataatatgaatttttaatggtttccacatctggattatcttctgttatataagaaactatttcacctgcttcataaattatgctagcatcccatctgatagattcttttgaagttaatattttaaattgaccgattaattgattaacctctcttttgagtttattaaccgacttgtttagtgcgtctgcgctagctctttggttatccataatattgaattcttgaacgaactctctaaaactagttaagttaaaattatagccttggtatctaaaatcagacattaaatctcctgcttatatttttagtatttatttttgatcagaggcttaaataatttaaatagattaattagtgtttaaggttattgtataagtttcaaagcttgaagtttctactcctgtaaaattataattaatacttaatataaccctgttgaattctggttgtgaataaatgtctacactttgaactttgattctaggttcgtaaacttttagacatcttgtaatttcggtttgcatactattaatagtaatatggtcaatcatttcaaacaaataagcatataaattgcaaccaaattctggtttaccagctaaggaaccttttctagtagttaatatattaaaaatactttgttctatagctcgtttatctataactacatcattcaaagaatcattatgaaaatctttataagttgccatttatatacctattatattattttaaggtataagccgatttaataccgacttatttaccttaattttcgctatgttaatcttcagactcagttacttcaacacttaatttaacaactttttcagaaccaccattagctgtagcttttacagtaatttcagaagttcctttggttgcagcagttatagtgaatttaccagaacctttttcaactgtagcattagtattgttagactcaactgtgaaatcactagcattagttgttacagtgatatctttagtctgacccttctcaatagtttgtctatcagctggatttaaagataaagtagtttctactgatggtgattctggaccactttcttcattatctgctaagtttgcttcagttctttcagctatgatagctttaacctcagcttgcgatttttcatagattgaaccatttatgtcaactttaactggatctgcagtaatatgttctaatgccataaaatacctttcataattattaattattagatatttattttacattctaatgttatatgttttttaaaactaacattaagtatattcaaaatcttctaatgttatatgttttttaaaactaacattaagtatattcaaaatctttgaatgttataatttggaatctttatctttgggagatatgttatctaataatctatcaattatactttgtattttttcatatccagcgaatgctataaaaatagacacacctattctgctcgaatatgttaaatcaaaattatcagttattaaaaaagaagataatgctaaaacaccagaagttgatgatgtttttataaaaagtttaaatctcgttaaaaaattggttttagatttagcagctttatctatatgtaagaattgaacagtacctataacagcacctataagtagtataggaagggagccaaataacacatcgtaaatattcaacattttactccctttaaaaatttatgttatttataaacataaatgctgatgatcaatgggttaaccaacataattaaaaaaactagctattgcatatattaacgaaaatgtaataactccccatatagttctattacatattttccaaacagttctcaacgaaatggtataatgttcaccactggaacaatggtatctacctattaaaaaccatctgaaaataaaccaataatatcttagtttcttttttaaaccttctgtgcgttcacccattttaaaccttatttattgtcatatttttcttttaattcatcatattcttttttaagagcttcataaagagcttcagcttttttagagccgttaacacgaatacaataacctatagcaaggccaacaacgaatatagcaacataaatagcaacacttaacattcataatcctttaatattttttattatttattaaacaaaaaattggtcataaaaatcaaataaatattacaaaaaatcaggattttcaaatggctattataaaagaaacattgccttttacatacgatgaaatataccaagatatagctaaaagattaattgaaaaaggctgggatggaggagcttatgaaggctctaatggggcaatcttagcatctgttttatcttatattgtaagttctttgaacttcaataccgcagtaaatgttaatgagaatgttttaactttggcgactaaacgtaaaaatgttatacaagatgctagggttttgtcttatgaaccttctcataaaaaatctacaatactcgaaataacattaagttttaccagaactggctattttaaaataccaaaatatagcacatttaccataaatgggtttacttacaattatttaggtgatgatttagaatttaatatagataaaataggagctacaactacaatacaagtaaaagaaggtacattaattaaaaacgaagaatatcctgatattttaacttataaaatagatgaaaaatttgaatacattgatataccttggaatgatgtagaagatgatggtgtggaatgttatgttacttattatgatacttttggaaatttatcggataatgcaacttttgtaaaatcttcttttaatttaattgatattaaggatagcaccaataataagttctttagaaaagatgatgtggatactggcaatgctaggatatatttccaactagggactgctggtactaagttgccttctaatacgagagtttatattaatgttttaagaacttctggaatagacgcatattatgagagatgtgattcagcttccgttaacggtgatcttggctctttttgtaaaatattgacttctggtaaagatgcacctgtattagtttcccaagctcaggatgaagaaagtatagagtctattaaaacaaatgcaccaatgttttataatagtgcttcaagaacagtaacgatacacgattataattcagttataaaaacacactctagtgttaaaaatgtagtgacttgggggggtgaagatgaatatccagttgctccaggtaatttgtatttttcagctgaaccccgaagaaaagaaccagaatttacaatctttaaaaaagttcaacaaagtgatggaacatatacttacaaaaaagaaaactctactttagctaacggcgaattattgaatactactgaaatgagcaccaatcaatactacataaaagaatcttataatgatcctgacacattatatttaaatgatggtgaagttgtttctgcagaaaaagatgctaacggttataaaaacccaggtatttttgacttggtagatacatataatttaccagcacttaagaataatcttaaaaatccaacatatgttaatatagatttacaagttcttattaaacaatatccatttggtactccaaaatcagatattcgtaaaaaaatctatgcaaagattcgtgaaaaaatggcagaaattgaaaaatttgaaggtgaatttatccattctaacttagttaggcatttagacaatgaattgggtctgggtaatggtatagaagtaaatccatattttagtttattactaagtgaagaaaactgtgtaaaacaatttaaagaaaataaagactttagtaaagtaaattgtttttatgctaaatcatatgacaaattatctaagaatttagttcttagtgtttattttagtttattggctagtgtgggtgataaattagaagtttattttaataaagaaagtttgccgtttattttagacaatacagatcattatacttatgaattaacggatactgatatcaaccaatcttacaaatctttttattttaaggatgtgggatttgatgaagaatcattaaatgttagaataatatcatacgatgggttgaccacctatggtggaaacgacattaatttatacaacttaaaaaataaaaccgtattttttaatgttaatataggtaatgaattatcagttattaaaatagcattgccaagatttgttagtgtaggtgatagttttaaagtttacggtttatatggttctcgcaaagcagaacaattaatatatgatttctatattactgaagagatactttcgcaaggctatctacaatgtgatgatttacaaaggggtaaatatgcaggttttgtaggagcaagtgattataaagttgtttatacttgtaatagagaatctttaaaaccaagtgatagtgaagaacctgatagcaatgggttaaaatctaatcaactattaggaactgccagtggttcttgggaatctgcagttaaccaaactgaaagtcaagataatgtttttggtgatatagaaacttctaatttatattataactggtatgaagattctgatggtcaaatagatattagagtttggataccaagctcggtaaaagccaatgatacattattaatagattatgctcaaaaaactacaagtattgttataacagacgctatgatagctcaaaggcagtttgatacaaaaatagatggtatattattagatgttacaaaaatttcatttggtagtgctgatggttctatcggtatatatcctacttacgtagaaagacaaaatgaattaacacctgtagaagatgatagaattcaatttgttgctaaacagtttgaaaatataacagaatatacacctacaaccacatttgatagagaagttcaattaaaatctaatgaaaaaattacattttatgttaattataataataaattcgacgtcaggaatttaattgcaaatcacgatgattcatcagattcatatacagttagtataccagaaggttctccattaaaatacgaagcaccatacgtagtattaaataattatagaaaaacaggaacttttaattttaatttagacgttcaagtaaaacgtggtgatttattatatcaaaatcaaatagtatatgttaaagaagctgcagtagatttatcagtagatgaagggcctggtggtgcttatgtatatttagatttaccaattgaaggtatatatgataccaagggtcaaataataccagaaaatatacccacaatagaatgggctttatttgctaaagctaatcctgcagaaggtgaagataatgaacctatttgttttgaggaaatacaagaacctagcaaaatacataaagttatcccagcaaatttaacaaattatgtggcggaacaaaaaatagttgctaactatgttatagatgaagaatctgttaagactatgttaccattttatacaacagttgaagaatatattaatttggatctatctaaagttgcttatataagaatacctattaaattaatgaatagaagtgctgctacaccagaagaaggtgaacaaattgtgggttcttatacaatatttaattcaaggataccttatattagagttaaattccaaacaaaaatttttcaacctggatataattatgaatttatgttaaattacccatcacataattttaaattaataagaaattcaatatttagacttagatctgtagtttttgatgatttattggattatcaagaagttagagatagtttaagagctggtgatattgatatgagcactatgagtgtttaattatctaattaaatatattttaagttattttatgatataattatgcaaattaaaataacgaggctatgatgaagttttcagattttttagaagagcaagcaattgctaaatcaggtgattatgattttggaaatttggagtatttaatggttcttttagaatagttaaaattatatactattttagtggatgattttaaatgggtattgatgggtgattctgaacaatatgaaggtgcaagaaacttatggacttccttgtctaaatctcctgggtttaacgttgatatagttgagttagcaacaggtagaaattttgctaaaaaggttaaattaaaagatgctttagatccaagaatttggaccgatgaagatttatttttaacaggaactaaagaagaaagaatacgtggtagatttaatagattggtattagcttaaggtacaaaataaaggatgaagttttcagattttttagaagagcaagcaattgctaaatcaggtgattatgattttggaaatttaaagtatttagacgggcccagatatacttcaatagaatatacattcgataaatcaccttttgtgtataaagtaatttatgatgatagagaatattatttttatcgtagagaatcttatcatattttagctattaaagtacctgaagattatccaactaaagctaaccccaatggaaccaaagacagattttatcctatagctatgattagattattacccactgataaaattaaaagaatggattataagaacacttatacagttagtgctgtagaagttgataaggatctacgaggtaaaaaactaggtaaattattatattatctagcaactaccgttcttaaatatactttattaggtgattctgagcaatatgaaaatgctaggagaatatattattcttttagtaataacccaggatttacagtggatataattaaattaggtcaaggtatcttagcaaagaatgtaaatctaaatgatcacaacgatgaaagagtttggagtacaacacccgataaagtaggaactttacatagggtggttcttaaaagtgttcatatggaatctaaggtagaagtcaaaaaattaaaataatttaatttaagactaagaaccaaataaatatactaaaagtatgatcaaaggtttgctgtgtttaaaagtatagctaagaacttagtaccagaaaattacaaatctaataaatttattatggacgtccttgacgtttttgtagattatatctatgataattcaagcctagcgattgacatcaataatttatataattctaaaaacgaagttctatatgaagaaattattaaaacatacgctgcaaacttttataagactataactgatggttcaaaaaatcataaacttgcagaagccgttagaaaagcacacgaaaaatatggttttgattttagtgaaacccaattagatataaatgtaatacacttattatcacaagaacaattagaattatttaaaaactttcaacaatctaaaggaacattaagatctattgagtttatatatcgtattatagaacaattaaatattgaaagttttgtattagaaaccgatggtcaattaacaatagagcccggtgaaaatatatttgaataccgcgtttacggatctatgttaccagaaatatttgaagcatttgttaaaccattagctcacccagtgggttggacttacttatttacaagaacttacgttcttaaattcgaagattatttcttatgcaaagaagtttacgatgtaaatgtttttagagtaacttgtgaagattctgattgtgaagataattttaaaacaaatactggatatctttttgaaactgacattaataataatataatatatgaaaataataaaccaaaaatgtataaagctgatggaaatccagtatttaatgttacaagatttggtgtcaattacccagaattaacattagaatctgaattaaaattagttaaagatcctactattagaactattgaaaaatccagcataaaaggtaatgacaaattaattgtatattttgaatctggtgaaagattagaacaaaattcaaaccctaagaatttaatattatattattataaaggtattaactcattaaatcaagaaattaaaaaagattatactgatttcttaagcaaatgtgctttggaacttaattatgttagaagagttataaccacagttaaagacaaatatcaatttcaagtagattttggtttagctagcactactggtaaatttgcagctattggcgctggtaatatgtatctaggttcagatacttgggttcttggtaaaaatagaatcaatgcaaatacaccagtaacttatggaactagagttcgtaataaagttttacaaacttctgactttaaagcattatataagaaaaatgataattctattagacaggtatttgataaagtttattctggttttgatgatcacgtaaaatcaagtacttgtaattttattttagaatctgacaatttatatcattatagattatataatccaaatgcaatattttttgaattaattaatacttacgggtatagagttcgcgctaaaataaaatataacgaagattcattagaagttatagctgaagatgaacttaaaaatacacaattattatatatagataaaacattattcagtaaatacaattcacaagtttacaaagattttaaagaatctatgaataagcctttaggtcaatattatacagtccttaaaaaaggtgttaattacttgaatattgtagattctaatggttatatagttaaaggtaattataggcttgtagattctgaatataggctttatttaaatataaaagatcctgtaactattcaatttattgatgatacttatgaatacgattcaagaccatttcaaattattgatgccgaattaagttataataaagattctaaattatatgaatatactacaccagaaaaagaatactattttgtcagcgtagctaatcgtattagcaatgtagatttggacattatgtatattgctggtttacaaaaaggttttaaaataacttcaagcactgctcaaaaaataagagtatatgttatagataatacttctaaaagatttccgataactatactgagtgcaactaatgaaactatacaagcaaaagaaaatagtatattcttaggtttaatcaatgctgataaccaatacgttgaaggacaaatagtttacgattctgaaggtaaattagcaacattagattgtaatgcaaaaacaaataatttaagtttattatacttagattattctgcaagtattaaaaacccaataactattaaatctacaacatttgatattgctggaaatttttcagaagttaatgataaaagaggtaaattcctttataattttagaatcgaaaatattatgattgttaatatattcgataaaaataatcaaagaatacaattagactatgatattgaaaatactggggtatctttttatactgatacaaatgaagctattacaatacaatactttgataatatagatgaaggtataccaagaacatatacaatagatgctgaatttaaattagatactagttacattaattataacgcaaaaatatttaaatataaagatatattattaaatatggatactagtacaaacaaatatgtttataagcacaacgaaatgaaaacttatcctttagttgttatggatactgatggaaatgttttagacgttgaaataggtattttaactactggatttaaaatatcttattctgaaggtataaaagtaagaatatattatttagatgatactaaaaatagggctgatgttacttataataaagctggagacccggaccccacaaaattattatatgctgttaaaaatggtgtcatagttaaacaagatatcaatacagtgtctactgaagatttttattcattttcaagattaaaaactcttaaaattaagaaagctgatttaaaagctgtggaaagtaacgacccagattcaaaactaggtaaatataaatttattaaaaatattgaatatggtttgccagttatggccggttttaacaatgatttaaaattcaaagttaatgaagattctataacaatttacacagcaactaaaaaagatattaatattagatacgtagaaaaagttaacgaagaaagtttcttatatacttatagtataagaaaagatgatgatttatttatagatgcgcaaaaagattctataaaatatttaatagattatcaatatgattatttaaataatagaattatttttacaaaagaagacgatgatattgtcaaattgtttttcttaaagaataaacacaataagaaaacaatacttagtattaataacgcaaactttgaggatattgattttccaattaaaatttatttaaatgacgactttgttgagtttgaaaataaggaatctatgcaattagatgcaaatccattagatcttaaattcaatcaagatattaaaaatagaaattcaacaattagagctattaataaagatcttgaagtattggaacaaatagattttaatttagcaccacaatatacctttaaagcacttggtgattatctctatgagatagattttaataagattaaattcaaagaaaataaacttaatgaagaatccttgtggtatagagaaagttcagtttatcataatcattatgtaggatattttgcagctaataatgttcagccaactcaggtatttactggtacgtcaaacaaattagattatgaactcagagaaacaaacccttggggattaacagccatagatacatttgaattaacaggaactgctgcaaatgatggatttgatgttaattttgaatttattgattcttggccaaaaatcacagaagtctataaaaatgattatacaggattctatcaaaataaatggggttggcaatcgggatatgttgacgtttataaaactactagggatcttgaaagatttaatgaaaaatacgaaagattagaacacgccagcgtataccaaatggatgattatattgttataggatctaatgatataacaaaagattatatgtttaaatggtatccaactagtaagtcaaatgattttagtgatagtttcttaagaaatggtcaagtctctgaaccagtaacacctaataaaatatatactagaaaatatgatagagaacctgataatataattaataaaacaaatacttgattataaaggatttagatggctgatattattcaaaataaaatgaatcaagtgatgggtgatttagctcgccccactaagtttaaatgtcaaatatttccacccaaagaaattaagtgcgaattaagtattttaaatgaaggagattctgcaacatccagtacttctgaaataggacaatatttagactatttttgtcacgctacaagttttccgggattgactgtagaaacaatagattttaaatatagaggtagaaccctaccagtcaaatcagtacaaacttatcaacaaaaatggacagcaactttttataatgatgaaaaacacgcagttagaaagttatttttagattggatgacttatgatcaagctcaccaatttgaggataaaactaaaggtaattttgaaggtatattaccaagcatttctatatatcaattagattttgaaatgtctaaagattgtgttgtatatactatgatgaatgtatttccaacaaatgtaggagaaatttcagttcaatacgacgggttaaatcaaattgaaacttttacagttgagtttgcatatacacattttgaaattaatacaatttctggggaggggttaacgagttctgaagtcactagtttgatcaagaacactatacagaatactattaataatgttaccaatactttaaaagatgctgtttttggtgctttagatgatttgatttcacccgtattagattcagtttcagattcatttgaaaattttataagtacaaaataaggttttttattatataatatattttcgatctttttaaattgtgttgttacgaactttttttgagtttttacagtttatactatgctagtactgctaaaacttaaagcaatattaaaaagtataaaaaatgcttgggtttttagtattttatatatgctagtactgctaaaacttaaagcaatattaaaaagtataaaaaatgcttgagtttttacagtttatactatagtattaagtctaaaacttaaagtaatattaaaaagtataaaaaatgcttgagtttttacagtttatactatagtattaagtctaaaacttaaagcaatattaaaaagtataaaaaatgcttgagtttttacagtttatactatagtattaagtctaaaacttaaagcaatattaaaaagtataaaaaatgcttgagtttttacagtttatactatagtattaagtctaaaacttaaagtaatattaaaaagtataaaaaatgcttgagtttttacagtttatactatagtattaagtctaaaacttaaagtaatattaaaaagtataaaaaatgcttgagtttttacagtttatactatagtattaagtctaaaacttaaagtaatattaaaaagtataaaaaatgcttgagtttttagtattttatatatgctagtactgctaaaacttaaagtaatattaaaaagtataaaaaatgcttgagtttttaaattttataccacaatatatgtaatttaagtttactttaagttttgaatatactagacttaaatcttaataaatacttaaaaatgaagttcaaacaaggcatttatataccaaaaaacccagagaaatatatacatagttatacaaaaatgaatgaacacactgaatatcctgtctataggagttcttgggagcttagtttcttcaaattctgtgattattcaccctctattactaaatggtcttccgaaccggttggtataaagtactttaatcccgtcaaaaaacgacaatccacatattatcccgatgctatgattattcgtaacgatatgacatttttaatagagattaagcctaaatctcaattaccaggttctaactcaaaatccagttatgataaactttcagcagcagttaacgaagccaagtataatgccgcaaaatcttattgtgaagcaaataatatgcaattcataatcttaagtgattctttctttaaatcttgattttaagtttttagcttttggttttaaaacttaagttttgaattaaaaaaatttttggcttttttaatatgatatattataatataaactttttttttcaaaaaattttagtagttttacagttgtttagaatttgtagaatttgttttaaaatctaaactaaagtttcagtttaaatcttaaagtaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggatatttcatagatcaacacagaagactgcaaatatttaaaccattctaataaatttaagaattttttaagcttatatattatataatataccaattgaaaggaaaataatgaaactgacttacaaacacaaattgtataccaaacatcaagatattattaacacatatctgcgtttaaaagtagagtttaatttattcaagctggattacaaacgacttagatattcaagtttattcacacaaaatacaagacttaaaactcaaaaacaaatagaagagcttgaaacgaaactaaccaaaaaaggcctcaacacacaaaaattacgcaagttatacactaaaattgttaacaaaaaacctttcaatgattttgaacaaatcatcattaataattttgtagaaaatggcaaaaaagcaccacaattattcaaacacgaacgtaaattcgataatagatttacaagcctactattagaacgtaaaaaacgtcgcgctaaagcagctaaagaagtatacgcaagaagaccattatctccagaaaaacaaaaagctcagcaattagttccatatatttttcaattcattaaactcagaactatggaaaaatttggatataatgaagatttagcagttgaaataactggcagaatttttggacctgggtgtgaagaagctcttgatatgtatttaaaagaattcagagatttgtatggtaatacagaccaagctttagagcatttcaaaaaagctgaactattagctaattaaaaatatatttaatatttaaatttaaaactaaagtttaaaatctaaaggtggtaaaatgagtgaaactcgtatgaaacacgattatactaacgaacttgaactaaaatcgctagctattcgcgaaaaaaacttcagattaaatctaggctctgaagatcctgatggttctataaatgaagacttagacattaagataaaagaatatattaaaacaaaagatccagatcttaaagactatattattagtatatccgagggtgtaaaaatatcaccaaaatctcacgaatattttggtaacattgttattctaatgattaaaaaaatattaactaaacctaatttttccgggtatacttggcaagatgatttttatagtgatgcttgctatcgtgtatttaaatatattcataacttcgatcatacattaaaatctaaaattacaaaccaatcagtatcttgttttagttatatttcacaaataattcataatagtattttagctattatcaatgagaaaaacaaaaaagataaagaacttgaaaacttagcttgtatgtataattctgaatatgatatacataatgaatctaggaatgcttcaactatagatattgttaatgaattatatgtagattacacaatacccaattttaatttaaaaatgattgaaaatattttagataccactgaaatcaaatacaaaaatattaatattagatacaatgaaggttttatatcatttgatgattacgctgaacttaaaaacgttctaagtaattataaacattttaatgtaaatctaactaaaggtgattcaaaatgaatattaaccaagatttaatagcaaaggaaattaaaacattaaataaattctacaagtttttaagagagcataaaaatgaatgtgttatggaaataatgcaagatttttgtgatttaaatgatatccctttagaagaacttggttttttgatatcagaggatgcatacttaaaagattatatagaagcaaatcttattaaatataaattctataaaagtcctaaaaaaactgtttttagtgatgatttttaattttatgtatataagcaatatcataaattacacttggtgttaaaattgatatttgcttcgattctgccaatactaaatactactaacactactaacactacaaaaaataagcttaaaacaaaattaaaccgattttaataaatataaaaaaattcaaagaaaggtacctaaatgttagacaaagttttaagcaacgatagctttaaagatgttctaacagaatcagttaaatcagaaattgaatctgtgtttaatgaagctgttgaaattaaagctgttgaaatagctaatgaacaaatcgaactcgaaaaaatcaagttagtagaagagttcaaagaagctaaaaaagaactcgaatctaaaattactgaaaatatagattcattcatcaatgaagaactttataaatttaaagacgaagttcttgaaaaattagacgctgttgttgagaatgaaaaggctgctactctagtaagtatatttgataacttagtagatgttgctggatcaaacatactcgaaaattatgcaaacaaagattctgaattaagtgatcaatttgataaattagttgttgaaaatagagaacttaaagctgaacttgcgattcttcaagaatctaaaaaaattgatgaattagctgctaatttaaatcttgtagaaagtgaaaaatttaaaaaattagctagcttggtagaacgaggtgaaggttttgaatctaaattagaagcgttatttgaagcttgtaaaaaaacaaacgaagatgattctgatgattctgatgattcaaaggattcaaaggattcaaaggattcaaaggattcaaaggattcaaaggattcaaaggattcaaaggatatcaaagaaagttttaaaaacaaagcaggcgctgacattaactgggctaactactaagttcaactaacaagctcagttaaaattcagttaaaaaataaatatataaaaaattaaaaggttaaaaacaatggataaaaatgtaagtcttaatgaaaaagtagagtcttatattaaagattcaaaatatgctgctttaaatgaaagtgaagctgtattgatgagtacattgctcagcaacactgctttagcatctcaaggtgcacttgtaggtgaaagtgttatctctagtgatatcgctcaatttacaccaatcttaatgccaattgtaagaagggtttacccagcattagttgctaatcaacttttaggtattcaacctttaacaatgcctacaggttacatttatgcattagtcaatagatatacaggtaataaaaaagacggtgctatatctccagtttctaaagctcaaattcttgtgtttgaagctaatgtgactaaaggtgatactgttacaggtacaacttcaagtgcgacaggtaaaattatacacgttgaaaaagatggtaaaactgctttagttcagttaactagcgataaaaaattccaaaacgaagctgctgataaaggaactaaaatcgttaacgtttattctaacgaagctactttccataaaatcttagaaacttattcaggaccatatagtacagctgacggtgaaaaacttgctgaagatatgaacactgtaggttttggaattgaaaaagatactgttgaggcaaaaacaagaaaacttaaagctgaatatactttagaaatgtatgaagatttaaaaaatcaacacggtgtacttgcagatgaacatttagctaatcttattgctgctgaaatgcaaactgaaatagatcgtgagattatcaatttcgtaaacaatacagctaccgttgtcgctgatactttaagtccaggtgctgaacacaaagaagctggtagatgggaaattgaaagatatagatgtaatgctatcaaaatagatttagaagcaagaaacattgggttaatgacaagacgcggttcaggtaatacattgcttgtatctccaaaagttgctactatgttagatcaaatcggtacatttaaatttgcttctagttcaagtaatatagctactgatgtatttactggtaatgtagggacttatgatggtagatataatgtaattgttgatcaatatgctaaatctgattatatcactgttctttataagggtacaaccgctcaagatagtctcggattcttctgcccatatgtaccattaagcttccaaaaagtaatgaatcaagaatcaggacaaccaggtatgattgcaagaacaagatatggcttagctactaatccacttgaaccagaaaattacgcaagaacattcggtgtagatttaacaggaactattttagcttaattgcttcaataatttggggatgttaaatccccaatctaatttttaatacataaactgaaaaaactcttaaaattcaatttttaaatccttaaataaataataagattccaatatactttagtcgttttagcctaaaggcatcgaaattggtttaagagctcaacaacgaagcttgatgcagttcgagagactttttgtaatatcaaatcatattaaaaggattaaaatggcaaatttacttagccctggtatccaggtttctgaagtagaccaatctcaaattacgcctgttgaaggtgactctgctgccgtttttggtggtgattttgagaaaggaccagttggtgtacatactttaatctcaagtgttcaagaactcagagataattacggtatgcctaatacaaagaattataatgattattatcaagttcaaaatttcttagcttacagtggtgcaatttatgtttctcgtgcagcagacatcaatggtacacccacacaattagatggcttacaatttgaagaaaatgcatataaaacaaatgttaacgctagtaaaatcgaaggtgttaaagttatcgaagttgactctgtagacgttaaattcgaaaaaactgataaattcgaagttggtcaagttcttaaattcaacgattctaataaagaatataaaattaaatatgttagaaatgaagttaagcaaataccaaatccagattatcaaccattaacccaattagtagtggacccaagccaagtaagtgcttatgttgatgaagttgttagctacgtaataacaaccgatgcagaatcttatactgtagaaacagatagacctgatgtggttcttgttaacaaatctaataaatctttaactgcattaaaagtagggactgctattgtaacttttaaagctactaaagaaggttcgagaactaattcatttgaattaaaattcgacgttcaagaaaaagaacaaacaaaactttaacgtaacagccgaagatgccgatccaagtggtagagctaaccaaaaatctaaagctaagaaaggataataaatggcagatatctacgatataccagagtttataactcaagaagtaactattgttactttagacaaagaaccaggtgaactaaatgcagacacttcagtatacttaatggaaggtgaatctcaaccagattctaattatattttaagtcttagaggtgctaacactgaattaaaacgcggagatattatagcattttctgatgttttaactgatccaagattcagaatcttagcaatctctgacagtatagtcaatggtgaagctttcacaaatattacttatgaaggaactgaggattctgaagctattgttgaagcaactaaaggttttccagtttatttagttaaggctactaaatcatcttgtgttgaagttcctgtagaaggttctgaaaccaaatacgatgcggcagaatatgaactttatgaccatactattagtaacttcaatacatttgatgaagataaattatctaaaccatttgtttataaagatgcaaaattaaaaatatttgctaaaacaccgggagagtggggcaataaaattgatgtcgcaatcgcacaccctgatgatttcaacaaaggaaaatatatcactgatggtataccattagattctcaatttgattatattccttatggtgatcaatttgctgttattgttatctacgcaaacgaaattcaagaatcatttattgtaagcttaggcttaactgataaaaatgagaaaaatgaatttacttatatagaaacaatgattaatggcaagtcaagctatatcttagtttctgtaaatgaagcagttcaaggtaaaccaaaaacttgtttaggtgaagatttacttaaacttgaaaatggtatggattcagctccaggtattgacgatattatagacgcttatacaatttttgacaacaaagaagaaatcgatgttgatatcttaatttgtaacgaaacttatccaaaagcagctactgatattgcgattactcgtggtgactgtatagcatttatgggtgcaccaaaaagttgttcagtgggctataaatctacaattgctaatcaaaaaacacttgattttagaaaatctttaaatatagattctaaatatgtaactttgtgtagcaattacaaatatcaatactgtgctgagcttggtggttatagatggctgaacttagctgcagatattgcaggtcttaaagctcaaacaaattataatcaagctaactggtatgcagctgctggtcttaacagaggtctcattaaaaactgcgaggcgttggcatatagcccaactggtgcgatgcgtgatatactttacaagaatggtataaatccagtagttatgtttccaaacactggtgctgttctttggggtcaaaaaacattacaaactaaagcttcaagcttcgatcgtgtaaacgttgttagcttgtttaaccatttggaaagatctttagggcgtatgtcgaagtatagtctatttgagttcaatgatagttttacaagaaattaccttgtaagtattatcaaacctttcttggctcaagtaaaagctggtcggggtatacaagattaccttgtgatttgtgacggatcaaacaatccagcaagtgtaatcgctgcgaaccaactcgtcatagacgtatatattaagccgacttatgttgcagagttcattcatctcagattcacgaacgtcggttcaaacgacttcagcattgttgtaagctaaacccaaggttcaatttacaaaagattcaaggattttacgatccttggatccactgaaacttcatatttccacaatcgtatattattctataaccatttagcatcatattagcactttctgaaagactagggtcgaaaatctctaacttttcttttagcttatgtttttgaaattgatgtctagccagcaattttaaatctttgaagtaaaaataattcggttctgtattctctacgaactcaaaacctaaggttttatatattgaccctttactaaatcttctattagcataactcactatactttttggtttataattatctaagaaatacttaaataatttagaagctcctcctataactgaacaatattttaaagtacataatcttattaattcatattcatagtttttattaaatctaggcttaccaaatgtcataacttctactaattcgttattataaaataaacctaaattaatttttgaaactgtcgatttttgtaaatgattctcatttaaaaagtcaactacttcattataacttaattcttttataatacattttctagcataaatttttttatttaatcctagtttattattaatcattgaaaaccatatatctaaatcatctgattcaaaaatatgaaataattgtattcctagggcttcgcacatttctgtcttttttaaatgatattttttatcataatcaggtgtattaaacattttatgtttatgcaaacctctactatgaaaaaataaaccatcgtattcaattgctaaattataatctggtaaaaatatatctaattcataaggtgatataatagatcgcgagttaacgactaggttatctacttcgagcgatttcgcaattttactttgtatttgtgaacgacacgatttattaggagctgatatattaaattttttcttatattttactgctgtaacatccgatatattaaagtaactcataaatgcttctttattaaataaagaatcattaataaagttttcttctataaaatctttgtttaaatcactccatttagtaatatggctagctccacattcattgccatagatttctaaatttgtttgttttcttttttcactgagttctgctagctcttttgcagatttagaagcccaggttttactaacagcttctttaaattcttttgtttgagaattacagataacaccatatttttttagatttgtttctacagttttatttttaacaacttcactttgtgtcgcatattcagtattatatttacttaaattggtttcttttcttttattgtttatttcagtataatctgtattggctttggtgtttctaattttatcatttacttctggtatttgtgatacattttctacattatatttttcttttattgtttctttatgtttatctatattattatagttagcatcaccatatctttctaattttgtagatttgattttagctatgcgtattttgtcatattctggtgattttaggcattctttacaatattgtgtctttgtcttagttccacaaattacacaaaaattaggattgttttgtaaatccttgtagtctttgtatattgaatgaaattcctcattatatttagggtcttttaatagaatatcaataatttgttttctataaagtggatactgttttaattcaatgagtatttctttgaaagttttgtttagatctatcgttatatttttataagttactttcatttaaatcctattttaaataatgttattatataatattaaaacttaaaaatatattaaacatattttaaaatatttaaaatattaagtaagttttaagctttaatatattataattacaaaaaggagataacaatgttgaacttaaaagatttaaatcacaaatatattgatgctttatatcgatgtttgaatggcactgaaaatacaccaaacaaataccacttagaaccgaacgttggtatacacaccgaaatggttatggccaaagtcaacgaattatataaagatgatcctgattataaagtattaatattaggggcagctttacacgatattggtaaaataataactagaacaccatctaaaaataacccagaaaaaatacattttttaaatcacgaaaatgctggtgtgttctttgcattagatgttttacacgatttggatttaaatctatccaaacaagaaataatagatataattaaaatagtagcccatcacgacatttataaattcgatttagaaacccttaaaaaacgttatgtttatagagatttaaaattattatccaagttttcagttgctgatgctttaggtagaatcactgaagttccaaaagaacttcccgatttaaatattgaagcttatgatagatctaatgttgctaatgaaccagttttagaagtattagtaggattaccaggttctggtaaatcaacttatgtttatatgaatgataaagcagctatatcaagagacgatattttaatgagatacggttttaaaaaatataatcaagttgaatattcagatatttggagaaacttaacagattctgatcaaaaagaaatcgattctttatttaatgataagtttttaagagcacttcaaaagaatcaaaatattttaatagataaaacgaatacttcgattaaatcgaggcgtagattatttgctacttcgagcttggttagaaattatcataagaaagcagtagtatttttaacaccatatacaatgatattaaatagacttgaaaaaagaaatgctacaggtaaaataattaataaaagtgttgtggatgctatgatgaaatcttttgcaatacctacttatgaagagttcgattcaatagagtttagactttggttctaaacttaaaagcttaaattttaaaataatttaaactagagttttagtttttaacataagattcatagaactttaagttcaattataatataatatatgaaaaaggagttatatgctagtttcacacgaagttccgttaagtcttttagaaaaatcaagaacgtttaatgattatgattatgctttagttcatttatttgaaatctacccagaatacaaacaattttacatagattcattaaaaaagcgtagaatagtttatttagataattctttatttgaattaggaacattatacgatcacgataagtttgctaaagaagcaaatgaattaggttctatcaatcctagtaatttctattatatagtccctgatgctttaggtaatgctagtgcaacaatacaatcttttagagacttttctaagtttagtatacctggtaagaaaataggtgttgttcaaggtaatactttagaagaattaacagattgctttaagtttatgaaagaaaatgcagatatggtagctatttgtttttcaggagactacttctatgaatacgaaggtgatactaaagaagctaaattaacacaagcaaggatagattttataaaacatttagataaattaaatctattaaaagattctaaaatacatttattgggttgtcaagttcctcaagaatttaaaaattataagaacattccagagattgtatctttagatacttctaacccaattgttcacggtatatataatgtaagatattctaaagatggtttaagaactaaaataagtactaaattagtagatcttatagattataaaggttccgccaatactattttattaaatattatggattttagaactattaatggcctttgatatggtttaaatagccaaaattaggttttaaaggggtttaaatgaaaataggatttacaggagtttcaggttctggaaagacgactatagccaaattattaaaagaacgatataatttggatattattccagggcctggaagaaaattaaaagaattgggttttaatataaatgaagatggtgatatggaaactcaaaaagcagctttgcaaattcatatagaagatcttaacaaagatggtatatacgaaagaacaatattagatgctgtagtttatactaagtatttagtagagattaaaaaatcaatacctgatgtatttttagatttagctgaaatagtttctattgaattaatgaaaaaatatgatatagttttttatattaaaccagaatttgatttagttccggatggtgtcagatctactgatttagaatttagaaatatttgtagtaattactacgattactatatagatacctatggtattaatgtagttaatttaagtggttctgtagacgaaagatttaaagcagctgtcaaaattatcgacaaaagatttggaaatttaaggaacttttaaggatacttagtatataattataaatataaataaatataaataaattagatcttttaaatatcattgttaaacagatttagaatataaccaaaattgtgagcatttcggatttcctgacagagaaaatcatagtagagtcactcctttttctttagattgcaatgtaacttaattgaaagattaaaaaatttaaaaagtttaaaaatctgaacagagagatgctcacaattttggttatattttagttttaaattctaaacttagaatgttagaactataaagacttttatgtgcagaacaccatacatacttcttatttaatcgggaatttgttagtataaacttagcacaccggaagtctttatagttctaatcaatgttcagaatagtctctaccttgctaagagataagcgaactgtggatacttctataatatttttatgaaggactggaggtagaacactaccacaaactcaagacattctttagaactcgtatatcttttctatccttatatttttgaaggaccattacttgctcctatcagaagatttcacactatagtgtcgtattttaattttagaacttaaaataatcttaaaccataaaaatcatcaaaataataaataaaacaaaagcaaaggaatggtttaacagttatgtctaacaaaattgaagaaattaaaaacgcactaaaatctggtgcaaaagctacaaaataccgtgttaaactttcatttccaacagaagtgcaacataaaatggaattacaaagcttgaactgcttagctaaagctactagttttccaggtgtaactattggacaaattgaagtatttaaccaaggaagaaagcttcctatacctggtgatacttcgtatgatacacaatggactgtgacattttatatggataatgcacaccaaactcgtaaagacttcttaagttggatgaaagcttgtgataacttccaagcaaatacacattctggcaatccaggaggtttatttacagaagtttcggtctgtcaattagattcattagaaaatgaagttgctgaatatactttaagaaactgctggccgagtggtgttggtgaaattagtgtcggtgctgatcaattagatacattacaagaatgtgatatcacatttagcttctcagattggattatttctaatggatctgaatttaatatgccacaagatggtaaatcagctgctactaacgtagtttctgtagaccaataattcttaagagtctggaaatccagactcttaaatacttcaaaacagtcagaaaatggatagtttaaagttagttaaaaatcttattaaaaccaaatcggttgaaaaaggacaaattttaaaacctggtaatttagtaatttttaaatataatcctaaagataccagtgttaaatatgatagaactccattgtgcctggtactcagaaaatctaaatcttataccttaggtataaattttcactggtgcccgataccaatgagaaaaatgcttttaaatgccatatttcgactaaataaaaagaatattaaagagaataaaccattagatatagattggtatagaattaagcctatgctcaaaaagtttggattttttccaataataagactttatattaatagcagaatatatagaagagcagtcaaaatacctaatgaaaatatgaaacaaattatagaaactaaaacagaaacttttataggtgtttctgcagaagctttgtataagaaagcgcttagggattcaaaagtttcaagtaaatctaaaaaataaaacatttttttaatttaaagcttataagattataacatataaacaatctaaactaaagtttaaatttttgtaatttaaaactcaaggttattaaatcataaataaaatcaaaagccaaaaggctccaatgaaaacttatgtcgttgatactaacatcattttagatgatgtaaataatctctcacgtttatacgatagtgaaaatcgtattataatccccgaaacagttattgatgaattagatgccaaaaaatcattattcgatgaagttggataccaagcccgtaattttgcaagacttttatcaaatcttgatgtcattgaacttaataaattcaatgactatactgagacaacactgggtgattctcttttaaaagtaactattactagtaaaaaagaatataaacacgcagatgaacctattaatattctaaatgatagaaaaattatagaagttgctaagttatatccagattgtatttttataacatatgatagtatgtgcaagataagagctatatctgaaggggtaaaaactgagacattcggtttaaaaaaagattttaatgaagttccagagttttttaaagttctcgatgttgagaaattaccagaaaatcttagcagcattttaagtgtagatccagattataaacacgaaaattataactacttaatacagagtaaagatggtaataaaaaactagcaaggatacaaaatcacagaattaattacatagacgaaaaacacttggaaaaacaagatgtcaaacctattaatatccgtcaaaaatatttcgtggatgctatgctagatactaatgtagatttacaagttgtttctgcagtttcaggatcaggtaaaagcttattagctattgcgactggtatcagattagttaaagaaaaacaatatagtaaaattgtttatatacgtaactcaattgaatctttagataaaggtgaagatattggatatcttgctggaaatgacgaaaagtttgcggtttttaatcacccactatatgattctttagaatatattgttagaaaaagacttgaaaaatctaatgataataaatcaagaaaagttaaaattgataatttaaaaatacaagaaggtattaaagaaattattgagttatctggtatcgaaactatgtggattggtgctttgcgtggtagaacaatttcggatgcgtttgttattgttgatgaatcccaaaatatctctactaagtcaatgagcaccatattaacaagagttgacaaggattgtaaagttataataattggttcaaactcacaaatagacaatcaatatattaataagtataacaacgctttaacagttcttcaaaatgcagttaaaaatcctagtataattaatacttggggtggtgagttaattaatgtggttcgtggacctataactgagtttgctgaacaaatttttaataaagattcaaaacaagaaccagagactatgaaatcttttgtagattctggtattagcacacttgaagtgaatacaaatactgagaacttagaaacaaaattagactctgctagctaatttaatattattttaagtttattactatataattacattgataaattaaatcaaaggagattaaaatgattttgattttagaatttggtataatattgaaaagaagtatattaatacataatttataataaataagtttattataaggttaatctgttataattatgtataaaattaaactattaaaaggataacaaatgacgtttacgaaatttattaatgaagctgctattgatgatatgctcaaggagattaatgtagccaataacaaatcaggtctggccttcaaaaaagattataaagatatagaatcgcttgggaagaaagctttaaaaattctacacaagcttgctgatggtccacatagcaacaaacaatattataaactttataatgacttactgaacgaagtatggaatataaatcaatatctacttagctataaaaacaagatgccttggtatagagaggaactccaatcacaagaattgaaaagatacaaagaaatcatcaaagattatatagatgaaatcaagcaagctatgaaagatttaaaagccgattatgcttctgtttctcacattagtaatagaaatctggaagctatcataaaatctattatagacgaatataaaagattatataaaatagttgaaaaaatggcaagacaagccaataaagccaataagtaaaattattagaaaataaacttattggagaactttatcgtattacaagagtaggttaaaagtttataatctatttctaaaaatcaaaagcacaacaaagggtagttattacatatcatataagtttaaatttaataagtattatgttttcggtgataaaggagggaccatatttgctaaaaattatgaggatgctttaagaacagcagactggatgagcgataattcatatttaaatttattttaagtttattattatataattacatcaataaattggaggagataaaaacgaaattggtagaaaataaattattagaattaatcaaacaaaatggcaatattgttagcgaaagtgattttataatgctagagcaaagacttgatatagatgataaagatttaaaatttgcttttaaagaattaatcaaacaaaataaaattatgagtgtttgggtcaatccaaatactcatttatgtgttaataaaaaagatttcgagcattatgaaataggatatagtgtaatttatccaaaatatgacttagatgagttatggttataaaatactaaaaacttcagcacaatttaagtttattattatataattacattaataaattaaaggagctaaaaatgaataaaaataaaaaattttgtgataaacaatgcaataattgtacattaaatgctaattgttattgcacatacggtgagtgttcgtttggtgtcgaatatgttattgttatggctatagttatgactgttgtgttggtgattgaatatttttctcgataaaggaattaatttatggtaaaagccagtggtgtcgctattgtacctgatggtatcgagtttagtgaagagacgaatgaattttgggatgaaataactaataaatttttagaagtattaaatagtaatattgatattcttgtaaatgatggtggtatgaaaaaacacgaagctatagttcaagttttagaagatgtgaagatgttatacagaaatgattaagtaagaatgaatactaaaaatttaaattaaaggagattgattgaaatcttatttagaagactacttagaatctatctatgaaaacgaggacaaaattcctaaatacaatgtaaatcaatattttagatcaagtgaagaaattgaatctttagatatagattatgaaactattcttatagctaaggatattttgagaaacccagatgcttatacagaagaagaaatagatttagttttaagcggtattttttatattgcaaataatttaaataaaatttgtgaaataataaacacctcagaaacaaattatctcttagacacagaacacttaattgatatgcttatgttaggtgaaaatagactacaaaaattagacgacgttactttaaaatttgcgttgaatgctatagtgggtgctactatcgatttggtagattctttgttatttggtttagaaactttagcttcaattaaagctaagtctaaaactaaggctaagactgagtctaaaattgaagttaaagctaaaactaaaaattaattttgttttaagtaattttaatatataataatgtaaatccattcaaggaatattaatgaaaacagaaaaagttattttaggtgtagacataggttacagctttgttaaagtttgtgtaggcactggtgatggtcaaataattaaaaagtttaaatttccaagtgttataggccaaaccaaaaaacttgaaggtgttcaaaatgataatatagttcattacaacgaacgttattatatggtaggtgaagatgccaaacatttaccaagttctaatatcatagatttagatacttataagaatttagaatattttggaccattgttattgaatcacgcagtgaaaattgctaaactcagtaaagtagatttaatagtttcaggattaagtattgcagaaattaaacaatctggatattttcaaaatgtactaagtcattttgtggttgatggtattgaatacaattataatgtaatgttgttacctcaaggtgctggagctaagttaagttatgaaaaattcggaaatgattttccaaatcttcaaaaagaatacttaggtgattcaacatattgtattgtggatattggattcaatacattagatttagttcttgttaataaaggagttacttcaccagaattattcgaaggaatttcacaacacggattgatgaaaatagcttcgcaagttgctaaattagtaaatgaaaaacacaacagatctatttcattgccagaggctagagaaatcttagatacgggtgtttataaactaagaggccaaaaatatgattatactaaagaaattgaaggtattaaaaaagaatacttaagagaaattttagcattagtaaatgaaagatatagcaatatattggataaactagatttcttggttgtgctaggcggtggtgcacacattttcaaatcttcaagtgatggttatattcgttgtgttattaaagatactgagtattataatgctattggagaatttatatttggaactaataatatagattatattgaagtgaatgattaagacaaggagattttatgtttaatataagtaaaacatttgaatgttgttacggccatagggtttggaatcaatagtaaaagtaccatcaacatctaataaaaaatttaaagtatttggaaattaactaataaaaataacagtttaaatggactatagacaaacaatatgatttttgtatgggtcaaagagtttgaactcaaacattagatacaaaatataggatcgatagcatttgggcttgcagaaatcatcattcgcacagtggcgtaataaaactattcttaggttcagatgaactaatcaataatatagatattgatcataaatttggagaaattggaaggtctggtagttgtcgattttgtccctactagtgaaaacttatgtagttgagttctgggaaacaccaaaaattcaaggagcttttatagctccataattaatttttaagcttttttattatataataaaacaattttagattctagttctaagcatacgacactttagtgttatatacctggctctaaaatataaaactagaatctaaatacggttataaccactcaaaaacacggttaaaatcgactttaatttttttgttatgtaaaaaaaagtattaatttacgtttaaaggagtttaaaaatgatttctgcaattgaattatctaatattaccgtcaacccaagtattcaaattattcgtttctttaaagactacgaagaaacaagtccaggtaagttcgaattatccgatgattttgatctaagtactgaattattttttatagatactaaagaatctattgataatattattaaattaattattttggatccagaattaacacaaagtgtaaagtttggttcaattaaatatgattttattataaacaataaaaatttatatagaaaaattgttattaactcaggctctattattgacaagtttagtactataccatttgaatatggttatgaagaaccatctaaggatacactaaaagaattcaatgaatttatagaattaactacacgcaattatttattcaatacaaagaacccaaagggtataattattacaaatacaaaagatttaaaattcgatgaacttaatgattttttaagaaattcaggatcgcaaacatttttcaataccgatgctagagattttgatattcttagacgcgaatcaactatggtaactccggataatattttctttaatcgtgggggtgaattagtttgtgttaatgattttattgacccattaaatgtttttaagcgtactacagcaatgctgttagcatcttaagtattttagtatttagaatgtgctagcagcttaaaatgttataaatatacataaaggaaccttaaaagattttgattttagaattgattttaaagattttatgcataaaaggcaaaaaatgaataaatcagaatttagaatatatcgtggtattgttgttaataatgatgaccctaaaaaaggaggtagagttcaagttcgtatatttgaacttcacggaatgagtgaaaatgctacacctggtcaatacccagtaacttctggagaaaaggacactaaatataatcaaatacaggaaagtgatttgccttgggcagaagttatgcaaagtattgattatattggttattatccagcaccttcagatggttctgatgaatatgccaacaatatagatggtaaaggttctaaatctggatacaaaactataacaagatctggaaaatatccaggatttggttataacgttatattaacaccaggaacttgggtattttgtgttttagacaataataacccaaacttacctattgttataggctgcattgcaagtgaaaacgaaatacataaaaatgcaaaacctaaaaatactagagtatatgatagtattacaggtcattacgaagaatggagtgatgaagatggtaatattatttttcaccacagaactggcactacaattactatgaataaagatggggaaatgaccatcaatactgtaaagaataaaaaagaatatacacaagaaaataatttgttacacatcgatggtgaacaaaatgaatacgttaaaaaagacgttaatgagaaatatgacgctaaccacaacttaaatgttaagtcaaacgaaaagttagaggtaggttctgatagaactcgtaaagtaggaggtaatgaaaatgtaacaatttctggtaaccagaatataaatgtgtccggtagcgaaacaatttcagcaggaccaagtattactatgtctgctggagtcatcaagctaaactaaattcaacagctaaactaaattcaatgaaaggaattaaatgaaaatattcaaaaatattaagttcttattttatataatactaataatatcaattatttgtgatatagtgtctttaattacagcaggtaaggttgtcgtagagccagcaacttatgctttgattttagtagctatttgtatagaagaagttatatacactcgcaataaaattatagaagaaattaaaggtattgacgttcatatcaaattaaatgattatttaatatctgctagtaatgccaaaactagatatttaaatacaaagtctgaaaccgaagccaagttaactaaagacaaagctgttaaaactgagtctaaagctaaagaaagtaagtccaaagcatcaaaagctaaaactaaatctaaaactgataaagagatattaaaagatatgttaaacggagccaaataatgcctcctttaactagagttggtgttgattttagtacaggacattcttcgtttccacctaatgcaatttcgagtggttctgcgaatgtattaactaattcaattagtacagttagacaaggtgatcctatgataccacacccaagtcctagtccatcaccaccacacggtggaagtattgctacaggttctgggactgttatggtcaattcaaaacctgcttgtagaataggtgacgctattagttgtggacaagctgtagcgcaaggatctggaaatgtcatttgtggataaagatttctaattaaggagtaatatatgtattttatttcttttagtgaaagtataagcaaagatgttgaattaacgttatttgataataattttcaacgtattgctaataatttttatataaacgcgtctactaaaagtatgtcggatacatataaattcctttctgaaaattattttgaaaatgtaaaaatatattatggtagacttggagatctttcagtttgtgaagatggtaatcttaaatttttagaagttgataatataacaaagttctaacctatgcttgttatactaaaaaggctgaaaatactagacttataaagctatgaatacgaatgctattttaataggaccttgcaaatcgagaatccccatagatgggtcactttcgaatgcttttgaatatttttatttctcttggttatataataaaaatattattcttataatagatactacttttgaatctcttgagattgttaaaaaatatcttgaaattaaatataacattaataaagattgttttaaaaatattataatatttaaaaaatcttttatgtctattaataatttaattttatttgaaatgtactgtatagatcatttcgacagatataaaccatttttaaaatgcaagaatttatatgctttaagcggctcaaaaaatcatacactcgagtgtaattattttgtggaatacgagcatttaaaacctgtcggtaaatcagttaattatagaagtaaaatattttttgagatattgaataaacctagatttcaaaagaatcaaaaatttattaataccagagcaaaatacattaaaaaagaatctgaaataactagaagtgatttaaatattatgtctaatatatttgaacaatttaatgaaatgttatatatacaagatcctgtattttttgatgtaaaacctagattatttcaagaatgtcaatattttggcgttccttacgaatttatagcacataaagattgttttgatggggctaatttaagagcatttgactatgatttagaatccagatttatgagccttgaagaccctataatatcattattagtggattctaataagtgctgattctaatagtgctggtaatgttagatcataaataaatcaaaggagtttaatgaaacttatagattgttttaaagataataatgattctgcttatatttttaaaggttttatatatcattatatttttaaatatagaatacaaatacttcaagataaaagctatattatcataacttgttaccgtggtaaagataatgaatacgtagctataaaaccaaaaaaattcaaaaaaattattaataaattaatggaagaaaaacaagcagatatattcgtgatggaaggaactattaaattaaactcagtgaattctaaaaattttagatttactttagattctggaatgtatttgtatataagaaataaatcctagattaatctgggtacgaaagtactcaagattttcaaattactaaccgtattcgcatttgctaatcgtaagctaatagtttaataaacttttaagttatttctttatataatataattttaatataattttaataaggattttagaatgaatttaaaaagtcgaatttgtaatattttcagtgagttttcttttgagaagttaatagaaagattttttacggggttatttgttttgtttatagctatatttgtagttgttttatatacgtttatgttctcgtatttagtcagtgtcataggttctataactattgctatattattgtgcgtagtttttacaattatagtgttgtttttaggatcactcttagctgtataatatataaataaattaaagttgtttatataatattgaatggatttgagtatattaattttaacacgcaatagaccaaaattatttaataggtgtttagaatcactcaaaaaatatcgaattagataccatagataccataggtattaattacgaaatacttgtgagtaatggttctgatgctaaacattaggagttaaatgtgctttatacactagacgatattaaggacttagtgatatatcagatgataataaagtttattgtaatcaagattgtgctgatatgtatgcttttattgatcaatttgataaattactgtaggcgaacctaacgattatataaattaaagattctaattcattatgcaagcgctacgaacaattaaataattatttgaaaatataaaatgtgattatttatttttaaaaaatttttttaaaaaatatactgaaaaaacactaaaaaccaacaacaataatgcaattcatacaatttgattacaatagagatgatgaagacaatattaaacaaatgtataaaaattccacatttgatttgttagtaaattttttaaaatcaatttataaagaaagaatacaaaatttgaagataattattctatatttatggtaatatttttcctatggattttggtgtgtttttagtaaatgatgcagcacttcataaacctattaaagaatatctgcctgaaaaatttcataattggaaatttataagtactaatggtgattttaaatataaaacatattatataaaaatggttttgatgtgataccagttcgattaagacattgtgaattattcggtggtggtatacattgttcgactttagatttagtgagacaagattgaaaatacctaaaagattactatacacataacatctaattgtttactcaaatgtaacttctgttggttacaaaataataataaaactttaaatataatcaataatattaaattaggatggtgcagagattatgagagtgaggctattaaatgttttaatgtactgaattatttaacagacatatataatattaatatagataaaatagattttgatattgtcgaagaattagcataaaagattgtacgaaactgaatcactgaaatgcgccgaacttttaaaaaaatacactcagtgtgatattttttatatatgccctacaaataatggtgttgatgaaaataccaaaaaaagatatagtaacttaggtgtcaattatatagaaaatacatatagatttagatatgtaaaatatagtacttaataattataaaaaagatatgattgggttttcttttaaataaatagaaagaaagaatcatagtgttacgcgaagcaagggtattaaaattttataaggatactttgggtaaaaccaatgattcgcacgaagatgatatattagctggtaataaagtatatagagctgatgtagattttttatgctattcactatttaaaatatttaaaattgaagatattgctaatctcaaataaaaaccaaaggtttaaaaatgaatataaattatggttcaatcaaaaagttttttgggttagatccagatgaaattgacataatccaagaagtaggtgatatctttcaatttggtactctttggatagctttattttttatagctttatatcctatgaatatgacaattacacctatggtgtggctttatgtagctgcaggacaattattagtatccgctagtctaaagaaattggtttctaaatactttcctaaattatcagttagacccaatgggggtaaagattcaatgccttcgggtcatacgtgtgctgcttacgctggttttggttgtttattttttggtataaatgaatataatacaattttaattatagctactgtgatataatattttaaaaaaggagaatataatagctaactttaaagaatttttattgctgcaagagtctttgactaaaaagactaattatattaagctcggtgagaaatacattaatatgtttaatcaagttctggatgcaaagaaatatctgcaaatatctctttttaatgtagataataaacaatactattgcatcctaataatgaaggattcaaagttggaaccacattttggagtcttttatgaaaataaattcaatgagttggtagaagcttttaaaaataaagacacgaagagaatcagtgatttagtgaatagtgagctttttattcaaaaagatggttatctaaattctgatgtaaattttctaaaagtattatcatatgtgttttcagttttagtggattacctggcaataaagccgataggatttgtaaaaattatggggataccgagaaagttcaatctttatcaaaaggtagtaaaaaatatcatccaaaaaaatgagataccatatcatattgtagtagaagagcaagatgatagttattctggtaaaattactggacaaacaaaccctgctaagtcaatgattttaaagtataattttgcttagtgtgaacaaaatgctaaaatatgaaatatgctaaaatctactaaaacttcagtttaatttaagattattattatataattatattgataaaaacaaaggagataaaatgtacgttgctagatttaatgagtattttggttatgactaccaattaatggatgttgaaacagttgatattttagaaaatatctatgatagtttaggatatatgcctagagacccagaaccaattgatttagaaattgttttagaagaattctataatacagataaaatctatgttttatgtgaagctgatgatgaagaaattgaattttgttcttgtattgatgaagtagaaccagaagttatcatagattttttgaaatctaagggtcatacttttatggattcaaatgcttgattgcgtttgattataaaataaaggaaaaattatgttattatcgttttttatatatttagctggtgtttttgatgctcttaagagcacagctgtagtagtactttgtttaacattagttgttttttgtttgtcttttacatttaacgtggcgtcgtgcgtcgacagagaggatcgtttatataaaatgacatcaaaaagtataaaaatttgtgcgatagctagtataatatttggtgctataattattttagtacctagaagcagcactatgtatttgatggctggtgcttacgttggaacagaagcgatagaaaatccgaatattgttaataaattatctaaagttaataaaattatagattataaacttgacgaaatgttaaaggagcttgaatctaagaaattagattctaatatagattacgaaacaaattaattttgtgccggctaatactagctggtaccagtttgtgaccatcagtgtaaaatacacaaaataaataatcacaaaaagagagattatggactacttaaacccgggatatgaagctcctaaaaaaggtaatattaaaattacactagcatctttggtagatagctttcaagaatttttaacaaaacgtaattattttttatataatataacaactaaaactcaaataaatgatatcaaacaaacgaaagtttatagtgatttgcacgaacagttgagatctgtaacttatagtcatttttatgacgattatactttttatgctaaagatacctttgatattgagcgtgttaaattaatttttatgacttgttatttagatttacttgaagaaaatgatattgatttatctaataatgaattagttacaaataacgacgtcaacatcgaacattttgatttagcttataaatggtgcgatttcaatactgaattgataagaacaaaagcatacgaaatgggtatatttaaatcttaagctaaaggttctaaatggatgaaatcaattatgatgtattagaatatatcattcaagagcatttaaattgttctttgactcgtgaaaaatctgtattagattacttgaatttagaagcaactaaaagaaaccaaaaaatcacgggtgagactgaatcatttgtagtctacaaattcaaaccatatatgttaagtgatgatattttaaaaccttttattctgtgtacaaataaaaataataaaggttcttaatgatttataatatcgacaaatacgatataaaactctacaatgaatttttgaataatttatctaaacataacgtagattacacagaatacgtgtgtacaagagataataagttctatttatcaactcaattagagccttttattctggattatatccctattcaaaatgcttctaaaatgtttttgatatctaaaacaaaaggagttaataaccaagatgtataccaatatagaagacaaaaagtgacagcttctaaagataatttaaaattatgcattaatgatgcttatcaatatttcatagatttaaatcaaaaacagaaaaattctatattttactttgttaatatatcgaataaagaacgtgccgaagctttatctaaacaactaggtaggctttattattttgggttttattataataagtacagagtttatttgaccaataatcaatacacaacaaattacatagattctgaaaatattttagtaagttctaatgatttgtttgatgctgagatgcaattgaattataatatatttagattgcaggatagacttaaaaaatttagtcaaacaccctatagagaaaatggtactacagtgttaccaaaatatatagatccattttttagaactcaggttaaagttcaaactaattcaaatgctaaaaattaaaactttaaattaaaatataaatataatatatgaaataaaatttaaaactaaaatttaaaacacaaacattcaaaggaggcaaaatgcctaaagaatcaagatatacaaaagttaaaaaagcaccaaaaatgatttcagatgaagactttgctgaattcttccaagcagccatagattctaatcttaatgaagattttaaaagaccactcatagaatctaaatataaacttaaatctaatattttatacttaacagatgcttgcaattttgattgtgattattgttatcaaaaaaatgatagagatcgtttaataaaaaacacgtatatctctgaaagagaaattaatgatttttttaaagatcttattaagagagaacccgataagcctagcactgtagttatatttggtggagaaccatttttaaacccagatattgtttattatatttttgatttaactgataaaataacattccatactaacaaaaagtttaatctatcattgactacaaatggtgcatattttaaaaatactaaaaatgctgattattttatagaaagaacccgcaaattattaaatcatttttctttagaaatatcttatgatttatcaggaaactccagaagagtttacagaaatggtaaagattctacaaaagatactgagtttgttttaagttattttaaatctaaagactataaattaactatccgttacactgtacataaattaaattatatgaatgctttaaaagatttaataacattaagtttagattctaattataaaaaaattgtagttaatttctatgaaactgaattagaacaatatataaatgtatctgagtttaaagaaaccctgaaaaggcaaacttgtgaagtgtttaaaagaactaaaatgcctatttgtcatttaaattgtttggcttgtatgggttgtaattttgcagattttgatggtatatattaccaatataatgataaatcatttgaagtgcaagaaaatgcaaagatatttgaatcttttacagaacattcttgatttagatttggttcacaataaataaactaaaagtatgaactaatgaaattatctgaattaatacttattttagaaggcggcaataccacaacaatcaataaaaaaacgggtgaatctaaaagtgctgaaaaaatagattttaatagattgtcaatagaatcttttagagctgaattcatagatttattcacaagtcttaatagattgtttttaaacaaatacaaagaaaaactttgggctaatgattctttgattaaaaaaggtcttgtttttaatggttccacgagttatattatgaaccctaaaatggacccaaaagaaatctttaaatataaacaaagttccggagatattgatattgttatacctgctgaacaccaagaaaaactatgggatttattagattctttagaaggtaaaacaataggtaattttgaatatcacggttgtttttcacaaaatcgtgaaaaattaggagatcaattattaacaatattcgtgtataaacccgaaaacatagcttgccaaatagattttgaaaatgccgactttaaagatggaaaaccaacggaatttgcgagatttagtcacggttcaagtttcgaggatgccaaagaatctataaaagcatttgcacataagttattattaagagcgttagtaggagctatttcagcaaatccaaatatagttgtagctactaagagttctaaaccaggcaatatcaaattaaaagcagataaaagcacacctagaatggctcaattcagtgttacccggggtttgagatttggtttggttcctatgttagataaaggtgaacccgtttattacgaaggtaaacaagtatatcaagaacaagatactagtgattcagaatttataacagatttaaaagaaatatttaaatatatgtttaaatcaaacgtgggaataaaagatttgcatagttttattggtgttgttaaattaatgaaaaaatactgcgatgaaaaaactattaaattaacacaagaaagattctttgatatcatttttggaatgccagcacaattcatagagccaaatgatttgaaattagatagacaagttaaattaactgcttataattatttcttaaaagaattacgtttaagacatccaggattagaagcagatatagatagatattatgttgttaaaggttctaaagctaaagctaaagcttaaaagcttgaactaaaatagcttgactcagcaataaatatacaaaaagtagggttaaatggctgaaataaaaactggtattttattaagacgtaatcttaaaaaacattttgtaaatgacgcaaaaccaacacaaggtgaaatcgttcttgctatcgatacaaatgaaattggtatgcttgtaaatgatgaaatacaatggactcctatccaaggtgttgttaacacggttgcgggtaaacaaggtgacgttgaattaaacaaaaaagacgtaggtcttgaaaacgttgataacactgctgacattgacaagccaatttctaattctacaaaattagaatttcaaagacattatacagctgaaaacccacacaatataacaaagaaaacgcttggtttagaaaacgttgataacactgccgacatcgacaagccaatttctaacttgactcaaattgagttaaataagaaaatttcttgggatgatgctagaaagcaagccggtgggaaagacccagtttttacagatactacttatactattaaagatggtgagctttcagaatttaactttaattcatattataagaatttcatagatacttttaatactaattccagagttttaccaagcacacaagctcttactgccaatggtagaacaataaccttaagaagagctgacggctcaagtgaaagcatagaaactcaagatactttatatgatgattctgaacttagagcattaattgaacaagctaaaatagatttacatataaacatacaagataatttagaatcagattctactaaagatgctttaagtgctaatcaaggcaaagttcttaaaggtataatagacgaaataaagaaagtaattaatattacagatgatgattttaaaaatcttcaagatattattaattatatagaagaaaaccgcgaaaaatttgatgatttaacaattgctaatatcaaaggcttacaagctgctttagattctaaattaaatagggatgattctacatatgttgcaccaaattcagcattattagaatcacacccagctagtgattttgtattaaatacaaattataatgctaagttaatagaaatacaagattctttaaattctattaattcacaaattaaattatttgaaacgcaatcaggtgtagattctaaaataaaccaagcaatcagagatttaaatttcactgaaactatacagagtattaatgaacaaatcgcaagattacaaggctctttagatggtattgatttggatgctataacagaaaatctccaaaaagttcaacaagatttaacaagcaagatagaacaattagaaaccaatacatctaaaaaaatagaagaatttgaagttattattaataattttgatatgtctgaaatacaaaagactattgaagatttcaaaaaccaaatcaatcaaaatattgatagcatacaaggtgttgtagattctataacaaaatcattagatactattcaaaatcaagtttcaaaggatatagcaaacaaagtttcaaaagatgagttagctgctgaggttaaaactattaatgataacattactcgcttatcaagcatagcaaatgaagcaaaatggcaagataatttttattgtaaagttgaaagaaaacgacaatctttatggtcaattatatcaatttcaaaagactctttcaaaggttcatataaaaaaccaaatacttataattactgggaagcaaaatataaaaatcttaagtatatcaatgataattttgataacttagaaacaatatctaatgcacctacatacgacgttgttactaatcaggttattaaattaacttttagtgatattgcggaagcatcatttttaattggaagtcctaagaataaaattcaaatagctaaaattatagcagtaaatgctaatactaaaaaagctgtgtttatatatgggtacccaagttttatgaccgacgatttgtcaaaaattatggtaactatagaaaaagattcaagttttggtaattatctatcaagagctaataaaacagatccagaaacttttcaaaaaattgtaaccacgcaagaatttgatttacctgacgatactgatgattattcatattttgaagctagttatgaaatatctggaaatataataacattaaccatacctgaaaatatatttttagaattctatggtaatatgacagcagtggaaacaactgttactggttctaacgcagctcaagtctggtcaacgactttaaaatccactgattatgaaggtaataaattattctcaaatggtgtgttgataggaaaagatttaaccggagaaatcttaactatatatgataataaatctacatacataaataccttgggtgaagctagaactaattataatgattttcaaataatacgcgaagaatacgaagatattatgtatacaagggattttttaccaggaactatagaaccaggggatgatgagttagaatggtaataacttttaaactttaatttaaacattaaaagctctaagatttaaactttaatttaaacattaaaagctctaagatttaagaattatttaagtcaaaatatattataattataaaacaaaaaggaattatatgttagaattaagcaattttcttagatcaccattcttagatatgcctagcatatcatttaataacaaaaatcttcaagatttattaaaaaatgtttcagaaacaatggaaacatatccatcatcagttacttcgtatttaacaactgaaactagttcgggaattgatgttgttgtattagcaccaggagtccaagaagatggttctaaaacaattgaattagactttaaacctgatgaaattgtagttagatataaagttatagatgatgctaaatcattttttataactggttataatacaatcagagttagtttggattctgttaataactttaaacttaaacaaaattcatttaaagctagaaatggcattataaccttttcgttagaatctattaaagaaactaaaaatacatacacattctaataacttaagcctttggacaaatactaaaggcttattaaccacaattcataaataaatatacaaaaagcaaggattgtgatggcttttacacacaaaaatcaaaaaaccttttatactgattatgctattaaacacggtatggtacctactgaagatactataaatctatttcaagttcgtcttaaaaaagagacaactgatatctacaataaatttcaaatagtaaacggaaaatcaccactcgagtggaatcaatctgaaaactatgaggttaatgaaattgtaagatataatgaagtagattataaatgtgtgcaagaatgtgttaataaagttcctagtgaggaacctagtttttgggtcgttacaaaatatcaagaatatactgaatttcccgccagtaattacctagctaaagacaatcaagatccttatgatcctagttcaatgcaagattatgaagaatctaatacttttcacccaacaaccgttaaacacgttgaagatcgtctaaaacattggtttgataatgaaactgttacaaatgctgatagacttgatggtgaacacaaagattatttctgctctaaacaagagtttgatgattttgttagaatagcattgactgaagaatctgtcgttgatagtttagaatctgataatcgcagattaccattaagtgcttaccaaggtaaggttcttaaaggattaatagatcatatcaatacaattttaacttcaaatgacataaacttagatgaacttcaggaaattgttaactggattaaaacaaatagagatatgattgaatctttgggtattgattctattaaaggattaagagattatttaaatcgcatagattctgatctgaaaaaaagagttacttacgattattggaatgctgaatttctcaataaaattaaagaagtagatggacatttatctggagttgatgctgatacattagatggtcaacacgcaggttatttcttaccagcaagtagatttacaccagaagaaattgctttattacttcaaaaagtaccaggatctttgggtaaaatagatgctgataaattagatggattagattctaaagatttcttgagacgttcaaccagtgatacccctactcaagataataaatttagtttaggatctacagctttaagatggtctaatatatatgctgttaattttcaaggaactgctttgcaagctaaatatgctgacttagctgagtattatgaagttccagaatctattaaatcgaatataaaagcaggtcatatattaggcatagatgcttgtggtgtaaatttatttaacccaggtatgaaattatttggtgttgtttcaaaaaatcctggtgtaattctaaataatgaatgtagcggtgttccaattgcattgaaaggtagaactccagtttattgtaaaaatgaacctagtgtgggtgattatatctatgctgattctaatgggttgggtattgcaagtgaaactgaattagatttaccattagtgggtatttgtataggttctataataaattataaagatttttggatttgcgagatcaaaatctaatcaaacataaggagtattataatgaaattaatgatttaattactaaaaactcgagtttaattttttaaactcgagtttttaattcttatatattatacaatattatattttaaatttaaatttttaagttttaaatttcgggtaataatatgcagcgagttccaaattcaacaccttgtgtatctttttggaattgaacacttgaataaaaactatctttaaaacttgaacctactataggaaatgttaaagtatctttatacgttggatttcctctccattggaaagtttgtcttgtggtgtctacggtagcatcttgtaaaacactccattttggaataccgcaagaatctattttatactcagaagttgttcttacatttgcgttattgtacttggcaccaacatccttaaaataacctaatgggctatcagagtcactgtttatataagttataatctctgctggtaatgtagtttcatcataattattagtatctactaaagattctaaatctaaatctgttatattagtgctttctttgataacaccaaaataacttctatctaatatataaccatacatagcgcctatagccagattaaataacccgcctactaaatcaacaaccccacacgcgtgaccattatgactaattttacccattttagaatctgaaacactacctgttctgtacaacgcgttagtaccatctgtatacccagcagttttataatctaaattatgaatagcttgaatatctctttgagtactttgcatagtattcataccttgaataaatgcaaatctatctgttcttgatttagcaaactcaatattattgaaattatttgaattataagcattttgatatatacatttagacaacaaaatcaaataattataagcaaatacagttaatacttgaaattcagggcctctatttttaacagcttctaagaagcttgaatttctattcttaatagattttaaatcatcagaatctaaatcagaatcttctgtaattttattacccaaagcaacctttgcagaaactcctgagattaaagctacagagttaaatttagaatcacaggttaaaggcactgtattacgcctagaacctaaaatacccccttggttagatgctagatatttgtctataaaaaaacctggaatttctttaccattattaataaatgctctatggcaccaaaaaccttcttcttgagtagcggaaacttcaacttttaatccgtaatatggtgcagcgtctacatttgaagtcttaatataaagtttaggtatccaaaccataacattaccgcggatatcagtataatttccataattcatatgaccaggagtaaaagttcctagcataggatacatattatatttgttagtaatttctttaggtgcaatacccacgccaaaaccaatatcaccaagatttggattacttggaagtgcaccagcaacttctccgtttccgtttatccagcgatttttattttttgttttatctatacaagtccaaataactccagtagctgtatttaaaaaagttgcactatcgattgtaggatttatagaagctgtgggatcatttgattgcttatagtttatagaataattatcaacttgtgtatgcaaagctttaacatcttctttaaccggatctaatttttgatctattaagaaattagcggtattggtatctatagaatttttaattttttcataattatctttaagttcatttatggctcctactgctgtagtttttgcttcggtttttaatgttgttacatcaccaatagtattgacttttttggttaaatctttttgcgtgtaagcaccaagagctaaatctctcattacgaaccttttatgttatttatttgaatctatataagaagcctttaagatattttataatataatatcccaaaggataaaaatgaaaggtaaaaattttagcttaaactcaaataaacgtaataaaaatgactattaccaaacaccttatagtatgactaaacaactattagaagttgaaaatttcgaaggaagtatactagaaccttcttgtggtgctggagcaatagtcaaagttctaaaagattataataaatctgtagattattgtgatttaaacaatgattttagtttaacaggtatcttcaaagatttcaaagatttcattaatgatgattttgatagatatgataatattataacaaatccgccatttagtttagcaaaagaatttatattaaaagctaaacaaatagcaaataataaaattgcaatgttattaccattgaattatttacacggggtttcaagatataatgaaatatacaaggatactgattttccattaaaaactgtttatgttttttgtagatatggtttacttgaagatactattagagaagatggaacttataaagctggtatgatggtatatgcttggtatatttgggataaatcttataaaggagaacctataataagatggctaaataacaacgattatatagtcaaatcaaataaaggatcttaatggctaagttcgttactcccgcagggaatttacttaattctttaaattctaagaaccttagaaatgttcaaaattatagccaaacgatagtttggtcttttgaaactaatgaagagtttatatctgctagaatagttgatgaaggtgtagaacacgtccctaaaggcctaaagaaaacttggacacccacttctttaactctttctggtctgccagatgatgttgatttgtatcacccaaaaatgatcacatatctttggagtggctttaagttggatgggactgaatttaaggatactaattatgaagaaaaagctactatagaagatattaaaaatcaagatatgcactatactggcaaatcctggggaactaaaggtattgctggatattatagggataataatatactaacatttccttttactgtagaagttacttattgggaatattctaattcgggttcaaactcaagttctggctctaaaaatatctaaaaatactcgtgaatctggttctggtggacttaaggttcaaagaactatagctcaaaattattatattacagtagttcctaatatggatccagcattattttgtaaaaaatatggcgatgctcacggatttaaagggcctaaaggcgaagactttaattacgatcaatataaagcttatatggtttctttaggcttagatttcttaactatagataggactcaagcgacttaatacattgaaatatacttaaatattgctttaaatctaaaatcgatttaagccggtttttgagcctctatacatatatttgaattctactaaaaatatacaaaaaaatatctgaaacttcaatttaatttaagattattattatataattatataaattaaagaggagattcagatgttacaagacaaagttttaaaaagttacagagattctttaaatcaaagattgtcaatcttgatcaaagacccagaaagtaacaaagatatcatatctgatattaaagttgaaataaaaaagatcaataatatattaaacagatcttacaaccgcggttaattcaaacaagactagtaatggttagacaaaggaaatataatggtagattttaaaaattttttaacagtaaacaaagtttatatcgataaatcagatataaaaccatcgcaaagaaatgtaaactcagttctttataagttgcttttaaaaggttataaaccaagccagacattgttagaagctattaataatgcttcagattctgatcttaaatcatttgaagaatctatagtattagctgcaggcacaacattctataaaaaatatactcataaattaagagatatttcagattatgaagatcaattctatcactatgtcttaagatatatttttaacttagatactcacgattatactctaagtattaattttagtgatctaataccaaacaaagaactagttgaattagatttaatacaagaatctgaaattgaaaaaattacaaaaaacatcctagaatctcaattcaatcctacggataatgaaaaagatatcataataaaatatggttttaaatatatgccaagtaagattccaaataagttagctttagaaactttgatttctaatttaaatcctagtgaagctctggaattctctaaaaaatacaaaccagaaaatgttaatgcggtcagaactattactaaatgcttaattaaatctgaatacgatttagatatagacaaattagatagaatttacacaaaagaattcaatttacctagatatattaaaacttttgttatgaattctattaatgaattaaaattggatcgtgaaactatattaaatgaaatgttaatatacaagaaattctggcaaaatatacagtatttaatcgttacaacacaaaaaagatataaaaatctaatagttgcaaactatgtttttaacaaaatattaaaaagagattataaacaaacgggtacttatagaatcagaactttactaaataacccagtaaaatttaataatgcttttattgaaatttataagtataatataaatttagcttataaaaatgtttttaatttagcagctaaaactaataacaatgattttagtattttgttgtatcatagacctaaaacactcaaacaattattggatttagttcttaattataaaagaactggtaaagttcgtatgtctaatatcaaaggaaatattttatattttgatgaagctaaaaaaccaagcggtaatctttgggaagtcttaagtaaattattttcaattttattacaatctaaaaaagatttaattgattttggctcagctaaaagaatagcaatttctgatgatttagaaactatggttcctccaattaaacctaaagattctttaaaaactgatatattctttccaaaaggatccagccttagaatagattctaaatttcaagtattcgttgcttggaaaaggaaggataattctaaaggttcgttagacttagatttatcttgtttattcagagatagttcaggttcactaaagaatgttttggattatacaaaacttgaaactagcatagatggtaagattcaaatacactctggtgattggaccagttcaagaagttttgatcctaaaaatccattaattacagcagagttttgtactttgactttagatcctaaatcagatttagaagtatatgtaaatgttcatagttacaacaaagtttcactcagtgaatatgatgtaattgttggtgttctaccaggtgatactaaaaataatgatggtgttataaatctccaagatgctatttttcaattcaatgttgatgtagatttcaaagatatatgtacgtttagaattcaaaatggtttactgcaagttattggtgaaccatttaatatgagaggttctcactcagggggttatggttttaatcaaattgctccaatatatgattattataaagtttataatcaaatgagtttaaaaagattatttgaattaattgtaattcataaaggtttaaaacttgtcgatatcaacgacaatccagatttagtagttagttctaaactaagttctaaatacagctctgaatataaagtttataatgtaagtgaaaacgcaaacgaactcaaagagttaatggtaaaagattaactctttgattctattaagtttgattctggatttataggttctaccattggctcaattggaataggtactgctggttcatttggtatactaggagtgttatcattaggattagaatcaaactctaaagattctacacctcttgggtctatataatatactttaaaatgtctatcatttttaactgcttcatttaaaacattaatcaaatctttattattttctattctatcgtctatcccatttttattaatatctttttctggtgcaaacttactagcttgataaacaattttttgaccagaaacatataagattatcgacccaccaaaagatactaacaaaggttctaatcctagatttgcatcaaaaaatctattaagaattaaagccaaagaacatataaaaaagttctgtattataatatgcctatttctttctgggttaccataattagcagaatctttagttcctttaaaagtggcaataacagaagttgttctgtcgacacccacatatacacaacatagggtagcatatagtgtggttagtgtttccattgggacttgaaagtttttattaaagatacccgaacctggtatataataatctatgatataatctaagcattgaaatattaaacaaactgctgtgaatataccaaagaatataacatagccagcagtgcctttaatatttttatgtaatttattagtaaaataatcagatttaatttcttttgctgtatacgtagattcgttagtttctttatttaaatacatatgaaccttttatattatttatgtcgttttagagtttaagtttatattaagtttcagttattatagtatatactactaaaaagccaagcattttttatactttttaatattgctttaagttttaagcatatactaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatataccactaaaaactcaagcattttttatactttttaatattgctttaagttttaagcatatgctaggatataatactatagtatatactactaaaaagccaagcattttttatactttctaatattgctttaagttttaagcaagcattttttatactttttaatattgctttaagttttaagcatatgctaggatataatactatagtatataccactaaaaactcaagcattttttatactttttaatattgctttaagttttaagcatatgctaggatataatactatagtatataccactaaaaactcaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactatgaaatatccaagcattttttatactttttaatattgctttaagttttaagcatatgctaggatataatactatagtatatactatgaaatatccaagcattttttatactttttaatattgctttaagttttgctttaagtttgatagctgtattagtatataaataaactaaaagaggaactatgcaaaaatatgtagctattgctttcattattgttgctatgctaggatatataggatggcttaaatatgataatgctcaattgcaaacaactatttcgagcttagaagccaaaaacaaaggtttagaaacttctctaaacatccaggtcaatttaaataaaatacaagaccaaaagaatcgagaacttattaacaacattaaagaacttgaaaataaacctattaaaactgaaacaaaatatgtaacagtcaaggattgtaaagttcaaatatctaaagtagacaccaatattacctcagctaaaggtatacctttatttttaggaaatataggtaaaactcaaatatctaaccaaaaataaggaatctttatgaagtttaaaaagtttttattggccttaataccttttatttttataggctgtaccactgttagaactgagtttgtatacccaaaaataccggatattaaagaaccgcctataacacaagattataatctaactgtaataaaaataaataacatagaatattattcgttgagtgctgaagatgctaagattttgtcagagaactggatcaagtttaaatcctgggctgagacgaattatgaattattaaaaataattaaaaataaggacttaaaatgagtttcaaagacacattattaaacctagtttatgagaattctggctgtgaagtgctggattataaagaccctgaaatcaaagaaactgattctggtgatatagatacaacacctaccactaaagcagatattgttaaacgcaaagattctaaaattgatgaagatgattctggtgatgattcagagcttgaaccactatcaaaggaagaatttgacgatataattaattctttagatccagatacgattgcattaattataagtattcttaacgataatggatatatagttgcttccaaagaagaaattttatcagcagaagattttgaagatattggctatcttgttttagaagttctcgaagaaatttctgagtatgaagctaacaattatgaacaatatggtgcaactccagtagatgaatcatttgatgatgctgaagttcttaaagaagctgctatgattttagaagctaatgatttaagtgatttaagtgaacaattagtagatattgcacatactaaacaattaagacgtgatagaaaaagatcagcttggaaaagatcagcagttttaagagcaagatttagaaaaactggtgaaggtagaagagaacgcaaaaaagcgcttaaataccttaaaaaatatagaagacaacataaagctcgtatgaagagatattcacaaaaatatacacaagtttggaaaggtaatactaaaaactaatgatattttgtgaagatttagaaccaatatatgaggtggtgaaaaaactacctctttataaacagagagctaaggaagaagtgtttttaggtattttaaaatcaaaatctaagaaatggatcggatggaaatacctaaaagaacttaaaaaagataaaagctttgacgacagcgctatttttattgagctttatgagcttgcgttaaattactactggattaaatctcaaaacgactctatcaaatacgataacttaatgaaaaactataaattttaaatttattaatattctaatttaatattaaagagtttgaaattttttaaaaaattttaccctttaatatgatattataatataaaaaacttttttaaaaatttttagtagttttattgtcacttaaaaaatgcttggctttttaatagtatataacaatgctatatatcctagcatatgcttaaaacttaaagcaatattaaaaagtataaaaaatgcttggctttttagtagtatatactatagtattatatcctagcatatgcttaaaacttaaagcaatattaaaaagtataaaaaatgcttggctttttagtagtatatactatagtattatatcctagcatatgcttaaaacttaaagcaatattaaaaagtataaaaaatgcttggctttttagtagtatatactatagtattatatctaaaacttaaagcaatattaaaaagtataaaaaatgcttgagtttttagtagtatatactatagtattatatcctagcatatgcttaaaacttaaagcaaattaataacattttaagttttaattttatataataacaatatttcaaatcaaaaggatttatatgaaagatacagttttaagtctaagtggtggtttagactcaagcgctttactatttgagtttaaagatcgtattaagattgctgtaagttttaaatacggttcaaatcatcaagaaaaagaactagcagctgctaaaaaagtcttggatgaagtaaataaattaggtgctgaaatcgaacatagaataatcgatttaacagaagcttttggaacttttaaaagtgctttattaagcggttctaaagcagttcccgaagctggttcaactgaagtttcaaatgtaattgttccgtttagaaatggtatattcttaagtatcttaacgggtatagcagaatcagaagattgtagatttattgctatagcaaaccacagtggtgattctaacgtatttccagattgtagatatgattttatcgatgctatgtttaaagccattggttcgggaaccgaagacagagttcaggtattcgcaccgtatacaaatattacaaaaactgatttgacaatccgtggtatatctaatggtttaaacccagattggacttacagctgctataaaggtggtaataaaccttgcaatgaatgttctgcttgtgttgatcgtaataaagcagtgcaagaagctacaacagttttaaaacattttagttcttaatttattgtatattgagttttaagatattataatatttcaatagtattgacaaataacactttagtgttctagctttacactttagtgttaatttttaaaattagaaccaaaggagaattatgaaactattcgaagcttgcttcaatttaggtaattttgaaacttatgaaagattctataatacagaaactaataagtctgaaattcaaaaagtctttcttaagaatcaagtttttattgaggatcctaaaggagaatatacatttttattagatccaaatattaaactaacaaaagttcaagctaatcaagctaaaaatttagaaacttatggtaagactaatattgctgctgaacatattaggcagaactattggaaactcaatgattcaaaatataataaaaatataagtattttttatctggatatagaaactacggcacactcacctattgacaccgaagcttgtagagaaagaatagtttcaattcaagtatatcataacttaacgaatacaaattatatttttacaaatgagttctttgacaccgaagctcatactaaagattctaaatatattttcgatgataggacttatgattttaaacttaaatactatcaagtagaaggtgaacataatttattaattgctttatttaaacttatagaagctttaaaacctttattagtattagctcacaatggtgaaggttttgactttgcttatctttggagaagaactgaaaagttaggtttaactgaaggatttagcccatttggaaaatctgaatttcaaataaatgaattagataatggaactaaaaaatacagtataaaagcgcccggtgttttctatatggatactatagatatctataagaagtttagacttaaaccgagagaatcttattcattagattatattgcagaagttgaattaggcgaaagaaaagttaatcacgattgttttaaaacttttgatggttttagaacaggtgaaggatttattagaccagaagttgaacctagtgaagaatctattttagaatataaactttataatgctaaagatgctgaagaaataaaaagaatttctaaagaatattttattcattatagtattatagatacatacttattatatagaatagacaatgcaattaaattatctgatattatgattagtattgcttctattatgggtattcaattaccacaaacacttggaacaacaactccttggagtacatttatccgaaattatgcaatgcaagataaaatagtattaccaaatccaagtgaatttagtggtgatgtagaatttaaagggggctttgtagctgaaccattaattggtagatatgattgggttttttcagcggacgttaccagtatgtatcctagtcaaattatggcatttaatttaagttctgaaacatttataccattttataaattgccaaatgatttacaagaagctataaatgaattagatcttaatgaagatgaacaatatcatattaataattattataaaaatcccgaagcttataaaaaatacacggatttacttataaagtataattattgcggatcattaactggatctgtgtatgacaaatctaaaaaaggtattctaccaatattaacagaattagttttcaatcttagaaaagcagctaaaaaagaaatgttgaaatacgaacaaatggctgaagatgctaaagatccagaattaatacaaaaatatcaagcattagcaacggaattagatgtcaatcaattgacatttaagattttaattaactcattatacggggcttgcggaaataaacattttattctatataataaagaaatcgctaaagctatcacaggaaattcaagattttatataaatcttatgagtaaaaatatcaataattttttgtgtgatttatgtggttctggaaattatataatttataatgatactgactccgtgtacgttcaagtacctaatattataaacgaaaaattaccaaaagacccacaattagcaacagatataattgataaatttatagaaactaaaatacaaccggtaattaacacaagctcacaagaattagggtctatttttaatgctttagatgcttcaagaatttctgcaaagcgtgaagcgattgcaagctctgctgtgtttgtagcaaagaaaagatattttatgaaagttatagattctgaaggtgttaggttcagtgaaccttatcttaaaacaatgggtatcgatattgtcagatccagtacaccagcattttctaaaaaatatcttaaaaaatcagtcaatattatattagaaagtacagaagaagaacttaaagaatggttaaaaaatattagatcattatacctgggtcaaaatctaatggatattgctaagatatcttcggtcagttctagcaaatataaacttggtgtggacaaatccataccgattaattcaagagctttcttggtatcaaatcattatataaatagtctaaatacaggtgagtttcaaccattagaattaggcgaaaaggttcgtatgctatatcttagagaacctaacccattaaaatctaacatttttgcttttaataatgaaaaatttgcaaatgtatttaaagattatatagattgggatactaattttaataagttctttttaaaaccacttgaaataatgacagacccacttaattataatttacataaagaaactgaaactttggaggaatggtgatggatatactcggtgtttacaattatattaaatcttatattttaaaaggatacaattatttaaaaagtaattattcttttattactataatgatattattatttggcactatttggttagcttataatttattatttgctgtaatttttattgttttctttttaataggttcgtttgttttatttgcatatcttgattctgcaatagacgacattaattttaaaaaataatgattaatagggctgttataactaggtgtttcaaatataatggctctatgttcgatgcttttgaatatttttatagactttgggaattagatcctgatactaaatttgtttcattgtacagtcatatcaataaagattttttaagcattaaatacaacgtagatccaaaatgttttgataattttatatataaagatccatatgatttagaatttaacaaagttttattattcgatactcacgatttctataatataaatcacccaaaatcccttaaattaaataagttatatgtaatcgctaacagcaccatagggttcaaagaaaatactgaatattttgatgaatattttttaaataaaaattatattaataaaatatattatcagattcacagaatatttaatcatttagataatgtatatgttaattgtatggataattgctgcaagagttatttaaatattcttaaaatgtatccgaaagcaattatcaaagatcctaaaaataattttcaacattacacaatgactaagaattttataccggatatttacaagtattttaataagtacatatatgttaaaactggtagaacttatgatagacacccaagacaatttacagaatgtgcttaccaaggcattgattgtgaatatatttctgaaggttctaaattcacaaaaaatgataattcatattatagattcgaagatagatacgattttgataagagatttatatacaatgatatagttatatctaaaatgctcgattgatgctaaaaataaataagctaaaaggtttgtgatgagattcttagaatactatagattgaaagaagctgaagaatttagtagaaatgacattaaaaccattgttaaacaatacaacaaagtattcgcaagaatcttgaatgcaaaattttatttagttaatgaagttgagcactgcacttcaaatggttcaaaattaataggtattagatttgccagtgctgatggctatatgataagatttaattacactgcaaaaaacgctaaacaaattcagaaaattaacaaagttactaaagaatttcacgtcgaaagcatagatttttggaatccaataactggtcatttaaataaaccaagtatcagagtttctgtaatttcaagtttatcactcaaatattttatagaagacattacaacttctattaaaaagaatcttttaggaactttttattataaagatcttaaatttacagacgatttgcaagtcgatacaagatatacgattaatccagatgaaatcatattcattaatactaaaggatttaaagaatccaatgattttacattaagttcgcaagatcctaatattcaacttatacttaataatatcaaagaagtttatggagaagcttgatgaaaagaatcttaaccttatcagatcttaggcaatatatcaaagaagaacttggatatccacaattacaagtagaacttacagataatcaattagatcactgtattgaaaaaacagttcaaatgttttgtaatgttgcctatgatggagaattaacaagatatataaaatttgaatgtcaaggtcaaggtaattattttgtagatcctgaagttgaagaaatattacaaatatgccaaagtggtatttttgtaggttctgatttaaatggattaatagatcaaaatctatctaattatatactatccacttctggtgttgctttaagttacttagttactttaagttctacaagatccttagtcgacaaatactttggccaacgtgttaatttcgagtttaactctcataagggattattatcaatatatcaaaattaccacgggcctttgttaattgaagctaaatgtaaatacataccagatgaacacgataaaatatatgaccaagaatgggtcaaagcaatgtctgtggctcaagccagattgatgcaaagtgtagtcttaggaaaatattcagcacctttaattaatggttcgcaagttaattatagtgatattagacaattagcccaagatgaaatacaaagattaaacgaggaacttttcaataaatttacagaacctgctgtatttatcgttggctaaataattttatatttaaggaactcttaagatattttatattataattatcaaaaggagataatatgagagtttctaaatacaaaatgttgagttccttaaaagactcagaatacaacttagttttaacaaattacaaatacccacaatctaaaatagatttagaagaatttaacgagtttggagaacgcttcttaaaagataatgcaattatcgatgttaaaaaactcaaagatcctgaattaaatcttagatatgattatgttttaatacttagatcgaaactcactgatactgctttagaaattataaaagaagcttatcctatgctaaaaactattgacgaatataaagcttcattaacaggagattttaatgaattatgataaactaaataaaattggaataattttgattattattttatcagttgtttattttatgcttgatattaataatacaaaagttaaaaatttagaatttaaaattcaagatctccaaacagaacttaataaaaccaaaaaagaattaaatgataccaaaattaatttaaatcatttaagttctaaagttcaagatttaaaaatatctttaatgaaagatatgtcgtcaatgtatcacttaagtgataaacaacaatctctaatacttgatgaaatatggaaacaatctaaaaaatacaaaataaatccagcattcttatacgcaatactgtggaaagaatcaagatttagaaacgacgttattcataaacctacttatgttagaacacttaaaaaagaaatacaagctcaaggtatgggtgctattgtttgggatttctggggagataaactcaaatctaatacaagtttaaaatctaaaaaagatcttaaaaattggaaaaagaatatagaaggaactgcatatatacttagttatttgaaatctttaccaaaggtatctaatacaaaaaataagtacgaatccgcagcttcaagatactatggaaaatatcaagcaaattacgtgaataaaacaatgtcaaaatttaatgaactaaactcttaatgctgaaattaaagtgggtttaaataacgattttgaaccgatatgattgtctaataattaagtacattttaagtgctaatatgttataatattgttagatttcaatagaaaggagaactatgaatgaattaagttttgtaccaaaatcagaaattcttaataaatcacaagaaacttgtattaaagaatgccaagatattgtatttcaagaaacaaaagaagtttctaaagacctcatattagatacattattaggtatgatagattctgtcaagatttcagattctgcagttcatataaaattcaataaatctttaatcatacaaagtgaaaacattgttttaggtgcggataatttaaatatacaacttgcaggaaaccgagtagaattacaaccaagaatcaaacaaaatccaaaggagattaaatgatcacaaaagatttcattaaagaactttcaaaaatgtcgagtataactgataaagttattcttaagtatccaataacaacattaaattctgaagctatagatatgcttgtaaatatagatgcgtctaaattaggatgccaagaattcccagatactggtatatatgaattaaataagtttgttcatatgttcgcattatttgataatccagaaattacaagaacaaacaatgcaatagaatttgaaacaccggggacaaaaagtgtttatacaatttcagatttgtctgtaatggaaaactttgatcaaaaagcttcaattattgaaagtttagataattttccagaagttgccagagttgacattagtattgaagtcataaaacaaattaaacaagcttcaagtatttacaacgaattaaatgttttaagtatagaaggtaaatcaaatgatttatatttgtatttagatgcacataatagatttaattcttctaataatacattcagcaaagagtttttaaatcattcaactatggattttaaactgaaaatcaatattgaaaattttgttaaactgccggtaacaaattatactttaaagattaaatataatgagagtaaaaacgcatttagaattctctttgaatctgagttttctaagattttgatctcaaaaattgcagattaaagattttacaccaaggaacaataaatggataatttaaaacaactttcagctacgtgtatgcaaatctttattaaattaaatggaatgcattacttagccaaaggcaatcaatttcacagacttcacgaaataacacaagaatattatgaattttttcaagagtcgtttgatacattcaatgaaagattggttcaattgagtttaacaccctgtgttaatatacaagaaatccacgatctgaaaaatccatatattttagatctacaagctacaaaacttgatttggatactatagctagcgcattaataaatgattttaaattagttgacaattcagtagcagttcttattcaagaagctattaaaattgaagatactgttacagaagacatcttaagaacatttagaattcgtctccaaaaatatatttggatgctcgaatctatgcaaagttaaggaggtataatgttaaaagaagataaatttatttggagtttatttcagaaaaaatttccagaagtttcaagagaagcttatgaagattttgtagaagaatatttaaatatcaaaccatttaaagctagcgaaaatatatttgaaaccaatcaaagtatttcaaacgaagctcattttattatgagagcattagctactaaaaaattacaagaagtttttgaaatacttaaaattgatttagaagacccaaatgttaaagcagattttgaaaatggtaatttaggaacaccaggcagagtcattaagctaatggctggcgccaacactgatgatgatactgagtgtggctctggtagatttatgaaacctgttagaatagcaacttttccaaataaagacgcagctaagattccaattactaaaaggattaacatagcaagcaattgtagtcatcatttattaccatttaatacagattttgcggaagattcctatgcaatagttagttatatacctaaagattatgttctgggtatttctaagttacaaagattagcagatttcgtctcgagacgttattggttgcaagaagatttgactaaagaaatctataataaaattaaagaagcagcacaaactgaagatgtttatgtcaagttatgtaatattaaacatacttgtgaatggattagaggtgcgagaaacactgaggggggatttacttcagaattctacggtggtgcttttggtgatcctgaattaagaaaacaggttcaaatccgagtttaatgttaatacactatagatcttagcatttaacactttagtgtaattaacactttagtgtaatttgctagatctttagtaaaaaatttaattaaattttaatcgttctttatataatataatattaaaaagtctaaatcaaaggagtttaatttggataattttgaatcggttcttctaaaaaatattatagaatctaaagatttttttaataaagtaaggctaatcttaaaacctagtattttcacagattttggtaaccaaaaaatctatgaattaatagataatttttattctaattataatacaactcctagtattcaagaaatagcacttcaaattaaagatattcccaataaagaagcaagaacccagattgctactaaacttaatgatgctagaaactcagaaaatatcaataaagaattcttagatgatttaactgttaaattcattaaggaccaaatgttcacaaaagcattaatgttaggtgctgagttcattgataaaaaagatgaaacttataaacaaaaagccaaagatcttatagatgcttcacaacttgtgaatattcataaagatcttggtaatgaatataataatatagaagaacgcattgattattatcaaaatccaagaaaaggtatcaaatatttaagattcaatactttaaatgagtatatcggagaaggctttcttaacggaactttgaatatttttatggctcctgcaggtattggtaaaagtttattaatgagtaccagcattggtgattttcttaaacaaggtttaaatgtattattagtcagcttagaattatctaattttgagttcttaaaaagaatagatgctgacttattagatatacaaattaatgctttaaaagacgtagaccctagtgttatcagaactaagtttgaagaactaaaaagatctggtattggtagcttatatgttcaaaacttcccagctggttcttttagttcaaatgatttaaaatctttattagaaatgtataaagctaataatataaaattcgatgcaatattcttggattacttaggcttgatgaaatctgatagagtttctgcaagtgcaggtttatatagttatattaaggccattggtgaagaagttcgtgctattgcagtcacagaaaatattccgatattttcttgttctcaattaaatagatcagctgtaaataatacagattctaacaatgaagctatttcagattctatgggtactgctatgactgctgattggatttgtttcttattacaaactgaagatcttaaaaagaaaaatactattagatttaaaataactaagaatcgttataatggtagaacttcaagttttgatatgcatattaattatatgaatatgcgtatagaagatatagtttcaaatgatatacaaatgttaagtaatactgatattaaaaacgttccacaattagaaatacaaaaacctaaaactgattggaactttaattagtctcataaagattgacactacagtgttaaatgttttaaatttaattaaactttaagtttatatattatataattatattgtttaagagatttaaacattttacactttggtgttaatcgataactcttaagtaaagtttaaaagttttttaaacggttagattctaaccaggattttcaaactgtcaatgtaaaagttgcagtttgaatcctttttaaattaattaaactttaagtttaaatattatatgaaaatttataattttcggggtgtagcgcagtctggttagcgcacttggtttgggaccaaggggccgaaggttcgaatcctttcaccccgaccattctaacattagtaagcattcgggtaattggtaactcaccagactgtaaacacatttaagatttcagtagaagttttaaatgtgtttatgatgtcagcgttatattatataactaaaactgatgattgtaaacacaattaaaaatcatttgtaagttttacccatgtttattaaattgtgatgctatatgtttatataaccaataaatatatttaaatatattttgaagggttaaaatgacatttaaagattatttaaacaatattcctataaatgaagcgttaaagacggatgtgtctgctatagaggaactcagaaatagatatcaagaagtagccaaaaaaaagatggaattgcaagccgaaataagtaaactagaagctgcgcagactacagcttactttaaactaggtggcttagctgcacagattgcgcccgataacgttgataatgaaaaactcaacaaaggtttagaacaatacgacagtgaaattgagaatattgagaaaaagttagaacctctttataaaaaacgagaatctttactagacgagcttaaaaaaataagcagagttgctaataacttagtaacaagaaatgcaaaaaaagctggtgtaagccctttgaattatgtttttaaatataatttatcattttaataaagttaaagagtcatcgtatagaattaaactctatacgatgactgaatataatgcctgattagctcaactggtagagcattcgccttgtagctcaaaaaccttataaatagacataaacataatgagagccatatagctttatatgacccacatttactaataaacttaattattcccatttaattttatcgacagatttaacagtttcagataaattaattttttcttttaatgtattcgctttaaatattacttcctgagtatattcggttacttttgaaacaaatgttaaaaattcttgaggtgtgaaattaaccttttcgtcattcaagtcaatccaagtaatctcagttattgaattagtaccactttgtatatctaacaatatattagcggccattccgttaatattaagtttatccttttccctagtttggaatgtatggcctttgaatataaaaccagattctaaagctgcgtccctttttgtttgtatttcaaacttcttcttttctttaattatattaagtttttcagattcgcttgcagtatttagcacatattcataatataaatccataagattattagctaaacagtattctttaactgcttgcgttcctgcttgaatttcttcaggcgtaatgtcatttatttataattgatatatgtatgcaccatttgttgatagattctgtcaagatttcaggtgtttatagtgtagagtatctgttatccgcttgtgtcaacacatcttgcaatttagtatcgatttcagatttatcataaacagattcggcacttgctttaagttccataaaagaatctatagtagatttattataatatgaattaaatttagtattaatttcagatttattataaacattacttgtgttggctttagtatctaatttagaatctacttcagatttattataataattagataaatctacacttagaactgcatttttccattttttagtatttgaatcatattgtaaaatatgattgtttgtcgggtcaacaatacttgcatcaattaagttagcaatacttgttttatgtgggttattaaagtctgtcttatgagtattaattaaatctacattaaaattctttttggcgtaagctaagttaatagcgtgccaatcacttgttgggtctgcaacattaaatacttgtgtttcagaaccacccagatttgcttttgtatttaagttattattaataccaagaatgttattttctatattttttttaaattgggtatactcactatacctagtatcttctaattctttgttggtagtaatggtattttcagcagttgtcactcttctttctaatttataatgtttatcttctatatctttttcattagtacctactgtagtttctaatttggtaagcctagaatcattagcttccttataagtttcaaaaattatttttcgaaggaaattatcttctatatatttagaactgtataataaatcttttgaagcttcttctggattttcagttgtatgtctaaaaattgcttgaaggtctattaattcgtctgctgcttccatagtctctttagtttcagaatccatacaaatccaatatttaccattaactatatcgtgaatattagcgatataactaatactaggatttgattctttgcttattttattaagttctgttagaactttttcttttaactgttcttttgtgagattttctgatattaaaacatcaacttttttaaattgcatttttcacctttaaactaaagattttataagtctatctattcttttatcctgaacgatattattactagtattatttatgatcttaccatcagagtttattaaaataactctaccttgatctacgtctgttactctaacatatactggtgcaccatcatttttagcaactaatccctgcatttcatcaacagcttcttttgtaatttgacttaatgttttagttgtttcgtatacgaaatctattatttttattttagatgcttctaatgccatttaattttccttgtatatttttaccatttagatactaaattttcaaaagtatcttgaactgcattctgcgctgtgcttaatccattttttaacatattactaaaatatgaacttgctttagattgtacactatcattcccggttgtgttggaagtgcttgctaattgaatatttttaatatctgtattatcgtgatttggttggttcattttaaaactaacattgaattctataatttcattattgtcttgagataattgtatttgtgaaacatctgtcaacaatgcatcctgcgtctccattactaagatgtttttagaaccattgcttaaataaacctgaattagccaagcacagacatcattgtagttaccttttgaaatttgaaaagcattgacaaatctgcgatacatactggcattatcaaaatctctgaaggtcatatccacttggtatactgggtctgcaccacgtgctaaaacccaagtccctccaattaataattcttcaaatctaccggtatattgtggtaaattaatactttttaaacaaatatctatactattttgtgtttcggtagggttaccccagtttataagattttggaaggtagcattaataggtttcataataactataaaatcagaggttttactccatttgatagtattaataacactagcaagtttatttaaggtaacagttgccatttatcctacttttttgtatatttattcttaagttcaaatatattataataaatgaaattcaaagattatagatattaatgatcctttataatttaagcttcttttaagtggtgtttagttataataacttcaattaaaaagttaaggaaattaaaatgataatacttttagagaatacttatatgaacaagcttttagtaaagatgtaatgatctctaaatttactaacaattcagacaacatttttaatcatattttaaaagtcttagtatatgatgataatttaaataataaaaaacatttaagagagatgtcaggaatagtaagatctttacaaaacaaaactatcaaatcaaaaataacgccggaagacttgtatcaaatttaagattatgaaataatggatatcataaatatttaaccaacgattaaaggactcaatttgaatttagacactatacatattgttaaaaataacggagaacgtgaaatattcgatgctgaaaaaatacataaacacttacattttgcttgtcaaaacctcgatgtagatattattagcattattaaagatgctagattaaaaatatttgatggtgccaaaagtgtagacatacaagattctttaattaaatctgcacaagaaaaaatcagtgaagattctccagattatgagttagttgctggtagattattaaatcaaaaactcagaaaagaagtttataaacaatacacaccattagattttaaatcacaagttaaagaacgtattaaaaaaggtttctatactgaagatcttaatgcttatagtgatgaagagcttgactattttggatctttaattaattatgaattagataacgaactaccttacagcgcattaaatcaaatgtattctaagtacttgatcaaacataataaaaaatgcattgaggttcctcaagaagtttttatattgataccaatggctattttttataataccgatatagaatatagaaaaaaatatgttaaacttgggtatgaattattatcacagcgtaaaatttctttacctactccgattatgaatggagcaagaacaagttataagaaatttatatcttgtaatttattaaactttggtgattcagttgaaagctttgctaggggtttagaagctgttttaaaatgcaccagtgctaaaagtggtttaggtatcaatacaagtttcatcagaggtttaggagctccagtaggtaaaccttcaagattagatcatactggtatgctgccgatcgttaaagccattgaatctgctacgtctgcgctgattcagcacggcaggggcggtgcaagcaatctgtcaatgcctttctttcactacgaaatagaattattttcacaactaggtgattctaaaggatctttagaaaatagggctagacatactgatcaaactattatcatcaataaatggttcttagaaaaagctcttaataaagaggatatatttttattccatatgaatgctgtaggtaataaggatcccaaattagatttatatgatgccttaggtgattataaaagattcgatgaattatataaacattatagcgctaaagttcctaataaaagtaaaaagaaaattaatgcttatgatttattatctttaattataaatgagagaatgattactggtagagtttatattgtttttgcggataacttcgttaattcaagttttaaagaaaatctatatatgacaaatttgtgctgtgaaatatctgtgcctagtcatagtttagataattataggggtataccaggagaactcggaacttgtatcttaggtaatataaattttggacattctaaagaatctgacattccaaaagttgctgatttcttagttaggttcttagataatatgattgatatttctgattttgctatgccagaaattgaatactcagctacaaaacgtagaacattaggtattggtgtttctaacttatttggatatcttgctaaatcgaaattattttacaatacaaaagaagcacgcgaacatattaatgatttaatggaattattttattttaacttagttaaaacttcaatagatttagcaaaagaacgaggtgcttgtgaattatataatgaatctttttatagtggtaataagtttatattcgaaagatatttagaagctgggattaaacctgaatttaaaacaaaattagattgggagtcacttcgtgaagaattatctaaatacggtatgcgtcattcaagcttgtcagctgtaccacccgctgggaatatacttgtaatagagaatcaaatatatcataattattttaacagttcaaagccaagctcagcaacacctggtatcgaacctccaagagaattagtaactattaaaacagaaaaaagttctactgtaaaacagttggttcctttctataaaacagccaaaaaatattatacgactgcttggggtgttgactttaataataaagattatcttaaattagtgagtacaatacaaagatatgtagatcaaagtattagtacaaatcaatattataatatcgtagaaactaaaaaagttaatattgaagatgttatagaagaatttatagaatgcttcaatttaggtgtcaaatcattgtattatgctaattttagaactacagatgatgcagatggtgatcaagtaattgaaggttgtgggtctggaggttgtagcgtttaaaaacttttaggtttaagcttttaagactttttaagcttaaactttaagattcggtttgtatttcagaaacttttaagttattttatattataattatttcattaaaagataaaggagataaaatgaaacacattacaaaaatatttttaggatataaaaacgacaaagcatatttcaatagaacacaaagacaaattacgtgtgctatcaaaaatcttgaacgtttaaaaccttcatttaatattaacgaagctagatttgaagaaatctacgaagctaaacaaattgaaacaaacccaaatatactttatattgctgttacagacaaacaatatgtaattgtaaccaatagtgattggcgcggtaatatcacattagattataaaaatattgattttggtgtagaaagaagtctacaaatatcaaggcttaaaagattatttagagctggtgttagaatatggaaatgtaatacttacttatatgatagaaaacgtaaatccataggtttgaaacctagtcttgaagatcgtttagcagaatataaaaaatctaaaatcaatgattttaacaaatattgcttaaataaattaaaaagtgttagtaatttaaatctaaatgtaaacaatattgaagatttagattttaataatttagaaaaacaaattgattttatgaaagagttgttatatcatactaaaaaatatgttgcgaatgaaaaatataaattttgtgatgaaccttattttgaaagcacaaaaagaaaaactatgaatgctattataaatttaaagatttgaaatacattcataatcacacaaaaactgggattaaacgatgatattagatactaaagcagatatattagtaactcatagttttcactttaataatactaaaatgcacggattatcaggacatttatttgaagtattagattattactggtattttaaaaataaaggtgttaatgttaaatgtttaattccagaagtagtaactaaagaaacttttaatgatttcataaaaggacactatagtgtagattttgatttaaatgatatatattttttagatactaagatattagcaattaaagctagaaatatactagtaaccgatggtgggtattggtttttaaatcaatataagtctaaattactaggcaaagtgttttcgtttgcttgtggtcctagttttttagaatccggagataagccagaatatgtgacttttttagcagatcataaaatatatcctggtttgggaataaattatactaagaaggtgttaccacatttaaatcatataccaggagataaaccttttgctcatattactaaaaattgtagggcattatcagaatctcaaataaaagatctaataagagattatcctgatattgtaatgtatagtgattatttgaatatacagaattcgacaaacaaacctatcaagaattttaattttagtaagtatgtgtatacgcctattatgagacattttgattgttcacctagacttataatagaatgtagaatattaggtatagattttgatttatggaatatcaattataaagatcctggtttagaaagacgtttagaaacagatctggatcaatttatattgggtgagtctgataatataataaattattttaattaaaatattaaaagtccacaaaggtttaaaatgaataaaatagacttctcgggttctgaatgctcatatgaaaaactactaaatggaacattagagtttgaaggtattcgagctgcgataatgacaaccgataaatgttgttttagttgtgaatattgttgtaattcaggttttacagattttaatgctgctaaaaatactaaaagcgaagcagatttaaaatgttttaatttggttaaagctatatttcctagattaaaatccgcagttttatgtggtggtgaaccactaatgtgtgattatctttatgattatttagacttatttaaggatctaaaagacgtaacaattttaacaaatctattatatataaaagatcattataaacgtctaaaagaatatagaaacctagatttagttacaacttatcacgcttctcaaattaattctaatcaatatattgaaagacttaaatatttcttagacatagatttaccaaaagaagttaaattattttttaaccataaaaaaccagatttaatagaaagaactcaaaatgttaaagatttcttagaatctcaaggatttactaatattatttgtactcatatttcagggtttggttttagtaatccaaataaaaatgtagcaggcgttgaccttaatgcagatagagactacgtaatgatttctcaaggaactaagaaatatatgaatgaatctgagtttgcgagtcaaaattatctcggtatggtctgcaatggtttgagacttcacgtttacccagatagaatcattgaaaattgttcaagaaaaactttgactgtagaagaagttctaaagttaaaagattatcaagtttgtaaattcaaaagttgtaatgttggtatgtgtttgaattattttaataaatacaatgttaaatacttaaagtaccaactaaaccattataaaatattataaagaactataaaaattctttacatttttaatagtttttcttgcttcatagttcttctcagactttatctgagttttcttagaactccacaagctttaattttttagagtggttccagctgttgtatctgtagccactatattctttaatccaagatttaatatatttatactagcatttaaatctctatcaatcgtaaaaccgcattcattacaatggtatgttctttcagataaacttaaagtttctttaacacaaccacaattagaacaggttttactactagggtagtacgtatcaatcttaattaaacagccttggttttcggctactttatattccaacttagaaataaaagaactccaactaacatcagatattactttagctagttttctgttcttaaccatattcttgacttttaaagtctcaagacaaatagttctatacttatcagctaactctcttgaaactttatgttggtagtcatttctttgatttttaacttttttatgaagctttgaaacttttaatctttgtttttctccattattagaacccttttgttttctacttagacttctttgagaaatctttaattttcttagtgatttttcaagaaatcttttattttcgaatacaaccccatcgctacaaatgcaaaaatctttaatacctaggtcaataccaacagctccatttgtttctttactttctatattacaatgaaaggtgaaagagataaaatacttattattttcttttgaaattgtaaatccagtaactctatcaaaattatattttattttatgtcttttaaaacgaattttaaggtcatcgtttgtatatctggaaccccttgggtttatcagaattatataatcaccatctatttttattctacaaccagcataacaattaaagctttgagtactattctttttagctttaaatttaggataattgaaagttttatagaaattattaaaacctctacttagatttttcattactgcttgagtataatcgtttggaagtaaagataaaaagctgtgctcttcttttaatttaggtatagatttatttaaatcaaattcagttggaattcttggaactatattacctttgtttttaccgttttgaatttcataagttccaaatttagaatttttaatattatagagtgagaggttatagatagccctagacaatccaaagaacgattcgagtatttctttttgcttagaactaggctttaaaatgaatttaacacttctaacagtgctataaatatttttagttttagccatattacacctatgtttaatatttatttagtttaatacacttttaagtccagaatatataatatttgatataaattatatagttttctcaatttcttaaggttgtcttagtaacatatataattttagaaaattctccaataatatacatttaaagtctttttaagaaaacttataatataattatagatatttatatattcttatatatttcacaaattatattaaaaaataaaaaccaaattcataagcaatgatgtataattttaatcttattttaagattattattatataataacagataaaaaaggagataaaatgattaaaaacacaaaaatacaagaaataaaagattttaacaatgatttaatatctaaaatgttaaaaaataatccacattttgacttaaaagtagactatagaactcaatttgtagtttttaaagacaactcgataatagaaagtgcttattatcctactaaaatagctacttgtgaagatggtgtaattgaagtagatgaagatgcttcagatggcatctcaatatctcacaataaaatagaattttttagaaatggtgtacctaatggtttggcaatagaacttattgaggataatgaaaccagaatcaaaattagatttgatttgcaagatcgtaatattttctatgaaaactattacgcttgggattgtttaggaaaaagagctttcacttttagaaatgatttaaatcgttttaatgatcgttttatgactaagattaaacttaagaattttttaacaaaaaactttgatttatttaaagattttatcaaaagttctaatgaatatttagattttattaataaaagtttataattaattatagtcaaaggagcttaaaatggaaataattaaatctgcaacttcaggttttattaaatacacaataacgttatttttattaggatttttttcaggtatagcttttacattttttatgactaaatggtatttcgaagatcgtggatcaactataggttatgaaattcaaagagccaatatgataaaaaattgtataaaagaagttgatgtttccttagaaataatgaaagaagaaaactcggtcatagatgcaacgcaaccattaaactaaatataggatttaagatgattattgaaataaaagattttccattaaatgttaagagagtagttttagaatttgatgattctggtgcttgtacgatagaaccagaaacaaaagttaaaaaaaatctaagatttctaaacctattaaagaagttgaaaatgattcagctgatatgactgaaactgaacctgttttagatattaattttggttctaaaccagtaaaagcatcaaacacagaacctattgataaagttgtaatcccggatatagaaagagaagctaacgtttcagctacaatgcaaaacttgaaactataaaagtgttatgtgttaacactatagtgtaaaacttagaagcttaagaatctcttaagcttctgtaattgcaaacttatataacatcggagtagttgcagaatgtaaagggtgtattgtatatgcatttcttgtaaatatacctacagttctttcaccggatttataattataagcagttgttaagttcatacaatatgggctataaatcaacgaattaacacccttttctttatgagattttaacccgacataagcatttttatcgtcagggtttggatttaaataatatcttgtattattaatcttacctaagaaataatcattcgctctattttcatctgttgagtcatctattcttgaataagtaaaacttaatgataatataccacctacaccagtttgcggaagtatacaaaaactatcgtatgttctaaaattaggtgaattcattttaataactaaatcatttacctttttagatatatgaaataagtttgtttcggcattttgtttagaatcgttgttatcatctaacgtaataccttctgattcaactgcattttctttaataagatttataattttttcagtttctttgtgtgctgcagaagacttgacccagttaatgaataattctggtgtttgttcatttccggctttattaagattacttaaatttaataaatcttcccaagcttcctgtgatattttgataatagatttattagtatcaacatcaatttgttttttaataattttaaatgtatcttgagtttcttgtcttgcgaaaacatatccagatggttgcatcataggttgaacttcagcaatatgatgacctataaacgatttgattttatcttttaagatatcacctaacataacttggtaaaaatctgcatctataccttcgctaattaagtttgtagtctccttaagagaattttctaataatagtttatacattttggcctctatgtatttttaagttatttattatcttaattaactttaatatttagattatttaagaaacttttaagttattttatattataattatttcatcaaaagataaaggagattaaatgaaaaactttaaatcaaaattaggtgataatagatttacatttgacttagtttacatagttgtagccgtagtaatgatgatagcatacccagcttattttatttggggttaaaatgaacttcgtaaccaaagattatatgttaactgcagaaatagcggataaattaaatataagtatgactaatatttcaaaatggtatgtaaaatttccagagtctgttactaataaacatttagtaagaataggtaattgtgtgtttgttcacagagactttcctaatttaactaagaatatgaaaattatttttaatgaacccagaatagattggagtaataaattaccattgaattatatgattaaaaattttaaaattaatgttacatattgtgaaaaatataatattggttataaaacaagttatgattttaaaacacatagaaatcgaacaattcaaaaagatttttttgcatttgaccctagtattttaaaattattaaaagctactgaattagaatcaagtaaggttgctagcttaaattcaattcaagtttcaaagaattacttcatttgtttttgattatttaaaggagtaaaaatggattcaaaaagctttattaaaaaacaagttctaaaaatcttaaaagtaactaatatagaagaagaaattcttcataaaatgttcgtagatgaaggtgttgatgccgatttcttgatacaagttctgaaagatctacataaagaatctaaaattaaagttctaattaaatctgataattgcttgtttgaatgggattctcacaagccttatattaaaggtgtttattgactataagtcttctgatacagaaagaatacttgattgtatcaaaaactacaactctctttttagatcaacatattcattttatcagcaagttcctgacttaaaacaagcagaaacaacaagacttcaatctagatatgaaaaagttatatttggtggtaaaaagaatttctttgatagattaaaaggaaaaatttcaagagaagaataccaactaaaaagactgcttcctctatatagtgtaggtgaagcatctaagaatggaaatagaaaattccaaatagaagatgaaaatacaataatttttaaagtctcaagaaaagaacatatcactctaaaatatattcagtagtagattggaaaaacgatggatcttataaaatcataaaaacggggtctatttctttaaaagctctaaatgattatgatgattctttaaaaggacaagggtattctggacaaagtaaagaaagaaaatacatttcaaataaaagaaatcacgaaatcatacaaatagtccatcagctatctaagttagcaaatcattttgggtgtgagatttttagcttagaataccttaatacgaagcaaggagataaagaaaaaggaactaagttcaacaaactctgtaataactctagaggttcaacctcaatatagttcatttattggaaatcttgaattcaagataacttaaaagataaaaagatggagaagaataacatctttggaaactatgaaaaagataaaaaactatatcatatatcaatggaagaaatcggtaataaagagtcttttaatagttatataactagtaaaatgtaaacaaaggttctaaatgacaagatatagtttttcgaaaatagatacatataaaaaatgcccaaaacaatattattatagatatattgaaaaggttccagaaactcaaaagaacccagcattaaaaaaaggttctgatatacacgaaatacttgagtttcataacactgaaaaatacaatgaagttcttaattcaaaagatccagaaatacaaaatattgcattaagatttattgattctgaattaggaaaagaaatactatccagaaaatctttaagagaatacgaattattcttagattctaattatgaaccttgtagcaaagatactgctatttttgtaggctatattgatagaattaatacgactgaaaatggattagagcttatagattataaaacaggtaaatataaagaaccatcttatcaagattttacacaattaattttatatagtttatatatatttaaaagacttaaactaaatgaaataaaaataagatatgtttatgttgaacatcttttagaaaatactttaagtttgtctcaagattctgcaatttattggcaagataatcttaataatcaaataaaatctattgaaaattctattgaatctaatacttggaatagcaaaccaaataaattatgtccttggtgtccttatgcaggattatgtccagattttaaaggtaaacctaaatgttaaaaaataattttaaaaaattaaacgaatcatttagtttaatatctttaactgatgaccaaaaagctaaattaatatttaagaaagatattcgttataatatatgggctcaaatgaatccaaaattagcttatgaatacttctataaagatttcaacaaccaacaaattgtaccaaacggtgttttagaatacctgggtataacaactaaaccagaaattaatgaaaaattagattcgcaattggaaataattataaaacatttagaaccatttccagtttatgattatcaaaaacaagctataaaagatgctatgcaatttcataagttattcattagagcagccacaggtgctggtaaaagcgtcattattggattaattgctaagattctaatattaaaaaaattaaaaggtttgatacttgttcctaacatttcactgacaaatcaatttaataatgatttaataaattataaattggatatagaaacaagattaataggtggtgaaaataatattaaatcttttgataaaccattaacaattagtacttggcaatctgttaaaaactttaaagaagccttaaatgatttagattttattattgtagatgaagcacatacagccaaagcagatcaaatatttgatatttgcaataagtgtattaatgctaagtataagataggtttgacagggactattccagataatgaaatagatgctatgagattaataagtatttttggtttaccaagaacatatattacacccagaggtttaatagatagaggtctggctacaaatgctattattaatataatagatcttaaatataaatttaattttgaaggtgaatattcaagccaattgaaacaattaaaagaatacgacccaagaaataatttaattcaaagaataggcgatactgtagtcagcaaaggtaacactttagtattattttctcatactgaacacggtctaactttattttataagttcttgaaatccagaggattaaactacgataaaaagacttataaagatttggcgtttcaacaaagaaataatgtattttttattaacggaatgatagaaggttcacaaagggaaactattagacaattaatagattcagtaaacaatgctatcgtagttgctaattatgcgacaacttcaaccggagtaaatattaagaatttacataatttagtgcttgctagtccactcaaaagttatgtcacaataactcaaagtattggtagattattaagacttcacgattctaaagatattgttaatatatatgatattgctgatcacaatggtttttttaagaaacaaataaatgctagaataacaaaatcttatgaacctgaaggttatgaaataaaaagatttacttacaatatataatattttaattttaaactaaagttctaaaatttcagcaagaattaagttcaaatatattataattctacatagctgtttaaaaggggattgatagtcacggtgacggtaaatacaataagggtattgtagacctaagagcttcctagtagctcaaaccttttttacggcttagattaattttaaacttagatctaaacttgctgctatagtgttaaatctaaaagcttctaagttttacactatagtgttaaatatgtactttaggtttaaacttagaattaattttaaaaggagatacaatgttaatacaagttaacgaaaatacaactgttaaattatcagcagtttgtaatattaatgttttgaaagacaaacaagttttcaatatgtgttatactttcacagataaaaaaggagcaatgagtggttattattatgtagataatagtaatataaactatcaaaattctaaatacttcaaagaaaaattcatagcagttcgtggtattgatagattaatatatattaacacagattttgtaagctttattaaaaaagattacgcaaattacccaaaagtggtaattggttttagtcatagtgtattaagacacaatgtcgaatcttttgcatttgcacccgaatatatgtatattagaaccaaacctgaagatttagattctacttatgaacaaatcttagaagctattacaaatatttcaaaataaggaggtaaaaatgagagatgaatttgatgatttgttagcaagcttgtcaatagaacctgttaagaaacctgaaatagaatatcaagaaccattagttgttaaacctgcaagcaacatagaagttaatggagtaaacgagcaaaacgcagatttaaatgattttggtgatgttcttaacagcatcgaatcaggtgttagtaataccagcaataataacgaaaatatggtagctagctcagattcagaagcttttaaggaatatatagatctcagaaatattaaaaatgaatcagatattgaagttcctgatttagtggatacaatgcatttagaagaagcgccaagtttaataccagaagcacctagtgaacatacaaatcaaacacaagaatcaaaaccaagtggttacgaagtcccagatatcaagggaactatcaaaagggtaccagatgttgacgattctgaaaataatgtttataaattagaaactgaatatattgatattatattaagttatgaagaagaattaaaagatcttaaacgtcgttttaaacttaatacattagaatatcaagcaaaaggtgttcagactaggttagttattaaagcagttaaacaagcagccaaagacgctaaaaaagaaggttatattattaaagatgaaaatagaatccaagaaagaattaataatgattctaatttattaggaagaatttgttcaattattaattcatcaatctaaaagtttaataatattttaagatattttatattataatacactaaagtttaaaaggagatatatggttcacaaaagtgttcaagattattttctaaatgaattaactaattattcttgttatagtactttaagaatgatagctagttctattgatggtttaaaaaattcaagcagaaaaatcattaacacagcattagacaaaaaattaaatacagaaactaaagttagtatatttgataatatggttcaaagttatacacaatacttgcacggttcgtgttcaggtgttattcaaaatatggctgcaagctatactggttctaataatattccattgcttgaaggtaaaggtaattttggttcgaggtttattaatgagccagcagcaccaagatatgtttatgttaaaaataaaaaatatattaatgatttatttgatattaaagatgtcttgatttctcagaattttgaaggttcagaaatagaaccagtattttacgttccaagtttgcctatactagttttaaatggttcaatgaatggtcttgctagtggttttaaacagaatattttaccaagatctttggattcagtaataaaatatattaagacaggtaataaagttgatttaaagccgtatattgcaggttttaaagggactgttgaattagtagaagataccagttctaataatacacaatggaactttataggtgttgttgaagtcaataaaaataaagcaattataacagaaataccaccatttatcgagtatacaaaatatctcgaaatattagataatcttgtagagactaaaaagattaaaaattataaagacttttcagaccaaagaaaccaagaatttaaattcgaagttatatttttcgataatatctctaaagagaaagctatcgatatattaaaattatctaaaagagaaacagaaatatataatgctttggatgaaaataatcaagtcagaacttttgaaaatattgaatctataattgattattacatagacgttagaaaaagatttttggttaaacaaaaagattttgatttaaaagttcttgaaaatgatttaaatattaatattcaaaaattaagatttgttaaattaatcattgattcagagttacaaattatgaaaagatctaaaaaggatattgaattggatcttgaaagtaaagggtttattaagtttgagaatagttatgattatttgcttaagttaccaatacattcgtttacaaacgaaacttttgaaaaattagtacaaaatgctaaagaaatcaaagctaaatttgaaacattaaaaaatctggatacatttaaaaattatgtcgaatctttagattctattaagaacatattaactaaagcttaagaaagcttaagaggagttaaaatgagatatgaagctgtaaacaataaaacaaaaatggaggattctgaattgggtattatatctacaaaagatacaaggcattttttatacaaaaaaagttttaattatactaattatactttaaatatcaattcatttgatcacgaagaaggtgaattagaaaatatttttgctgatcttaatgacgctaatgaaggtgattctatacaaatctttatagccagtgtgggtggttttgctgatgaacttaatagatttacaaatataattagaacaaagttctatggtaatgtaacaacagtattaaacccatttggatattcttgtggtgctatgatgttcttaattggtaattcacgtgtaatttatgagaactcaagtattatgttccattcagtaagttttggagtttctggtaaacattcggatgttaaaacgcaatttgatttttctaataagtattggaatgaatatatgaagtcattattaaatccatatcttaccaagaaagaaattgaattattaatagatggtgttgagttttggttcgatgcttatgaaatgtgtaaacgtggtattgctactcatattaatgtttttggtttaagtatgaaagcagatgcttattgtgagtacatagataatttagattatagaatagagtttcttgaatatattattaaagaaggtgatcttgattctattgatttacaaagggctgaaattgagttagaacaagctaaaaaagatgctaagaaagccagcactactaaaactactaaaaaagctgtagaatctaagccgaaggctaaaaccactaaaaccactactaataatgaaattgagtctaaagatcttagctaagatctttaggctttaagaatctttttagttcagctatattataatcatatataacacctaaggtaataaaatatgaaaataacaatctttggaactgcaagtaaaaatgaaaagtttgctaagtcaccatacgatgacaattcttttatttttgaaacaattgaagtccaaacgacttaccaagcatttcaactacttgttaataatttttgtttaaatattgccttagacttaaaaggacctggcaaatccagaagattaaaaacagatttagaacctcatataattaaaacatttgatcatttattatttgattttgaatgtaaatcagagtttaataaaaatatggcattagactattttaagagcacacaatgcactatcggtcaatccagatcttatgatggtgttaataattttaatttaaaaggtattattaaaacagctccaatgagcttaaaagaactaaaagttttgcaagctaaaattcaaaaagaactttctgagtatggtaaatatactactgatacattaagaataacttattatacagcgcctttgaataaagataatatactcttggataacccaaacggttctatgttaatgcctataggtacgaatgttacagattactataataacatagatttagattgtaaatttaatattacctctaaagaaactactgaaatatgcaaaacaatttttaagaacctgggttttatcttagtagatatcaatgctaatggttctataaaatacacaaaagattctgaaaattatatttggtacccaaataatccatatattatgaatcatactgaaagttatatgtcagtaaatatttggaaagaagctataaaatatgaacctacttttgatataactccttatatagattataaagcagatattgtagttgatagaaactttacagaaattaagtctgaattagattcaattgtagaagcttttttgtttaaacataatggtgctctgactttgagagctcctatgggttcgggtaaaacaacttttatagatagaattatagaagcagcactagagagagattttaaggttgcaattataaccaatagagttacgttagcagaagattacaaaagaaaatataagaagtttttatattataaagattatactgatgctattaaagccaagaatactaaaaaatcaacaaaaaaccaaaaatagttagatcaaaaggtaaatccttaatttgtcaatacgacagttttagacattttgatttagatgactacgacctaattatactcgatgagtttatgagtttattaatgcatacaagatctgcattgaatagtaaaacagagaacttaataaaattctatactgctttaaataaaaaagttgttgtagctgatgcatttttaagtaaatacattgtggacaatatgtttactaaacctttaaatgttgttagctatacaaaaaataatacagaactttatagttgcaatgacagcaataccttttatacattaattaaaaatgctttagattctaataaaaaaataactatttctacaactagtataaaagttgttgatattattaaagaaatgtgttatatactaaataaaaaaataattatttttaataaagaaaccagctcaatatcaaaaaatattatatatgataaaattaggtctaaagaagcactagattgtgatgtctttatttacactccagtgttaactgtgggagtcaacattctgaatgatgttgatatacattttcattatgatagtgcgagttctacagacgttattagttctttacaaatgttaggcagagcaagattttccaaaaagataatttactatgttatgaacaaaaaatataatgcttgtattaattatgatttattaaaaactactgtagaaaaaaagtcttatgaacatactgatgattctaaagacagaaatgttgaatataagaggggaactgttaaaaatcttttatatcattttcacgtaccacctggtaaagattaccaagaattagaccatattggtaaagcttgtctaaaagtagatgtttttaacaatatgactttatgtgactataaaaaatcttttgatattttattaagttttaattttagtaagatacctattgaattgagaaaaataggcggtgatattttaaaattaatgaatattaaaattcaggattcaaaagattctgatactttttagttttgtttaattttaaaatcagtctaaatatattataatatattatgatttttaaatatcaaacatataaaggagttaaaatgcaattaatagatggctattatatagattctgacaacaataaatgggatgcttctatgtatactgaagaacaagcgaaagaagcttctgagtctttagtagtttgtaaagattgtttaaattgtttcaattgtattgattgttataaatgtattgattgtattgattgttataaatgccgcgtttctaaagattgtattgattgtaaatcttgtattgattgtattgattgttataaatgccaaggttgctttaaatgccataaatgcgtttattgtttggattgtcacgaatgtgtgaattgcaagagatgccgagcttctatagattgtttgaattgcattgagtgtgcgaatacttcgaatgaatcacatactcgaaaatcacatacagtattaaaaatatataaaatcttaaatgcataaaatcacagattcataaataaactaaaaggtgataatgatttatattacaagtgatttacatatatctcatcaaaatattataaaatatactggtaggtatattgatgatgctttagaatattcaaaagaagttcataagtattttaaatctgttttaaaagattctgatattttaatgtttttaggagatttagattgtggtcctaataaaaatatagaattcttaagacactttattagttcattaccaagcaaaaaaatttttgtaagaggtaaccacgacaagtggttagatactgaaagtattttatatattggatttagtgcagtttctgatatcattagatataaagatactttgttttgtcattatccgttagattcaaaatcagtaatacctaaagaagctccagagtttttaaaatcatatgatttaactggtattaaaaaaatatatcacggccatactcacaataattggatagtggattctaaagatggtattgaaagaattaattgttgtatagacagaaatccagaagttattggtgctttgataccattcgagccgaagacttaaaaatttaaacaaaaggatattaaatgaataaagtttctgaagttaaaaaagttacaagagttttccagggaaaatctgtgtatgattgtttagttcgttggaatgatactaataaatttgtgccttgcacagttgatattcaaaatccaggtgacctgaagccattagcagattacttacttaaacataatcttatctctggtctttaataaaagaccttaccaaggtttgtgatgcatagtgatgttattcaaactctaagttcagcaggtgcttacttacctaatgatactatatgccctagggcaaaactagacactggcacatactgcaactatcgttgttatttttgctattaccaaaatgagttagataaaaagacaccatttgaagtcattaaaaaaagaatagatactttatataatataggttgtagagattttgatttaagtggaggagaatcttccatacacccagatttctttaaaatcctagaatatattaaatctttgaatccagataataaaatatcttgtttgacaaatggatctaaatttcagaataaagattttcttaaaaaagcaaaagatcttgggttatctgaaatattattttcattacatagtgttaatgaaactcacgataaaataactgggataaaaaattcttataattatataattaaagctattcataatgcaaaggatcttgatattgttgttagattaaattcaactattactgatgtaaattataaattagttgatactgaatatttcgaagttgttgaaaaattagaaccacttgaaatgaattttctaccattgaattattttagtcagaattcaaaatcaaaaggtgttaattattctgagattttagaacctataaaaagatttatagattcatcaagtatacctttgatcaatgtccgatatgtcccgttttgttatatgactgggtatgagaaatacgttgtaggatattatcagcacatctatgatatttacgattggaatattgctatgtatgaatacttagaacctaatttagtaaatttagcaaaacaagctgcatctaatagacaaaaaagttataggaaatgtgatgcttgtagaacttgtaagtatttttatatttgtgatggtattgagcctcaagttcttaaagcaggttgtgagtttaaacctattcaaggttctaaaataaaagatgttaatacgtttagaaaatcattctttaatttttagtttatggttttagatcttaaactttagactttagttttagatcttaaactttagactttaaactatagttttaattttttaacattttaaaaggagtgtaatggatatttcattaattataggacctatgagatctggaaaatcacttgaattgttaagacaagcagagaaacttcattttagtaacaaaccttatgttttatatagacccaaaactgacacaagggattttatatcaagaagttttagacctagtttagacttaaatatacaatactataacaatgaaaacttcagtgaatccaaatatgattatatattattagatgaatttcaattttttgaacctgaaattattaataatatattagaatctaataaaacatttgttttatgtgctttacaaagtggtactaataatatcaatgaaccttataatgtagaagtctttagaaatgtcaatagaattatgccattttgtagtgatattagattgttaactagtatatgtgaaaattgtggcagttcttgtgctacacacagttataccgatgttatcactgtttctgataattataagattctttgtaataattgtttagattttaagatttcaaatgctggtatttttaagagattaaaaacttgaatcattttaaatatcttaaactattattaaaaagtataaaaaatgcttgagtttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttggctttttagtagtatatactatagtataatgtctaaaacttaaagcaatattaaaaagtataaaaaatgcttgggtttttagtagtatatactatagtattactaaaagaactagaatctaaaatatcatattttaaattattcttataaaacttaaaacttaaagcaatattaaaaagtataaaaaatgcttggctttttagtagtatatactatgctagtactgctaaaacttaaagtaatattaaaaagtataaaaaatgcttgggtttttagtagtatatactatagtattactgctaaaacttaaagcaatattaaaaagtataaaaaatgcttgagtttttagtagtattatatcctagcatatgcttaaaattttaagtatattttaagtattttcataatataatactatcaatagaataaacaaaggttaaaaaacaatgaataaaaccgataaaatgattgaagctatcgaggatacactattaagtccagaaaatttaggaacacatttctacgttttagaaaccataaaaggatttgatttcagtattaagttcgataaaataaatagctctattaaatattttactaaaagtaaaccaattaattttgaatctaataaaagtccaaaaattaaaacacttaatgatactattagtgaagttagtttaattaacaaattagtagaattaattaatatcaaatacccagaagatgaccatattgagttctttttgacattatttcctattggagtaagcaagtctaatgattctgataccgcaggatatgcagtcataatgtatgacattttagtcggttcaaaaccactagaatccaaatatgaagattttgataatgttttagattattgcactttagctggtatcaaaacgaatccaattattagaattgcaactgatttagattctgctttaagtgttcctgtaaatggtgattctatgattccatatcttttcaataatagttcggagttgatacctatgtatggcatcaccatcagaccttataaggaattacaatacaaattaagatctaaaactcatagacttattattgatcttgatgagtctaatatgccagtaggttctaaaactgaagattcagaatttcttaaatttttaaacatagaatcattaaatgttgtaaaatctcaaaatccaaaaaatttagaaacagagctgatatattatataatagaaaaaataaatgaaataaaacacttgagtgtagaagaaattaaaaatctaaaatcaaagtactcacaaagagttaaagatttcatctctgtgaactaaaacactaaaatgttaagtttaagactaaaatgttaagtttaaagaactaaaatataaatcaaagaacgaaaggagtaaaattgtctatgaaattttttgtaaccggatccagtggtttcctaggatctaactttattaaaatactatattcattggattcaaatccaagagtaattggcttagatgtaaatccaggcgaatatactgatagtacacaaggtattaaaaatgctaagaaatctgggttgcttaaaaacttaattaaaaatagtgatatagttgttcattttgcaagccatttaggtgttcaaaatattgtagataacccaaacttaccttttaaatcttttaaaaatgataaaattgttgtagacttagccactaaatacaataaaaagattgtatatttttctacttctgaagtatatggtgattctaaagattactcagaatccaatgatttaattataagttctaaattaagatctaattatgctttagaaaaactttttatggaaagatatatccaatcaaaaacaaataattatttaataataagaccttttaatgtttacggtcctgatcaaaatccaaataatggattcattgctaaagtattagcagcagctttcaatcctaaagaagtgattaaaatcagagtcgatgctgagtcaaaaacagggactgaaagatgctattgttatgtagatgactttaataaaattctttataaattaattaaacaaaatatcagcggtgtgtttaacataggaaatcctatggctagagcaaatccattagatatcataaaaatattcaatgattttgggtataatataaaatataaattcgaaactattgaaaatgaaaatgattatgaaatacaaagacgagttcctagtattgttaaattaagcgaagttgttcatatcgattttacaaatttaaaaactggtattaaaaatattttgtattatattgacccaccattttgagataaaatttaaaacctaaaatcaacaaggggtaaatatgctaaaacatttaataattgcgggccatccagatgacgaggtaattggttgtagttctatactactagaagattctgttggtgttctatacatcacaaatgattatagtactgctaacacagaacgtaataaagtcaaagataaattagctttggattatcaaaaatgtttaaaatattcattttttaaaatgcctgatattaatgaattagctgataatattaaagacgttttagactccattaaaccagaaaatgtttacgttcatcatccaaaagatttgcatcaagatcataatactattacaaaagcaaccctaatagctgctagaatgaatagaaatgattatattaaatctttaagttattattatgttgaaaatccatttgaattaaaagcttgtgaatttaaaaaaatagataaagatgaaaaacttaagtttttatctaaatataaaaagtatataccggaaaatcatatcaaaactattttagcttttaatgagttcgtaggaatttatagcaatttaggttttgctgagccgtttgaagttgtttataagcgttcttaattacattaaatctaagaaaaccaaggaaaataatgagtgaaattataatgattcacgaagtaaatgataaagttctcaaagctgtagaatctttagacccagacagcataatcacatttgatgatggtttatatacacaatttcattatagaagtcattttgcgttatttaaacgtgttatattctttgtaaatccgtccataatttgcgaatcttccgagaaacaatctaaagagtatatacagtgctataacgcccataaaaaggcatttaaaggctgttttgaaaattatatgacattagatcaaattcagcaaatttcaagggaaaatatgtataattttgaaataggttcacattcttataatcataaatattttaaagattctaaatctttaataaaagatattcaagattctttagatttttttgagaatcataatatacctattaaatcattttgttttccgtataatcaagattcgagaaacccacattttacccaagcagttaaactaaagtttaaagatttggatatttttggtaataacagagtacctattgaatctaagttctaaatgttaaatattagactaaagtcttagattttagactttaacaatacaccaaattaaggagcttaagtgaaaaatattaaagttaaattaatagcagattctggtatcaatgtttttattgacgctgtcagaacttgctgggatagtcatagtaaatgcgatactaatggtgataatgtaggagaaaatgataaagcattaatagatagaatagtacacaaacataaacaccattctacattagaacatttgttttataattttgaaatcacaggaatttcaagactttgtttgcaagagttggcaagacacagaatggcttcattcagtgttaagagtacaagatatacactaaaagaacttagaggtgctgatatttctacattagaagatgcaagtaagtttattgttttaactgataatgaattagtagatgctgcaagccacaaaaacttaaaagaacttcataacatagtcaatacaaatggtattacccaagactacgccaagtattgtttaccagaatgttatagaacttcattaagattttctttaaatgctagaagtttaagaaatctattagaactaagattatctaaaggtgctcatttcgagattcggtatttggctaaattgttgtttgatgtattaccagatctacacaaagaattaatttttaatgatttagaatattcagagaattaatttttaatgatttagaatattcagaataaacacaaggagttaaaatgtatgttacaaaagaagtagacgtagaagttgaagttgaaatagatgaatttagagactgcgacgtcttaagacacgccagggatttaattgaagataataaatctaacctagaatatttcgaaggtttattagaaccagaatttaaatttgattttttaaatgatttatataatatagaatacaaaaaaaattattttgaatcatttcctgagcataaaaaattaattgattttataaaagataaagaaaggagtttagaatgttatctagaaagataagaattgatagctttatctctgataaagaaaaagaagaaattcttctcaagatacaaaaaatgaatattactttgtaatatttgattaaattcttatagattcttatagaatttaaaaatcatacttaagaaccaaggattttaatgaacgttttatataataatgaatatattgattttacaaaagaacctttattttttggaacaggtaaaaactcacaaagatatgatgttataaaatatcctatctttgaaactttgtttaagaaaatggctggttttgattggcaagaagatgaagtacagtgcactaaagatcaagcagatttcaatatcttaaatgaagcaatgaaacattcttatactagagtgttaaacaagttaattttcttagattctattcaaggcaggggtttattacaaactattggatctattgttactaacccagaactagaagtttgtatgacagaatggcaaagatttgaaatttcaagacattcaagaagttacacccatattcttagatctgtttatgctaacccaagtaagatatttgatgaatcttttgaaataccagaattattagaacttgcagatagtatttcaaaaccatatgaagaagcttttgaagctgtaacaaagtatcatttaggattaatagatactgaagaagttaaagtaaaagttcttaatatgttagtcgaaattaatatattagaaggtgttagattttattctggttttgcgacaatttggagtatgcattatagccaagggttaatggaaagaactggcaagattttacaattaatttgtagggatgaaaacctacacttagcaataactcaaaatctaattaagatattatcaagatctcctgaagaaggctttataaatgcttggaattctattaaagataatataactgatagatatttagaagctgctgatcaagagtttaagtggattgattatttgtttagtaaaggtgctttcttaggtatgacaccagaattagccaagaattatattaaatatcttattaataaaagattaaaagctattggattcaaagaagtttttgctgggtttaataagaaccctataccttgggtggaaacatatattaattatgataaaaatgaagttctcccgcaagaatctgaaataacaaattataaaatggatattttagacactgaaattaaagattctgcttttgaaagacttaagaagaaattaaaaatctaagcttttagattttaacactttagtgttatttgctagctctatagtgttagctttcagttcgttaacactatagtgttttgttgttaattttattttattttaagtttattattataaaattatataaaattaaaaggagcaaaaatgaaagatttaacaacaaagtttattaatattatgttgaataacagctacgatgaagctctacacaacaaaatacgagaaaaattatttagttccgatttacaaggttcaaattgtgacacaggttttgaatcatttagacttgaactcaattgttcaattgatgaactcaaatcaaaattattaggttgtggataccttgacgacactgacgaggatttgtgggacttttttaagttaaaagattctgatggtgattcacaatgggataattacgtttacagtttaccttcatctacaagagagttaagcagcactacatttagaattaaagacggaaatactattgttttctacgatatggtttggggtaacgaacaaacttgccatttgacttttaagaactagtaaatattacactttagtgttaacgaacttaaacgacactaaagtgtaaacttctaagcttgctagtactattgaatatcagtatccttgaatcttgataaaatcaattttgtaatataaaattgtgaactttctattttatctataaacccagttaaaatatactcaccagaaattttagtgtctccttcttgtgtttcattagtattttcgttagatttaaataatactttgtattttgtgaatatttctggtgccttaacaactccaggtactactaattctaacttagaataatctaaaaacgatttatatgtatcagcaaaaatattatcatcgtacaaatattcttgagcttgatattcaaaaccatcgtgatcttgagattctactggaacatcgaaatctaaatcttcaagattaattttcataactttcattgttttagtagctttatcaaatgcgattatttgtgatttcggtaatttcagagcttggtttgtgtttataatcttcctagataaaatatcataagggttgttaggatcttttttaaaatcatcatattgtatactttgaagttttaaattatttggtttgagttctttataaggtttcataacaattttttgtttatcctgaaataatattaatccttgtctatcacattcttcgaatatgaaatccaatacagattttcgtgaagttaaaacgaagttttcaattacgatgttgctagataattccaatttaacagaatctggattatattttaattttggtttaatataagtatcatatatatctttaaaaatatctgaaagttttttatttttatatgttttagctatatataatttactaaacaaataagataccaaatcttgaccttgtattgtaaaactggatttatcagttgtttgagttttattatttttaacaacttgaaattctcttctatagtaaccttcactagcatctaatataaaaggaataaatcgcatatcaccggattgatctaaatagtattgtaaatccgtggtgccattgactgtaaaataagacaagatgataaaaccattgaatgaaatttcaccagattttgtttctccagtttttaattcaagtgatttacttgatttattattaagaatagataaagtaaaatctttgacatcacaagcgtgagaaaatagactttgagttcccggattcattagaacctaccaaatacatcatcagaatttgtataaaaatcttttgtttcttgttgttgtttatctttaatagaactcaattcatcgaaatatttttcaagctcgttatgcatatctgtattaggtgtttgcttgtctaataattcgtcagatctaataacaaaatcactttcaagttcatcagattttttaaatacataagttttacatttaaatttataaacatttttatattgattataaagaaatacgttatttaacccaaaacaatctaacgtaatttcggtaatttcaagaatctttccacttggaacgattattaaagatcctattaaatcgtgaattctggaatctggtaaagttacatcgtattcattcttagaattcattgaagattgaactaaattaaatgtggaaattttagaaacatataaacctatacttgtatctaatgggacaccaaattgggtttgtaacctttcatattggtcaaactcttctgaattttctggcataccaaatatttcaaaacaagctctattatccgctttaaaatgactaaaatcaccaaatgttaaatccctgttaatttttttggtaatgattaatttaagtggagcaccataaagtctaatgagttcttcggtaacagatccactcagatcatattcattagtatgctggttaaaattcaattttaaagcctcatttttgatatatttattttaagtaatcaaaataaataaaatcaaaaggttcaagatggacagcacagataattctaaagctacaagtattgaaacaaatcaatatataaaaaatccaaaatatacaacaaaagaagctattgataaatttgttaacctattgatcctgggtagatacactgaaaaagatttatcagatgctttgaactattgcttaatacgtagcacagaaagttttgataatatagattctataaaagaagctatagaagaacttaagaaagattcagaagcttttaaaatattcatagataatacaaataaacttttagatgctattcaagatattaataaagaacaaactgctgaaattgataaaattaatgaattcttaaaaacagcagtaactttagatactgaacaaactattacaggaactaaaacatttaataagatttatgttccaaatcctacagaatctaaacaagctgctaacgctcagtatgttatagattatgttaaagaacaattaagtaaaactattggagatttaaataatttaaaaactgaatctaaagatttaattattaatgctattaacgaagttcttgacaatttaaatgcttataaagaaactataaatgaaactactattaatcaaatgattgatactaagttaaatccattaatagaaagaattacaacaattgaatctactgcggattacaccaaagaattagcagaagctaataagcaagctattgaagatttaaatacaaaagtagttgataatactagtgatataacggatatcaatagaagacttgaagaagctgttttctatagtaaaattgatgatactcgcaaaactatacaacttaaaaattatgatagcatttccggagttagtactactggtgaaggtatcaatattgctatggtttctaaatgggataaagtagatttaggatctaatcaaattcctattaacttaaatggatcggaaactagaccaacttataatgattccaaagaaatagctttaatagatgatgttaagttgaaagcagatgctagcaatgtttataataaatctgaaattgatactaaattagatactaaagcagattcaaatacagtttataataaagaagattctgacgctagatttgttagtttaactgagaatcaaaacattcaaggcaataaagttatagaaggtatttgggaatttaatggaatattgtctaaaccaaaacaattagcaactactgaatatgtggtaaattatgctaaaacatatgctaaccaaaaagtcggagatttggcaagtcttaaaacagaagctaaagatacagcagtgtctgctatcaacgaattatttgataagattgaatctggtaatacagacagcaaacaactaatacataaagaatacctagataaaaatattgcagacaatgtagcatataatattagtaatactccattagtaccttacaatgatgttagctctttaaacacaaaaaatatcggtgtaagaatatctgcgacaactaataactctagttattcatctggtgatacagtagtagttagtaatttcaagataaaacttaaaggagatgatgaataccttaaaccttatggggttgaagttgttgatagagaaaataataaaataggtttaaatttaataggagatgatacagtatataatgataatgatgctttattatctacaaggccttctgatttcaactcatctaatgtagatctttctagtggtagtaatgctgtagctgcagtaaaaacaaatggtgcatacgattatagtggagtatatgagatttgtaatcctttcagagagtataataaaaaatattgcgtatttttaagttctgatggattaaaaaatccttactatcaagttgatataagtagctccaaacaagttgataatatatcttttcaattatttggaactagtgctacaaatccttttttatattctaaagactgtaaaattgagttatttgtagaaaatactgttgtaaaaaccttcaatgttaaaggaagctctgaaaataatagtcctgtaaatattaatatagattataaagatggtatgttcttaatatctgttcttgattctataaattatataaataatagaatcaataaaaatgcagagttacttacagggttagggaaacccaatttttcactaaaccctaataaaataggctctctatactctgatacaacaaataaagctgtatatatgtgtatagacaatacttttggtgctaataaatgggtgaatatagtaacaggtgatgaaattaaaccaaaccttagaaaaatagaaatcacttgtaatgtaaacttaagaagtggccaatacggtggttgtatgagtggtgtaaaactaggatttgacaacgggtatgcttctacaaaacaaatcgttaaaggattaaataatggtcagatattatggtcattagacggtttaggtaatctagctagttattctgaagtaggttctttatctcctagtggtaatgatatcaaaggtgatgttactactactggaatatataacgacccttcatatcattgagttactaatatattcaaagagtatcttggaaatgctgaccagtgttcattatggtctgacgctagcactaaacaattaaaaataacattaatatctgaaaaagtccctaataaaattacttatgtaggtaacggatattatggtcagacttctgtatctgatgtaaaagctatatggtattatgtaaatgatgacggtatgaaagtagaagagtctgtagataatgaacttgaagttagtgttaatagttcagaaacaaacgatagttcttatatatatgcgttcaatataaattagatatgtaagactgtattaatgatagtgccaactaaagactttttaaaagatattatttggaaacatcatcattattattttttgattcattttattaaagaaaacagagatatttatattgtctttataattataaataaagttcgataaataatttatatctaatagatatatcataagaataatttaaatttaatttagtagaacattttaatttaggtgtttctacaaatatgatcaaatgaggtattgaagccgaggattcttaatggctttctttcattttaataccctaagaaaatatactggagctttgatacatttattttctaatttagaaatacaaactattcaaagtaatggtaaaccattgtattctatagttcctattcagtatgctaacagggaaagatttgatatttatagtcaattatcttataatcaaatgtttaatggtaatactcaagttttacctagaggtatactcttgtttactggtatgaatgctaatatcaatagagcaaaaaataaatttgctaagatatatagaaaatcacaaataattaaaggtgaaactaaaaaattaaattatcaattcaattcagttccttatgattttacttatcaagtaattatacaatgtcgtggaatgaatgaagctagtatgatattagaacaagtcgctagttattttaatcccagttattgtttaagaattaaagaagtagatttaccagattttggagatacctcttgtatattagaattaaactcgactagtgtagatcaagaatctatggatgaattaagtactaatattgtaacttgcacttttgatttaaccttaaggggtaatatatacccagcaataaaagaacaacatttaatagaattagttcaattgtttatgagcactgatttgccagaatctactgaagctaatccagtagtcacgagagtttattctgaaggttctaaagaaactgaatctggtatccaaacttttataaatcaatacaaagcggttattaaggatatagaattcaaccaagattatttactctgtaaaatagattctgaatgcgagaaacttattaaatttaaatttaattggtgggtaaatgacatcaaacaagacagtgaaattgaaaaattacattatgcaccacgagatgatgatattgtaaaagttcaagcatttactgatattgttgagagtgatatctttgaaaaagaattctattctgacgaaccaagatatgatttaattattaatgatttaattagggatgaagaattcttagaatgtgattttactgacagtaatccatcaaatattaaatatacatttgaatggtttataaacggtgaaaaattagatttaacacaacgaattattaaatataaatctaaagttagctttgattgtgaatgtattattagaagctctgatggtagagaagctaaatattttaaacattttcataataatgaaataatttttaaagattcttttaaaataaaagattctatgaaactcgagctcaaaacagatttgaaatccatagccattggctacaacgattcaatgggtttcgatactaataatgattcaaatgatgattcaaatgataattaaggtttagaatgggtactttttcattttcattatcggatataaagaaacaattaggtcctggtttaggagttagatcaaatgcttacttactagaagttgctgtagtaggtgctgtttctaaaaaattagcagttctttgccaaagcacagcattacctgaaagaaatattggaaccactgacatattctacaaaggtagaaaatataaaatgcgtggtgaaacagacttaagtggtacttacactattaatataactgatgattctgaaatgaaacttagaagaatgttcgatagctggatgagagaagtagataataccacacctaaagggactaatgctttagcaggcttatttggtggtgctatgggtgacttaatggaggtagctaatggaactttgaaagcggttaatgaaattaaatctgcttgggagtttgatggtggagtttcttggcttaaaaatatgattatgggcaagccactaccagcaaattatcaaacaactgtaaacatttggcaattaactaaagtcaaagaaaaactatatgggtatgctttgactaatgcttttcctattgaagtaggtgcagtagaagtttctgatgaaaatgaaaatcagttatctatgtttagtgtaacttttgcatattcagattttgaacctattgaagataaaggtgtaattggacaaatagttgatactgtaataggccaagaaggtcaagaaattgtacaaggtgttgaaaatctattggattaaatattctttagatttaaaaatttttaagttttaatattatataatatattaaaaatttaaatttaaaagatttaacactacagtgttaaatgttagctctacaaaaaactgctaaaatcactaaaaatttaagaatattttaaggattaatatattataattacattgtaaaggagatcaaatggatatttcaattaaagaaatacaaccaagtcctgaacaattgaagcaatacaaagctcaaagaataacacaaagaaaacgcatcataaaaggtgggtttgagcacgttctcgtaacttcggattctgacttagatggtattcatataggcgctttattgatggggtttatagaaagatttaggccggaatacaaaggtagatttggtcggtttaacacgcctgttaaaatggttttaaaaggtgaaactcctattaaatggacttatgacatcacagaagagttaccggttaaatccggtgaaaatgcgaagtatttcaaaggtttaggatcttggcaaaaagaattattagattttgttattaagaaggatgggttagaaaatatgatcgatgtctatgatttcgataatattaatataattaatgacttcttaggctctgaagagagtgataaaagaaagaattatattagaaatcattcttttagtatagcaagtctgtaattatttgattgttttacattttggtgatttaatttgattctaagttttaaactttagtttataatttaaagtttatattataatatagaattaatattaaattaagttttttaattttttataattggttttaatataatagattaaaactgattaattttttaaaggatatttatggatattaattttgattggaattcaatgaatgcgggagctaacccattcgaatctaaaagttatgaaagtgatactcgtttttataccttagcaaaagatgaaaatggtaatggtgcagctttaatcagattcttacctagcgaagttcacgaaaatggctcaatgagtaccattatgaaagtattcaaatacaatgttagatctaaaacttctaaaagatttatagctgagtggagtccgagtacaattggtttacctgacccaattcaagaaaagtgggcgtctctttggaatgctggcaaacaagatgaagcaagaagatatgcaaggtctacaagatacattgctaatattaaagttattaaagatccaaaaaacccagcaaatgaaggtaaaattttcttacttgatatgtcacaaacacttggtgagaaaattaaatctattttaacgccaaatgaacaagaattagcactaggtgctgttgctaaaaatctttttgaccctataaaaggatttaactttaaattgattgcaactaaaggggccaatgggtttatagaatattcaaaaagtgatgctgaagcaaatccaagtgcaatttataatagtgtagaagaagcagtagcagatattaaaaataatgcttataaattgtcagattggcaaaaaccagaaagctacaaatcttacgaagcattaaaagaattactagatggtttggatacaccagtagaatctaacaatttagattcaatggttcaaacagcgccagtaacaagttttactgaaccggaagcaccaacagcaccacacggcacatcatcggcagcaaccccaaaaacagaagcaccaaaagctccaagtgctaaccaagcagataatcttgatgatttgatggccgacttattaaaataacttatagaagctctgacgagcttcttctcaaggaagaattatgattgatatcgaaaactttaaaccacttcaagattttgttctaataaaaacagaacccgttaaatttgaaactgaatctggcatcattacaaaaatacaaaaatcaaatctttacgatcgaccaaccaaaggtgttgtaattaaacaagggcctaaatgtcaatatgatttggttaataaaacagttcaatgggatatcacaaaaggtcaagatattgaagaaaattatattcttttgactgaggattcaatactaggaattatagagtaaatgagagctcagctttttgaattgcaccaagaactcaacaatatcaaggataatataatcttgttacattgtgatatgtttccttatgcaggaaagaacatcataaatttacatatacaagaacaaactatgattaatgtagcagctggtattgcatatactggcaaaccagttataatctatggagttcttggatttgtttttcttaaagctctggagcaaattaagtttagtatattagattttagtgcgaaatatgctccaataattatgtgtaatgctggatatactaggtgttatgaaatgtatggcaaaggccacattttcaaagaagaattagatctttgtaaagtttataatattgaatatttcaaacctaataaagaaaattttaaaggtttgataaaagattgtttaaaaacaaatggtttcaaatatattttgatatattaaacataggtgaaatataataatttaaaactcaggaattttaatgaaagaattagtagcatcgtggctagcacgcagatttacagataatgactttagaagtgttctcaaaaatgtcgttctaaaagatggtataggtaaaggcaccaaacgcccagataatgctaccaattttgtgaatacaaaaactggtgaattaatagaacctactaaaattcgtgaatttatcaaagctatgaatgtggaggttcaaactcgtaataatttttataaaggtaataccgcttatcaaaatgtttcacaagttccccaaagtggtattttacagggttctgtggtttcaaacacaccttatactgctatgcaggttgttttagaatcatttgtaggtgatggtattagaaattttggaaccgcagttcaagcagattttaatcaagttaaattaaatcaaaaatctttatttttagcgcacggtaattattttgcaagattagaatttacagcaagtgcgattgctaatatttctggtggtgtaagattaacttataatcagtcacaactttggtatgatcaaggtagatcagaagttaatattaattatgatgctttaacaaaaatattagctcttgaaaattttacagatgtagaaattggtatagcagattttagctctaaaaaaattaaatggtttaataacgttaaacttaaagcaagcacattaaaattcacagtttcgcaaaatacagaaaatgctaataaaacagtgcaaaaacgtatagtttctgggtatttagattttacaattgatcaaactattgaggatacaatatctgagaaattaagaggtgctttgatcacagctgctagatttaataaattcaaacaattattaaataaagctgaagttgcttgtttatgtgattgtaattattgtacttgtgattgtaattattgtacttgtgattgtaattattgtacttgtaattgtaattattgtacttgtgattgtaattattgtacttgtgattgtaattattgtacttgtaataataataaagaatacactgatagtgttaattattggaatggtgttgtttgtacttgtaatgcgaatattacttgccaaactcaaggtcctggatatacaccagtttatgaaaacagatatatgaccgagtgttcttgtcaaggtgatagaagtgttccacaatacaaccaatacggtcaaatatatggttatgcgtgtagatgtaatgctaactggattaattctgttagacaacacgctactgtaactcaagtatgttcttgtaacgttgataaacagtggactaaaaatattacaggtaaaccaatttgggataaaaaatctacgggccaaattgataatattgtcaacaataacacttcaaattctcaaacaagtactactgtaagagtttgtgtttgtgatacaaacgtcacgatagccgcacaatgtgctacaaatagaacaatggcttatgttgatggatcaactggaagtcaaggcggttacagatgtgtttgcgatatcaacacaaatagacaaattgcttgttctgctaatagagaatataaatatgtcactgactatactcaatttcaaaacaaacaatacaattaaaactcaattaacatataatcagcttgaagttcttaaaaagagcttcaatgctttttaaaaatttaagatcaaagatttaaaactaaagtttaaattttaaaatatttaagacgcttttaagtcaaaatatattataattattttatcaaagctgtatataaaggagatataatgaattatttagaacttaaaaatatggcagagaatttaaaagattctaattataggtcaacaaaattaaatgattttaaattctatacttatatattgtcagattataaaaacttcaaagaaaataatacttttttcataagaggtttaatgatagattctaaatctatattaaacaaagatactttagcacctggtatatcgataccaataccaaaattctttaatattaatgaaaatgaagattggatattaccagattctacaaatcttgaagatttcactatagtgacaaaatacgatggttctttaatgataccttatgaatatgatggtataaaatttagaactaaaatgtctattgacaacgatcaaactaaattagctaataagtatatcaaaaataatccagatatattagatctaataaaaaataatccaggtacccagtactttttcgagttgatttcacctttaaatagaatagtagtagattataataaaactgaattaaaattaatagctgaattagatcttagaacattagaatttaaaattcacgaaactaacgagtttaattttaaagatttaaatattaggactctaaaagatcttaaagattatataaacaccatatctaattacgaaggtgttatattacagcataaagtaactaaaaaagtctacaagttaaaaacacaagaatatttagacttacataatactgtaactaatttagatttaaaagtgatatacaaaatgatattagaagaaactatagatgatgtgttaccaaaattatcgccagaagctgtggcttatgttgattctgtatctaattcagtaaaagttaagttaaatgaaatattagattctatagattctaattatattaaggctaaagatcttgaaactccagctttatatataaaagatttgaatatagatcctatagccaaagattgtttatttaaattatgtagaaataaacttaatttagacaacgtcttagatcaagttaaaaaatctatgttaaaatataacaaattgcgagatattaaggtttttttaaatgaattcatttatatattatattgcagtttacggcgggataagtgtgattttgagtgtttttgcagtatatatttctcataagttttaaaggtataaaatgaacacaattaaactaacttggaatgatgttcaccaagctttgcataatcttacaaatgaagtagatcttaaaaattttgattgtataataactcccaatagaggtggattaataataactagtatgttgcaatacacccagggtgttaaattacctgtttatgtaattaataattctgatgtaatcaacattcaaaatcataaaaaattttgtttttagatgatattaatgatacaagtaaaacaatatttaaaatacaaaaagtttttaatggtctcataacatttaaaacattatttgaaagatataatagtccatttaaaactgagactatcaatatcatcttgaatgatgcctggctaatttttccttgggatgttgaaccagaagttttaaatctaagaaagtgagtaattaatatgctagtaccaaaaataatcagaaattcaaaagtttatagatttataaaaaatatcattaaattcagaaatgaattaacaatttggggaccttatgagccaatatttgatttaaaattgatttataaaatgcttaaaatcaaaagagaatattggcttgatgattgtggtggtgcagcttatgaaggtatggaaaaagaattagatactttaaatagactcttaaatgagttagacttagtatttaaatattcacgtgctggcgacgacgaaactgctatgatccattttgacatttttatggaaatttataagaaaaatgcttttaaattgtggtgttgatacaaaatagcgtgtagaatctagaatctaaaatactgaaatatttaagttatatttaatcataaatacgatataatatatctaaaggagaattatggaatatttaccaaaaactcaaggacctaaaaaactttataattttgatattaatatgactcaagcgtgtacactaagatgtacatactgtattcaagattttaataaacaaaaatttgaaaaattatcaccagaacttactaaaaaaatgatagaaaagtttgattttctgttgaattcagtggaattcaataaacattatgatggtattagaatttcattctggggtggggaacccacaactaacctagaaggtgttaaagagtttgtagaatactatagacacaacccaaaagtttgtttctttatgtattcaaatggttataaatacaaccacgtttttgattacttagaaacatttaagtatatgccaaatgtgggtagtgaaccaaaattcttgactcaaatatcttatgatggaatggcaagtcacgattcagatagacttaatttgcaaggtaaaggttcagcacaacaagttaaagaaactgtttttgaactagcaaaaagaaatataccttttattgtacatcctacgattgcagccaagaatttcgataagattgctattaattatttcgaatttaaaagaatgtccgatgtcttaggtattgaacttaattataaccctacgatagattatatgtctaaatatgattttacaaaagaacaattagaagcattaacaaatactttaaaagaagaattcttaaaaatacgtgatgctgaagttgagttctttaaaagaaaaggatattttaattttggttggatgaatccaaatagaagtatttgtacagcaggtgatggctattctggtattgaattggatggtaaaatgtatgcttgtcacggtgtttttagtgaagaatataaaccaaataatgttttaaatgatattaattttgagaatgtaaaatttactgaaacattgattaagagctcacaagatcatagaaaaatattaaatgaaaatatgcccaaagcttgccaagaatgttttacacattattgtttaaaatgcaattctacaaaatttggtatttctaataaagaaacctacgcagaaagatggactgattatagttgccaacctggtttatgttatatgtttaaattcataggtaaatatagaatagctttgatgaaatatattcaagcttcttagaattctaaaatagttctaaattgacactatagagctagaagttaacactaaagtgttaacactaatagaagttaacactaaagtgttagatgcttagatccaaaataaatatacaaaaagtaggatttattttgagtataataaaatcaactgctaggagtattagaggtacttatagagcaggtaaaaatgcagttaatagtgttaattctgcttataatagtgctgttagtggtataaacaaagtaaattctgctttagatcctatgaatacagttagaagtgctactcaaagactcaataactggatggattcggattctaaagtatctaagacaactcaaaaaaataatgattcaattgttagtgaattaaacaacgtagccaatgaagttgttagtgcagccaaagctttagatcctatgaatgctagaaaattaacagaaatttcagaatctcttaaaaatatttcaaaacaaatctcggatattaaaaaaggattaatagataatcaagatacagaaataagacaccaaggttttgataaaaacgttcaaaatgtttcagaatctaaagtaaatgtacctcagaataaaagtttttttgataaacttttaggttggttaggaggtttattaggtatatcggcaggtgctttattaccattattgggatcattaggaagttttttaacaaagcctttagatttcattttagatctattaaaaggtggtattaataaattatggactttatttgagccattattaggccctattatagaccctttaaaaaatggatttgaattcttaaaaaataaatggaactcattagtagattttatcaataaaaaaattaatattggtgataaatggaaaatctcagataatgataatccaaaaaatccaaaatcaccaaaagtaagttcatctaatccagctaaagaacaatcttggatgtctaagaaatgggattcttttaaaggtgctatgcaaaatggatatgattgggcttcacaaaaagtagatgatttaaaatcatatgctagtaagaaatatcaagatattaaaaattctaaagtaggtaaaattatatctgcaggatatgataaattaaaagcagcacaaaaatatattgtagaaaaagctattgaaggatttgatgctgttaaaaatatggtaagctctgcttgggattcagcagttaaagcagcacaaaaaggctttaatatgcttaaaaagtttgctttagctcctatggagaaatttgttagttcagtaggtaagaaactatttggaagttctaagttattttcagttctacctagtatacttggaaatcttgaaaaaataggagcaagattagctgctagtggtgctaaaatagcttcaaaagctttaccaggtgttggttttgctgtaggtatataccaagcttgggatttctttactcgtggtagatgggtattgggttcaatagcagcacttagtgcttgtatttcattattaccaggtattggtgggatcatatctatgtgtttagacttaggtttatttgctactgatattataacaagtccagatgatgtagataatcttaataaagaacaaaatgatttagtaaatacagcaaataaaatggttcaaaataatgatactggaggtattttagaaccaagtcaagtagaaaaagataaagcacaatctggagttcaagattcaagttctaattcaagttcaagtaataaaggattaaatgctaaagtacttgatggtaaatctgctaacgattttgctgcttcgtatacaccacataaagtggattctaacggaaccgttatagctgctaaaacaggttctatatataaaggtttgacctgggtagaatctgaaaaatatgatgctgaaaagcaagcttattttaagaaacgtgaagaaaaagaagcacaattagatgcgctttttgaacaaggtcaaaaagctatgaattctggagatactgaaacctttaataaattagttacacaaagaaataaattatctgatgaattatctaaaatgagcttagattctatcgattctaaatatcaagctattggacaagcaagaattaaaaaattgcaaagccaaggagctaatgcagatttatcggtatttagaactaatggagattcaagtactagttcagggggaactgatacaaaaccagattctacaaatgctagtgctagtgtagcttcgcaagcttctggttcaatctctccggcgcaagttcaaggagctcaatccacagaagcccaaggctcgagttcaggaggatctccaggagcaagagctgcagcagaattcagtaaaaaatataacttaggaactagagcaacaggcgcttgtgccaagtatgttagatcttatttgatggcagcaggatatccattatctggttggccagtagcagctgcagattatataaatttcttacctaaatatggttttacaccagttcaaggtagagcttcacaaataagcccagaagtaggtgacatttcaataacccagagatttggaaatcacaaatatgggcatattgctatttggaatggttctaattgggtttcagattttaaacaaaactcagtttcaatttatagagacgtaaatgctttcggtgggccggatgctaatataactattctaagagatacttcaggtcaaaatccatctcaagaacttgtaaatcaacaattatccaatatgaatagttcttttaaagttgcattaggaggtggaggtgctaaaggtgctgtttatagtttggattctggagtttcaaatgttgttacaaatacagcaggcgctgcagctagtgttataagttctggtgtaagtagtatccaatcttttgctaatgctaattctattacaaccagaaaatctttaactcaaatgtatacagaatctggattaagtactagttttgggtcaagttcagtcccacaagctgctagcccagctgcaaattcaacaccaaaagaaacaaaagcagatattaagccagcttcaaaaccagttcctaaagctgctagctatggtacaccacacagaggtcaatatgatgcagaaacaatggaagacttcaacaacttaggagataactttagtaaatccaaatcaccaatttctttacctggagattcgaaatctaacgttcaaactaacaatgctggctcagtagcaccagtaactcctgtagttaatataaagaataattcatctccaagtgattattcttgggcttctaaaaacagttttaaaattgctagaatgtttgggttagatggcatcagcgattacgaaatacttaatgaaggttcagaatctgactttttacaatcttatggtatgtctaaaagacaagcaattcaatcagcagggttaaacaatacagtacaaaccaaagttgctagtaatgttaaaacaaaagatgtgataccagctgtcaataaaacccaaataaataataccaatatacagactaaaacaaaagaaacttctaataaagatttgactgattcttttgttttgagctaaggttcattaaatgcaaaggattaaattttgggattatttggttctgtcagtagtgttatttcaggtgttgatttaccaaaagctacgaaaattttctcggccaacaatggtgctgaaattctaaaatttaccaaatctttagaatctgataattttaaacataaacaaataatattaactgtttatgacccaaatgatttctataaaaaagtcaaagatgctattggtcaaaaaatgtcaagcctgatgacagcaggaacttcagcattttctggtgatgggtatgattcttcagatgctagccaagctctaaaagatgctggtcaagacattgtagatatgtcagctgtcaatatattatatacaatacatttaccattaatgaatgcttttcaggaacaaaattcccataattattctgaagatactggtattttaggttctatgtcaaatgctgctaatgaattatcaagtacagctagttctggcataattgaagcttatggtagatttggagattttggtggaaacacagataatatggcatttgctccgcaactaccacaagtagatccattaaaatggcaaaactttaaaggttccaacttaagaacatttcaatttacttttaaaatatctcctagaaatatagatgaagcttctaatatgatgagaatattttggttattaaaaagaagttcataccctaaaaaagaagctggtggtgtcttattgataccgcctgcaagaataggtgtccaattttcaaacccactgctacataagttgatagctcctggtatttgtgtaatagatggtgtttctatggtttatgaaaacggtgatgatattgctgtaacattagacggagttccaaagaaaatagagtttacattatcattaaaagaattccgtcaaaaataccaggatgattggaattttgaaaatgctagtctataggagttagaatgtatattagtaagcaacttacaaattatttagataattattcgttcagtgaagctaataagaccgaagcagaagtttgtaatgttagagattacaggtctatggattatagcactataacaaaatatattaatgattctaatactattaatgttaaaataaatgcaaatgatttcattgaaagtgtttctaatagattgtataatgatcctaatttatgggatttattaatgcttattaataataaagatgccttgagtgatatgccttatgataatgatagaatagcagatatggctgacgaattgatagccaattattttaataatcctgagaaaccataccaaggtaatgttactgaacaattaataaccgaatacagggaatatttgatagatttattgacacaaaagaattatcaaaatatgattataaaagctttagaccctgcttatttgggtgacttcttaagactttttaagtacaagtaatacactattaaaaagccaagcattttttatactttttaatattgctttaagttttaagcatatgctaggatataatactatagtatatactactaaaaagccaagcattttttatactttttaatattgctttaagttttaagcatatgctaggatataatactatagtatatactatgaaatatccaagcattttttatactttttaatattgctttaagttttaagcatatgctaggatatatactattgttatacactactaaaaagccaagcattttttatactttttaatattgctttaagttttaagcatatgataggatatatagcattgttatacactactaaaaagccaagcattttttatactttttaatattgctttaagttttaaaatctaaactaaaattttggttttaaaaacccgaaaaaacttttttaaaattttttaaaaagctttatattataatatatcatattaaagagtaaaaatttttttaaaaaaattttcaaggacttggaatctcacattaaaatacaaaacaaatcttaaagcaatattaaaaagtataaaaaatgcttggctttttagtagtgtatactatagtattatatcctagtatatgcttaaaacttaaagcaaagcttaaactaatattaaaaagtataaaaaatgcttggcttttttagtagtgtatactatagtattatatcctagtatatgcttaaaacttaaagcaaagcttaaactaatattaaaaagtataaaaaatgcttggcttttttaatagtatataacaatgctatatatcctatcatatgcttaaaacttaaagcaaagcttaaactaatattaaaaagtataaaaaatgcttggctttttagtagtgtataacaatgctatatatcctatcatatgcttaaaacttaaagcaatattaaaaagtataaaaaatgcttggctttttagtagtgtataactatagtatatatcctagtatatgcttaaaacttaaagcaaagcttaaactaatattaaaaagtataaaaaatgcttggcttttttaatagtatataacaatgctatatatcctagcatatgcttaaaacttaaagcaaagcttaaactaatattaaaaagtataaaaaatgcttggcttttttaatagtatataactatagtattatatcctagtatatgcttaaaacttaaagcaaagcttaaactaatattaaaaagtataaaaaatgcttggcttttttaatagtatataactatagtattatatcctagtatatgcttaaaacttaaagcaaagcttaaactaatattaaaaagtataaaaaatgcttggcttttttaatagtatataactatagtattatatcctagtatatgcttaaaacttaaagcaaagcttaaactaatattaaaaagtataaaaaatgcttggctttttagtagtgtatactatagtattatatcctagtatatgcttaaaacttaaagcaaagcttaaactaatattaaaaagtataaaaaatgcttggcttttttaatagtatataacaatgctatatatcctatcatatgcttaaaacttaaagcaaagcttaaactaatattaaaaagtataaaaaatgcttggctttttaatagtatataacaatgctatatatcctatcatatgcttaaaacttaaagcaaagcttaaactaatattaaaaagtataaaaaatgcttggctttttaatagtatataacaatgctatatatcctagcatatgcttaaaacttaaagcaaagcttaaactaatattaaaaagtataaaaaatgcttggctttttaatagtgtataacaatagtattatatcctagtatatgcttaaaacttaaagcaaagcttaaactaatattaaaaagtataaaaaatgcttggcttttttaatagtatataactatagtattatatcctagtatatgcttaaaacttaaagcaaagcttaaactaatattaaaaagtataaaaaatgcttggcttttttaatagtatataacaatactatatatcctagtatatgcttaaaacttaaagcaaagcttaaactaatattaaaaagtataaaaaatgcttggatttttcatagtatatactatagtattatatcctagcatatgcttaaaacttaaagcaatattaaaaagtataaaaaatgcttggctttttagtagtatataacaatgactacatttcagttaaaattcagttatattttaatataataccgtaagtataaaaaaataaatacttgaatataatataacaagcaaggaaatatatgactagtaatagctattcacaatctagtaattataaaatatttttaccttttctaggcgatgaatggatatatgctcaaaatatagcattaccggggtttagtctgaacccaagtcaagccaacttcggcggtaaaactatttatgttggtggtgaccacatagactatgacccagtaactgtaggtttccttgtgggagaagatttcaaaatatatacaaaattaatcaaatatattttcgatagagttcacccaaataatggtaatatcgaaccattaaaagaatttacttgtggtgtggaaataaccgacaataaaggagaatcgttagtcagtatgactatgtatggttgtaaaatcacaaacttaggtgctttacaactaatatcgaatgctgatgatgctgaacaaacttttgatcttacctttaatttcgataatttcgaattgatcgattattttgaatctattaaattaaaagaagctgttataaaatcataaagggttctaatggaacaagtaatagaagcagaaatcgttgagttcgattctgcgaaagctaaaatcaataaaactcaattaaatccagatgaaataattcaattggatttagtagtagacgattataataaattaagacaaattattttagctaatgtagcacaattaaaagttatgagtgacaacctagttcaagaaatggaaattgaaggatataacccagacttagtaactgcttatagtaaactaattgaaacttcaaacaagtctttaaaaattctaactgattcttataaaggaatatccgatattttaattaatattaataaaattaatgcattacacccaagtacagaagttaaagaagattttgaagttatttcaactgcagatgttattaaaagaatccgagattcgaaacaggattaaatattgaaaacaaagtatttcagataggacaaatcaaatgcctttaagtgtaaatgaatttattaagaaaccaaaatattttaaaccttttcttaataaattagaaacaaatgattttttattagaaggagatcttggtgtttttagttttgatttaaaagaccctacaaatattagattgtttgaattaattaaaagtatgaatattgatgctgtagaacttttaatatatgacaaagctactaaaaaatataaaaactttaaaggttcaattaatcgaaagaaaggtgaaataccttttagtaaaattcataaatctaatgtatctggtttaacattaaaaggtcaaaaaagtgataacaaagacgacttagcagagtgtggtgttgtatactatttagatatgtttttaaatactaaattaaccgatattaaattctataatgaaactcaagttaaaaatactaggactaagacgccattagattctgttaaaacatttttatttgaaaatccagattgggataaagcttgtaaagatgcatctaaatgtattctaaatgaaattattttaaaacaaaaccttagaaattatgaatttcaccacaaaactgatgtttttaatgatcttaaaaagcaaggtaaacaattaactaaattagcagaggataaatggaatcctggagatttctttttggttaaacctacatataaaatcaaatcatacaaaacttatcaagaacttaacaaagaaattaatgattttgataatataatacctataagtcttaagaaatctgctaaagaagctttaggtggttcctatgctttgaataatttatcaggtaattatggtttaccaaattttaaaagtattaaatataaatcattcgataataatttttttaatttttttaaagaatgtatggttgaattaaagaagcataaaaattcagatatcattagagttagaactaataacattaacttagctgacatttatgatgaaattgccagcaatgctaaagctgctaattttttcgaagggtttccaccgagtttagcatttatatctatgagttcaaaatattttaatgatattatatttgaagttgtttgtaattgtttaagtagatctctattaagttctaatttttataaagtttcgggaaatcatttagaagtatttgatacattgccttcagatttaaaaatcgaatactgtgttgtctcctgtgatggtaatgctgatatcaaatggaatattaaaatagacggtaaattatggaaattgcaattaagatctaaaggttctttaccacaatttatgttggtgcctcaaccggtaagtgcttcaagtcaagacaaaaaaattcaagctattaatgtttaaaaatctacactcgagtgttagatctagcactatatttagtatccaaataagtgaataaatacataaaaaggatcataatggcaaaattaatcttacaaagaatacaagaatgtaccaatgttagaaaaccaagtaaagaaaaaatcgaaggatctacattatctgatttaatattgtatgatgataatggtcaaattctttggaaaggtgctgcttgtgaaaatgctggaccaagcacagaagaatcaggaactgataaacgtataacagcaggttcttataaattagaatggtgtgctagttctaaaaatgttggattagctaaaaaatacccacaatggtacaataaagatcggtcaaccatagcaatttgggttaaaagaccaaacgatgctaattttaacaatagattaatcagaatacatattggaaattacccacaagatacagaaggttgtattttacctggtaaaaccagaggtgctggtattgtttctagttcagcagatgcttgcaacgaactctatactaaaataaaagaaattggaattaaaactgtagattttattattaaagaaattgaagcttaaggattaaaatgagggggttagtttataaatcaccacttaaagttgatttagatttagcagaatcttataaaggtaatatattcttatataatgaaccaataaaaaatgatccagaatatagcatacaagattctattaatttagtatctaaaccagatcctgcaacttttagtgaatcaatatctttagatgatactaaccacttcaatattgatttcaattttaacgaaacagcgatattaagagaatctgtctttgatataacttctaagactattgattctgattttagtagagatccagatcctggatttaactctgattcaaaaccaagtgtataaataaatacaaaaaaaacaaggattttaaatgtcagataagttaaaattactttatgaatatcacgatgctaatgtacttatcgaagaatcagttaacgacaaaaaagaaaaagttaaaaaatataaaattgctggtattttttcaacaataggtgaaaaaaaccgtaacggtagaatttacccaaaagaactctgggaaagtaatgttaaaaaataccaagacgttataaaaagcggttctattaatagactttgtgagtgggaacatcctgaaagaggtacagttgatcctatggaagcagttgctgccatcaataaacttgaaatcaacggcaagtatgttatgggtgaagctacattgttagataatccaagagctaaccaattaaaatccttaatagataatggtattaaattgtctgtatctagtagaggttctggtagagttaaaaatggtattgtcgaatcatttgatttaattacatatgatttagtatctgcaccaagcgattataatgctactatggaaggaacatctatatatgaatcacaaaaagaatttgtaatggtggatggtaaattagtagaatctaaagattctgacagtgctaaagattctgacagcgatagcaaagctgatactaaagattcgaatactgaagattcgaaactaaaagaatctattcttaaagaacatttcttagagtttattgaaatacttaagaacaaaaataaaaacaaataatctataacaggagttaaaaaatgtatgacgatattgtaaagaatgtaattcaaaataaagggctggctcaagcaagtaatgatttcagagctattctaattgataagttcgactatatgccagaaattagatcaagactagcttctattgaaaaatatagggatatgagagcttcacaattttctgcaaataatgcatataacccagatcgagattcgatttcttaaacatttaaaatccaaattttactcgagagctaacattttaaaatactaaaatattagctct

SEQ ID NO: 14 - DNA, 50110 bp, Camplyobacter Phage CJLB-15
ttttttatactttttaatattgctttaagttttagatttaatactatagtataaactgtaaaaactcaagcattttttatactttttaatattagtttaagctttaatactatagtataaactgtaaaaactcaagtattttttatactttttaatattgctttaagttttagatttaatactatagtataaactgtaaaaactcaagcattttttatactttttaatattgctttaagttttagatttaatactatagtataaactgtaaaaactcaaaaaaagttcgtaacaacacaatttaaaaagatcaaaaatatattatataataaaaaaccttattttgtacttataaaattttcaaatgaatctgaaacagaatccaatacaggtgaaactaggtcgtccaaagcgccaaaaacagcatcctttaaagtattggtaacactattaatagtattctgtatagtattcttgatcaaactcgtgacttcagaactagttaacccttccctagaaattgtattaatttcaaaatgagtatatgcaaactcaactgtaaaagtttcaatttgatttaatccatcgtattgaaccgaaatttctcctacatttgttggaaatacattcatcatagtatatacaacacaatctttagacatttcaaaatctaattgatatatagaaatgcttggtaatataccttcaaaattacctttagttttatcctcaaattggtgagcttgatcataagtcatccaatctaaaaataactttctaactgcgtgtttttcatcattataaaaagttgctgtccatttttgttgataagtttgtactgatttgactggtagggttctacctctatatttaaaatctattgtttctacagtcaatcccggaaaacttgtagcgtgacaaaaatagtctaaatattgtcctatttcagaagtactggatgttgcagaagctccttcatttaaaatacttaattcacacttaatttctttaggtggaaatatttgacatttaaacttagtggggcgagctaaatcacccatcacttgattcattttattttgaataatatcagccatctaaatcctttataatcaagtatttgttttattaattatattgtcgggttctctatcatattttccagtatatattttattaggtgccactggttcagagacttgaccatttcttaagaaactatcactaaaatcatttgacttactagttggataccatttaaacatataatcttttgttatatcattagatcctataacaatataatcatccatttggtatacgctggcgtgttctaatctttcgtatttttcattaaatctttcaagatccctagtagttttataaacgtcaacatatcccgattgccaaccccatttattttgatagaatcctgtataatcatttttatagacttctgtgatttttggccaagaatcaataaattcaaaattaacatcaaatccatcatttgcagcagttcctgttaattcaaatgtatctatggctgttaatccccaagggtttgtttctctgagttcataatctaatttgttcgacgtaccagtaaatacctgagttggctgaacattattagctgcaaaatatcctacataatgattatgataaactgaactttctctataccacaaggattcttcattaagtttattttctttgaatttaatcttattaaaatctatctcatagagataatcaccaagtgctttaaaggtatattgtggtgccaaattaaaatctatttgttccaatacttcaagatctttattaatagctctaattgttgaatttctatttttaatatcttgattgaatttaagatctaatggattaacatctaattgcatagattccttattttcaaactcaacaaagtcgtcatttaaataaattttaattggaaaatcaacatcctcaaagtttgcgttattaatactaagtattgttttcttattgtgtttattctttaagaaaaacaatttgacaatatcatcgtcttcttttgtaaaaataattctattatttaaataatcatattgataatctattaaatattttatagaatctttttgcgcatctataaataaatcatcatcttttcttatactataagtatataagaaactttcttcgttaactttttctgcgtatctaatattaatatcttttttagttgctgtgtaaattgttatagaatcttcattaactttgaattttaaatcattgttaaaaccggccataactggcaaaccatattcaatatttttaataaatttatatttacctagttttgaatctgggtcgttactttccacagcttttaaatcagctttcttaattttaagagtttttaatcttgaaaatgaataaaaatcttcagtagacactgtattgatatcttgtttaactatgacaccatttttaacagcatataataattttgtggagtccgggtctccagctttattataagtaacatcagccctatttttagtatcatctaaataatatattcttacttttataccttcagaataagatattttaaatccagtagttaaaatacctatttcaacgtctaaaacatttccatcagtatccataacaactaaaggataagttttcatttcgttgtgcttataaacatatttgtttgtactagtatccatatttaataatatatctttatatttaaatatttttgcgttataattaatgtaactagtatctaatttaaattcagcatctattgtatatgttcttggtataccttcatctatattatcaaagtattgtattgtaatagcttcatttgtatcagtataaaaagataccccagtattttcaatatcatagtctaattgtattctttgattatttttatcgaatatattaacaatcataatattttcgattctaaaattataaaggaatttacctcttttatcattaacttctgaaaaatttccagcaatatcaaatgttgtagatttaatagttattggatttttaatacttgcagaataatctaagtataataaacttaaattatttgtttttgcattacaatctaatgttgctaatttaccttcagaatcgtaaactatttgtccttcaacgtattggttatcagcattgattaaacctaagaatatactattttcttttgcttgtatagtttcattagttgcactcagtatagttatcggaaatcttttagaagtattatctataacatatactcttattttttgagcagtgcttgaagttattttaaaacctttttgtaaaccagcaatatacataatgtccaaatctacattgctaatacgattagctacgctgacaaaatagtattctttttctggtgtagtatattcatataatttagaatctttattataacttaattcggcatcaataatttgaaatggtcttgaatcgtattcataagtatcatcaataaattgaatagttacaggatcttttatatttaaataaagcctatattcagaatctacaagcctataattacctttaactatataaccattagaatctacaatattcaagtaattaacaccttttttaaggactgtataatattgacctaaaggcttattcatagattctttaaaatctttgtaaacttgtgaattgtatttactgaataatgttttatctatatataataattgtgtatttttaagttcatcttcagctataacttctaatgaatcttcgttatattttattttagcgcgaactctatacccgtaagtattaattaattcaaaaaatattgcatttggattatataatctataatgatataaattgtcagattctaaaataaaattacaagtacttgattttacgtgatcatcaaaaccagaataaactttatcaaatacctgtctaatagaattatcatttttcttatataatgctttaaagtcagaagtttgtaaaactttattacgaactctagttccataagttactggtgtatttgcattgattctatttttaccaagaacccaagtatctgaacctagatacatattaccagcgccaatagctgcaaatttaccagtagtgctagctaaaccaaaatctacttgaaattgatatttgtctttaactgtggttacaactcttctaacataattaagttccaaagcacatttgcttaagaaatcagtataatcttttttaatttcttgatttaatgaattaatacctttataataatataatattaaattcttagggtttgaattttgttctaatctttcaccagattcaaaatatacaattaatttgtcattaccttttatgctggatttttcaatagttctaatagtaggatctttaactaattttaattcagattctaatgttaattctgggtaattgacaccaaatcttgtaacattaaatactggatttccatcagctttatacatttttggtttattattttcatatattatattattattaatgtcagtttcaaaaagatatccggtatttgttttaaaattatcttcacaatcagaatcttcacaagttactctaaaaacatttacatcgtaaacttctttgcataagaaataatcttcgaatttaagaacgtaagttcttgtaaataagtaagtccaacctactggatgtgctaaaggcttaacaaatgcttcgaatatttctggtaacatagatccgtaaacgcggtattcaaatatattttcaccgggctctattgttaattgaccgtcggtttctaatacaaaactttcaatatttaattgttctataatacgatatataaactcaatagatcttaaagttcctttagattgttgaaagtttttaaataattctaattgttcttgtgataataagtgtattacatttatatctaattgcgtttcactaaaatcaaaaccatattttttgtgcgcttttctaacagcttctgcaagtttatgattttttgaaccatcggttatagtcttataaaagtttgcagcatatgttttaataatttcttcatatagaacttcatttttagaattatataaattattgatgtcaatcgctaggcttgaattatcatagatataatctacaaaaacgtcaaggacgtccataataaatttattagatttgtaattttctggtactaagtttttagctatacttttaaacacagcaaacctttaattatgcttttagtatatttatttggttcttagtcttaaattaaattattttaattttttgacttctaccttagattccatatgaacacttttaagaaccactctatgtaaagttcctactttatcgggtgttgtactccaaactctttcatcgttgtgatcatttagatttacattctttgctaagataccttgatctaatttaattatatccactgtaaatcctgggttattactaaaagaataatatattctcctagcattttcatattgttcagaatcacctaataaagtatatttaagaacggtagttgctagataatataataatttgcctaatctgatacctctatggtctctatcaacttctacagcactaactgtataaacatttttataatccattcttttaattttatctgtaggcaataatctaatcatagctataggactaaatctatctttggtaccattagggttatctttagtcgggtaatcttcaggtactttagtagctaaaatatggtaagattctctacgataaaaaaaatattctttaccattataataaactttatatacaaaaggtgatttatcaaatgtatattctatcgaagtcagaccatacttattaatatagtttaaattcccaaaatcataatcacctgatttagcaattgcttgctcttctaaaaaatctgaaaacttcaatttagctcctttaatttgtaactttagttaataccaatctattaaatctaccacgtattctttcttctttagttcctgttaaaaataaatcttcatcggtccaaattcttggatctaaagcatcttttaatttaacatttttagcaataattttacctgttgctaactcaactatatcaacgttaaacccaggtgatttagacaagaaagtccataagtttcttgcaccttcatattgttcagaatcacccatcaatacccatttaaaatcatccactaaaatagtatataattttttacctatcccaccacctctgtatgatcttaaagtttcgacacctttaactattctaagagggccataacctaaacctctgtattttgttgtatattccaaaagtatagcagctaatatcttaaatcttgttgtataaggttcaaatcttttatctatttcttctttagctacacaataatatttttgtttaggatggttagcattacattcaataatgaataattctgtattatcaccatttatatcaaaattgaacttatggagaactttcacaactttctttgatatcaaacctccagcgcctatgtaatccaagttaccaaaatcataatcacctgatttagcaattgcttgctcttctaaaaaatctgaaaatttcatcatagcctcgttattttaatttgcataattatatcataaaataacttaaaatatatttaattagataattaaacactcatagtgctcatatcaatatcaccagctcttaaactatctctaacttcttgataatccaataaatcatcaaaaactacagatctaagtctaaatattgaatttcttattaatttaaaattatgtgatggataatttaacataaattcataattatatccaggttgaaaaatttttgtttggaatttaactctaatataaggtatccttgaattaaatattgtataagaacctacaatttgttcaccttcttctggcgtagcagcacttctattcattaatttaataggtattcttatataagcaactttagatagatccaaattaatatattcttcaactgttgtataaaatggtaacatagtcttaacagattcttcatctataacatagttagcaactattttttgttccgccacataatttgttaaatttgctgggataactttatgtgttttgctaggttcttgtatttcctcaaaacaaataggttcattatcctcaccttctgcaggattagctttagcaaataaagcccattctattgtgggtatattttctggtattatttgacccttggtatcatatataccttcaattggtaaatctaaatatacataagctcctcctgggccttcatccactgataaatctaccgcagcttctttaacatatactatttgattttgatataataaatcaccacgttttacttgaacgtctaaattaaaattaaaagttcctgtttttctataattatttaatactacgtatggcgcttcgtattttaatggagaaccttccggtatactgactgtatatgaatctaatgcatcatcgtgatttgcaattaaattcctgacgtcgaatttattattataattaacataaaatgtaattttttcattagattttaattgaacttctctatcaaatgtggttgtgggcgcatattctgttatattttcaaactgtttagcaacaaattgaattctatcatcttctacaggtgttaattcattttgtctttctacgtaagtaggatatataccgatagaaccatcagcactaccaaatgaaatttttgtaacatctaataatataccatctatttttgtatcaaactgcctttgagctatcatagcgtctgttataacaatacttgtagttttttgagcataatctattaataatgtatcattggcttttactgagcttggtatccaaactctaatatctatttgaccgtcagaatcttcataccagttataatataaattagaagtttctatatcaccaaaaacattatcttgactttcagtttggttaactgcagattcccaagaaccactggcagttcctaatagttgattagattttaacccattgctatcaggttcttcactatcacttggttttaaagattctctattacaagtataaacaactttataatcacttgctcctacaagacctgcatatttacccctttgtaaatcatcacattgtagatagccttgtgaaagtatctcttcagtaatatagaaatcatatattaattgttctgctttgcgagaaccatataaaccgtaaactttaaaactatcacctacactaacaaatcttggcaatgctattttaataactgataattcattacctatattaacattaaaaaatacggttttattttttaagttgtataaattaatgtcgtttcccccataggtggtcaatccatcgtatgatattattctaacatttaatgattcttcatcaaatcccacatccttaaaataaaaagatttgtaagattggttgatatcagtatccgttaattcataagtataatgatctgtattgtctaaaataaacggcaaactttctttattaaaataaacttctaatttatcacccacactagccaataaactaaaataaacactaagaactaaattcttagataatttgtcatatgatttagcataaaaacaatttactttactaaagtctttattttctttaaattgttttacacagttttcttcacttagtaataaactaaaatatggatttacttctataccattacccagacccaattcattgtctaaatgcctaactaagttagaatggataaattcaccttcaaatttttcaatttctgccattttttcacgaatctttgcatagatttttttacgaatatctgattttggagtaccaaatggatattgtttaataagaacttgtaaatctatattaacatatgttggatttttaagattattcttaagtgctggtaaattatatgtatctactaagtcaaaaatacctgggtttttataaccgttagcatctttttctgcagaaacaacttcaccatcatttaaatataatgtgtcaggatcattataagattcttttatgtagtattgattggtactcatttcagtagtattcaataattcaccgtttgctaaagtagagttttcttttttgtaagtatatgttccatcactttgttgaacttttttaaagattgtaaattctggttcttttcttcggggttcagctgaaaaatacaaattacctggagcaactggatattcatcttcgcctccccaagtcactacatttttaacactagagtgtgtttttataactgaattataatcgtgtatagttactgttcttgaagcactattataaaacattggtgcatttgttttaatagactctatactttcttcatcctgagcttgggaaactaatacaggtgcatctttaccagaagtcaatattttacaaaaagagccaagatcaccgttaacggaagctgaatcacatctctcataatatgcgtctattccagaagttcttaaaacattaatataaactctcgtattagaaggcaacttagtaccagcagtccctagttgaaaatatatcctagcattgccagtatccacatcatcttttctaaagaacttattattggtactatccttaatatcaattaaattaaaagaagattttacaaaagttgcattatccgataaatttccaaaagtatcataataagtaacataacattccacaccatcatcttctacatcattccaaggtatatcaatgtattcaaatttttcatctattttataagttaaaatatcaggatattcttcgtttttaattaatgtaccttcttttacttgtattgtagttgtagctcctattttatctatattaaattctaaatcatcacctaaataattgtaagtaaacccatttatggtaaatgtgctatattttggtattttaaaatagccagttctggtaaaacttaatgttatttcgagtattgtagattttttatgagaaggttcataagacaaaaccctagcatcttgtataacatttttacgtttagtcgccaaagttaaaacattctcattaacatttactgctgtattgaagttcaaagaacttacgatataagataaaacagatgctaagattgctccattagaaccttcataagctcctccatcccagcctttttcaattaatcttttagctatatcttgatatatttcatcatatgtaaaaggtaatgtttcttttataatagccatttgaaatcctgatttttgtaatatttatttgatttttacggccaattttttgtttaataaataataaaaaattattaaaggattatcaatgttaagtattgctatttacgttgctatattcgttgtcggtcttgctgtaggttattgtattcgcgtcaacggctctaaaaaagctgaagctctttatgaagctcttaaaaaagaatacgatgaattaaaagaaaaatatgacaataaataaggtttaaaatgagtggtcaatcagaagatttaaaaaagaaactaaaatattattggtttgttttcagatggtttttaataggtagatatcattgttctggtggcgaacattataccatttcattaagaactgtttggaaaatatgtaatagaaccatatggggtgtcattacattttcattaatatatgcaatagctagtttttttaattatattgattaacccattgcttatcaatattttatgttaataaataacataaattttttaaagggagtaaaatgttgaatatttatgatgcgctgtttagctcccttcctatactacttataggtgctgttataggtgctgtacaattcttgcatatagataaagctgctaaatctaaaaccaattttttaacgagattcaaactttttataaaaacctcttcaacctctggtattttagcgttatcttcttttttaataactgataattttgatttaacttattcgagtagaataggtgtatcgatttttatagcatttgctgggtatgaaaaaatacaaagtataattgatagattattagataacatatctcccaaagataaagattctaaattgtgacattcaaatattttaaatatacttaatgttagttttaaaacatataacattagaatgtaaaataaatatttaataattaataattatgaaaggtattttatggcattagaacatattactgcagatccagttaaagttgacataaatggttcaatctatgaaaaatcacaggcggaggttaaagctattatagctgaaagaactgaagcaaacttggctgataatgaagaaagtgatccagaatcaccgtcagtagaaactactttatctttaaatccagctgataaacaaactattgagaagggtcagactaaagatattaatgtaactacaaatgctagtgatttcacagttgagtctaacaatgccaatgctacagttaaaaaaggttcaggtaaattcactataactgctgcaactaaaggaacttctgaaattactgtaaaagctacagctaagggtggttctgaaaaagttgttaaattaagtgttgaagtaactgagtctgaagattaacatagtgaaaattaaggtaaaaataagtcgatattaaatcggcttataccttaaaataatataataggtatataaatgacaacttataaagattttcataatgattctttgaatgctgtagttatagataaacgagctatagaacaaagtatttttaatatattaactactagaaaaggttccttagctggtaaaccagaatttggttgcaatttatatgcttatttgtttgaaatgattgaccatattactattaatagtatgcaaaccgaaattacaagatgtctaaaagtttacgaacctagaatcaaagttcaaagtgtagacatttattcacaaccagaattcaacagggttatattaagtattaattataattttacaggagtagaaacttcaagctttgaaacttatacaataaccttaaatactaattaatctatttaaattatttaagcctctgatcaaaaataaatactaaaaatataagcaggagatttaatgtctgattttagataccaaggctataattttaacttaactagttttagagagttcgttcaagaattcaatattatggataaccaaagagctagtgcagacgcactaaacaagtcggttaataaactcaaaagagaggttaatcaattaatcggccaatttaaaatattaacttcaaaagaatctatcagatgggatgctagcataatttatgaagcaggtgaaatagtttcttatataacagaagataatccagatgtagaaaccattaaaaattcatattatttagcattgcctagtgatatcgaaaatcaagggtattatccagatactaatcctgatatgtggaaaaaagttactttaaatgaattatacccttggttagatgtagataattatcctactaaaactgataatgataaagattggcccatcaacgacgattacgatgttattaacttaaagtatcttaaatgggctttagaacaatttaaagatttcttagatggttatctcgcaggtatctatattaaacaagataataaaatagatttagaagtatctgaacccgctcacgtaacaactaaaaaatatgtagataatttaatagatgaagtaaaacaaagcattactaatatagatgatttgttaacggattatgtatttgttgattctaaatctaaacaattacaaactcgtaaaagtaaaaaagaagcttggttaaccacagaagctggattattaccaggattaaacttaatatctacaattggctcaacaacacaacaatttaaagctatgtacgctcaagattttataggaactgctttaaaagcaaaatacgctgacttagctgaggtctacgaaaccgataaagagtttgaagttggtgctgttctgggtattaatgaaaattcagaaattgaatatttcgacatctataaacataatagacctttaggtgtagtttcagataaaccagggtttattcttaataaagattgtaaaggtgtgttaatagctttaaagggtcaaacaccagtaattgttaaaggttctgtaaaagccggcgacgaattatatgctgagtatgacggttatgcctgtgtaaacccaagcaaaaaagaagaaaaatattttataggcatagctttagaatctaaagaatctgaactagttggcttagtaaacactaaagtataaaatatgttaatacataatggccaagaatatgaacaattaataatagtagatttattaatactacttttagtagttacattcattttagcaaaagaagaaatataaataattataaaaaattataaataaaagaaaggagtttagaatgttatctagaaagataagaattgatagttttatatctgatgcagaaaaatcagaaatatttcaatattctaaatccctttctgctgtctataacgtatgtcttgatacgctcaaagaaaatttaaattttaaagatttatctaaaatcacaaaaggtaggtctaaaacaacaggcttgcattcaaaacatatacagaatacctctagagaggttataaatgctgtaaaatcttatctagcaaaaaagaaaacagataaaactgttagatttccaaaattatatagagaatatagtcctatcattatggatataaatctttcttctaagattgtagaggttgttaattctgaaacaggagaggtaactcttgtaaagaaatattgtccaggcgggggatttaaactagaaggtaagaaaataaactttacttcaataggatttgaattagatttaagtaaatgcccttactatgatatagaacttatcaactatgagactttaaaacagatagtcatcaagattgatgagaataagagaatagattgtatttttgttttctcagagaaaaaacaagaaaaagcactaaatcaaaattttctttctatagatctaggaataagcagtacagcatcttgctactcaaataagattgattgtctgaagatacaaactaagagatttaaaggtttagaaagagctataaatgaacttaagtctaaaagagataagaagaagaaaggttcaagagcatataagaaacttaacaaaacaatcagaagaaagcaagcaaaactaactaataaaagaaaagactatctccataagacctcaaaaactatggtagatctctgcattcttaatggtatagataacatcatttgtggagatatcaagactaaaaaattaaagaaagactataaaacaagtttaaacaaatcaactcaaaatgaaggactattgagtagatttaagggtttcttaaagtataaagcagagaataaagggttgaactttttacttgtgaatgaagcatatacttctcagactaactgtcttacaggaaaaagagaactagactcgaatcttagtattagagaggtagaattaagtccaggtttcaaagttgatagagatataaattcagctgtcaatatagccaaaatatgtggggatttatggttatcccatatctttgagaagaatagacttctcaagatacaaaaaatgaatattactttgtaatatttgattaaattcttgtagatttctataagaatttaaaaatcatatatttttatatgaaggattatgatgccagtcccaagtgttagatttattgatagtgataccagttcaacatcaaattattcacaaccaagaagagtattctatgctggatatttcgataaaggttcaccagatactttaacatccgtttattctatattagattttaaaacaaaatttggtaaaccaaacaaaaataatataaatgactggtttcaaatttataattattttttatatgataataatgaaatagttatttcgagatctattggtgaaaattcagttaatgctagtattagctatccatttaatgactttgacgtcagaatagataacttagatgattttagaagtaaacgtataatttctgaaaataatttcttgagaatccttgctagaaacccaggagagtggggaaatgatttaacagtttgtatttttacacaatatgaagttcttaataatatgctaatacacagcaattatttagcaaaagatattcaaaattcaatgagttcaaatcaatattgtatttgtgtgttcttaaaagatacattaatggaaaaatatatcttaaaagaagctgaggatatggtagatactattaatgaaaattctaattatatattcattgttttcgatcctaaaaaatacaagttatatgatggtaatatccactatgtggatggcttaaatcgcttagctgatggaaatgaacctaactcagataaaacagttttttatggttctaatagtcttaaattaagtaacgggtacgcaagtttaccaagtgcagcccaaatagatgaaacatataaaagtgtcggtgaatctaatgattatgtgtttgattttataatcgctaatacacaaagtccaaattctgctatcaatttagcagatactcgtggtgattgttgcgctttcgtaggcatacccagaggtatcaaacctgaagaatatattaaacaattacaaatttcaaacaatgctgttgtttactatggttctaaattacaattaaatccatttaataatcaaaatatatatgttaattgtataggcgatattgttggtttaagaaccagattaattaattcacaagaattatcagtatctcactgtaaaacaatttatagtttcttaaatacaatagatttggatatatatttaacagaatcacaaataaaagatttatatgatttaaatattaatattgttaaaaaaggatattccggtatatacgctttaagtgaaaataccttaaaaggatctaaattaacaaatagaataatatatttcaatttagttcgagaatgtgaaaatgctgcattatattatgtatttgaaaataatgatgaatatacaagaaatgatttaacttcaaaaataaaagaaatttgtagaagttatgttgcagataataatatagaagattttaaaatagtttgtgatatttctaataatcctactcaggataataacatttatgtagatgtttattataaacctaagtatttaattgaagaagttgtatttagaattcaagcagctagtgaattgcctagttgaattctaaattgatttcttaaaattttaatcccatatttttgactctatctaaagtatctgtataatctttatcttctctaaatccattaaatcttggatgcattaaagcatatatttcagaatcttcagattttgtcaatgctgttgctttaactgtaaaaactttatttaaatacttagaactatttttaaatatttcagctctttcagtatcactaatcccagaaactttaccttgaattaattcatcatctgttttaaaaacaatagcaccaaaagtatccttaaacttaccattaccttctgtaaaatcaatacaacgaacttcaacttctatttctggttttaattttatttgttctgtactagtaccattcttaaatacagcgtcacaattttttaagatagcaccttcttcaccttcttttaaccaagtatttaaatactcattagcagcttctatattgtcaataactctggttctaacaacagttaatgtatcagattctaaagattcagttaatctccaaacaaactcaaatctttctttatatggtgttttactatttccattttcaaattcttctaaagtcaaataatcccacatataaaaagttacattttcaggtggtgttaaactattaagtaaaccattagatttatatctgatttcagttgaattagtaccttcaacttcattacaaattaattcaccaatataagcaccatctggcagattcaataatgctgaatatactttagggtgatcataactttcaccagatcttgaaaatgcttgggcactatcaccttttttaataaaagttctataagttccatccgcttttatttgaatcattgctggaaatctaatattcttaaatttatccattaatgaacatctcatatatggaaattctgttataagttttttatgaactttgttgatttgtttagttgaaatacctgaatgaatatctctatccaaaatataagtaataatcctggttatttctggtgttttattgttaagtaatgactgaacaacactaatcgccttattccctgtaaaatcgcgattatgcaacgctatgaacgtatttttaattgtattgaaatctatggtttcattattattttgaaattctggtacttttttaattccgtaagaatatttgactttatcataaaccaatgaaagaaattctttaatgatttcattgttatattttttaagaacttctaatttataattagaactatttgaagcatttaattcatttaaaaaatctgttataatttgcattttatctccttttgatatattataatataattgaacttaaaaaattattaattatgcattttctcgttctaagaatccacaacattctacacaattaacacagtttttacaatttttgcaatcttcacaagtatagcaatcaacacattctacacaattatagcaataatcacaactttcacattttttgcattttttgcagtcttcacaatctccacattttttacacctgacacaattgtaacaacaatcacaaccttcgcagtcacaacattttgtgcagttcttacaaccttcacaaacaaaacattcataacattcagcacaaccattacatctgacacagtcttcgcaaccaaagcaatcttcgcagtttttgcaatctatgcactcgctacatttttcacagtcttcacaatcataacaatcttcgcagttaaaacaattaacacagtctttacaatttactaaagattctgaagcttttttagcttggtcctcagaatataattcagcatcccatttattgttgttagaatctacataataaccatctattaatttcatttaaactcctttaatattataatttaaaacctaaaatgatagccagccttcataaacttcaaatgaatctaaatttatataatctttcttattgaatataaaaagttcacaaccaagtacttccatacaacatcgatctgattctgaatccaaccctctaaagaatagaccaaaatcttcaccgtgttgataagaatctacatgatctaaaaaatattttttaccgttgaatgtaaatattaatttttcatttctaacgcgatctattaaatcgttcataacattgtgtgcatagttgttagggtctttagctattttattcattatggctcctttatcttttaatgaaataattataatataaaataacttaaaagtttctgaatgtaactaaagttttaaatcagtgagtcttttttaatagataaaccggttttatcatattcttcttcggtatctgtattattagcattgttattagaatcgttgtatttaggttcatcaccagaatcagaatctgaatctgaactgaattcatccccactttcaaaatctctgtaaaattgtttatacaatggatttttagattctttttgaatagctttaagattctttttgatttcaacatcattaaatctaaaaatttctttatataatgtatctacaggtaaaactgttcctccaaaatctttagctgttgagaatgcatctatacgtttcataaacaatgttagattcattctttcaataaattgattttcttcgctaaagtatatattaatagaatctttaagttcttgaaattgtttttcagtacaaactttagtacaaattaattctctttttagaatttgcataaagaattccgtgtatacttggcgaatcctagttattttttggaagaatttgatgtcctcgtttgtgatagcatctgcttgcaaatcaaataatggttgttgtgattggtcatctaagtagattctattaactggtattcccatagatctatataataacttgtaaaaaaacataatatcaccaagttctcctaaattaccagtttcatccaagatatctacttgcatacctttagcaccagctttattaccaatccaataatcttcgaccatagtgacaatatgttggttattagttacttcaccagtttctgggttgtattgttttttatatttgaacttattagtcaaatccctcatataagcttctgctttagaattcggtaattcacttaaatctatattaaatacacgtcttgaaattgatcttgaaaatcttaaaggtattaacaaatcttcaagtgtttttaattgattagctgttttaacggaagcttctaattcacttaaacaaataccagaatctgaaaataaaccaaaattttgatgaactatttcctctatatcgtattctaaagccgcttgatctattcgaactggagctttaccattgatattgatatatctttgatttcctaagaaattatttttaagagctactgaagaatttatatctatgtatttgtatttagaatctgttaaatcataccaaagatatctaggatctaaataatataattcttttataccttttttcttatcatcgtggtatttaattaatatattcatttggccgtctatataagattgtctgataaaagaatgtagatatttttgggttccaaataatttcattattttttcaaaagcattagatattgctatgtctattttcttattcgaagtatcaacttctaatttaataggatctttgaaatctctacaatatgcgacttcgtctacaatttctgttaaaccactccaacattcagcaatcttagcagtttgtctgtagatatcaattttttgagcttgttctgatgctttttgtagattatcaacataagttatgtcatttacattatcaaaaaaggtttggaatcttaaaggttcatcatcagataaagtgtttattactctaccgaatggaactgtagtatctattttattaataggttgttctaagaatggtctatctattttttcacctataatactattttttatactttctaataaccccattattaacctttttttttaatatttatgtactaaacttttaaactttagttatactttaaactttaagaatacaaattataagatattaataaatcttttgttttttgactaagatattttgtatacttaattttctttttaatataattaatatcttttttagtttctaaatgaattgctttaatcagtttattatataaagacttcggaaaaatttcttttaatttttttgcttcacttgggtatacatacggtgttgtatcagtttccaaataatttgcagcatttcttaaaaaatcagccaagttttgaattctatatcttttataattattttccattttacctaagaaaatattacaagtactgcaaataacatttctgactaagccagcgccttgtacacctaaattttcttgttttttactatgtttgtgatcaagtacaggattgaagatcttagaaccgcataaaggacaaattgggtttgattctaccatagaatctctgagttcttttgcagtttttgtatttagaactataagttcttctatttcataagtttttagttctcgaggttttaaatcttgcatttttagtctttatattttatgtttttatattagtatttgacggttcattaacaacatcacgaattaatttaatatcataatatatagttattatacaaaatattaagaacattttccaggataatgtatgatgcatataaaaatcaattaaaaaacaaattatacccactgatatagctatagccatatttaagaaagttttaattaaatggtttgacaagtgttaaatcctagtttaaacttgatatttcaataccattattataaaacaattttttagttttcttagaactaattaaaacattttctggtattgttgagttatctaacgtagatgacacccaagttttattagaactattatatgtccatttttgattgtttgatatatctattatagtatcatcatacacacctgattgcgaatcaaaataaaatttaatattttgagaccaattaccaaaacccatttgacaaggtgaatttaataattctttcaatatattaaattcattatcggataaaacactaggttttgttgttggtaatgtataatcaattaatgagttgtcatccaatgcttggtttagatctgaagtccaacattgtactctatttttagttctagccacttttaataaatgtttacctgctcgccaaattgttttaggataattatctgtaatattgcctttagaagctaataacctataagttgtataaggttcttcattgttgccacaataattaaaaaataaaccccacgaagtaccacctggtaaagcgtttaattgtaaagatctcactgcgcttaatgtatataatttaccattgatcattttagctgctacaacaatacttaaaacatcatcatcattatcttggcccacagctgatatttgcacactataagtatctttgacgtcattacttaaaaacatattataataacttgaatttatattacttgctatagcatcttctgcttctatgtaagaccatttagcagcttctgcttgaccagcatcatcatctaatttaggaccactagcagaattcataatagaatgtcttacccaattatcaaaaacattttttaatgtaacacttgattttaacgtggctaaatcagtcgcattatcacatatgtttaaaaattgaactgcaggtgtgttttgaacttgagttatagtgttatttacattttgtatttgctgagttatagtgttatttacattattttgaactttttctatttcggtttttaagctttctgcatctataattttattagctttgttaccatcacctaaatacacggcatttttagaaaatgttaacatacctctttgggtagatttataatctcccgcttctatgatatctttagaatctacatttaatcttaactcagtcattttaaaccttgcccgtcattttttgttatttattttctggttctttagacaaatctgatactaaacctaagcttttaaatctttttaatattttattatacatagaatgtatttcacttggtgtatttcttttaaagaaaatttctgaatttagattctcaattactgcagttgcagaaatagcgccagtatctctaggcgtttcgacaacttgaatatctgggttagctcttaattggtttacatagtcattatatctatcactaccacataaaacagcatttatattcattttagatttattcataatactaataatatttcctgtactatgttgtataatttcaatttcaggaaaacaagattttaacatttctaatctaagatcttcaaattctttagtatcttttgaagttaccaaacagactacgccattatcgtatttttttaatccatttttaataatattataatgagctttagttaaaattctaaacttgcctaagaataaaaagttattatttcctttaagtcttttaataacgatcattttgatattaccttgaatatcatcttttatttgaaattgtgtctttttaggatgtgtaaaattcaacttatatttcttaagagcttctccatacctttgaagtatttcatttaaagaacctttaatattactagctccaataatatttaaagctgctaatctaacgttagcccaataagcattttcagtatcaggatctccttgatattgtgaacgtgtttctgctcttgctttaggatccacttgataaggttgttgaatttttaataagaatccaggataagttaaaacataaccttcaggtttaccaccatacttagattccattttaagaaacatttcagatatttgttgtatatataaatctatgttttctattttaagaatatttttataagttctaaaaatatcattgagttcttgtgatttgataccacgttcgaaattagcgaaattaccttcaaatatagttcttgggtaatcaaatcctaatttcttagcataagtttctcttgaatctgtatagaaaccttttggttttgtgaataatctcccaaatttgacttcataagtacaagggctataagctaataaaattgcgcccatcttcttatacttatgttgtaatgtaggttttttcatcaagaattctacaaagaattcataatttaaaggtaaactctttgaatcacattttttaagaatatcgaaaataaatgtaaattgtgaattattaatgctttcaggtcttattttggatttggctgcgtattcaaactcatcaggatatataatattggatttgtatgaaacaataaaatcttgtttataatcaccagttttatctatatgaactatagttactttaataccatcatatttttcttctactttaactttatcatagataaaagcttcttttcttgcttggctagttaaatatttgtttgcatttaatatagatatatcaatttgatctttttgcattgtattcgctttttgttttatttattactaaataaatatatcaaaaaatcataaaggtctaatatgaattttaaagaagttcaaaaaacacctgccagaggttatttttgtattgaaagtttagatgctaatggtaatattatagataaattcgaacagaaaaatcttattacaaatgtagcaagagctgaatttgctaaattgattgctggtatcaatgaaagcaatgctattaatagatttgttatgggtaccaaaggacaccaaggttctgatattttaacaccaaaggatgaaactactggatttactgcgtctgttactgatattttcagtggtcaagaacaaggtgatattaatagaacttggaaccaagtaatttttacaccaagtggtaatatggttaacactgctgctacaaacgttcaggatggtgctaataataactctacagtagatattacagttactggtattgagcaagcagagcctgtagtaacttatactattaatattgcgcaagatgcttttaactgtgctaatgatggtgtagtttatactgaagctggtttgtatagtggtacaaatttaattgctatgagaacctttaaaggtaaagtaaaagaatcaacagttgcattcagaattcaatggagtgtaatgttttaattattggagctaatatagctcctttgattaagatttacacatagaatctaaaatacttgcatataatttagctacttctttatttaccttatattttaattgtatttctttgatagattctgattcagctaacgctttcgcaaatcttataaattttggtttattttttgtgtatctcactaaattatattgtgcttcatctggtaagcttttatataatatattaatatcattagctaattgtaaagtgctagggcttgaccctaaaaatctacaaaacataaagctattaaaacctaaactctcattataatctttgtctttgagacagtttgtaaattgttcgaatatatttgccataattaattatatcctaattttgtttaaattttgattaaaggcttttaaaaataacactcgagtgttagatatactaaaggtatcaagatccaacttcaagtcttctatatagataatctttgtattctttagtagagttcttaaaaacaaacatagcccacttaaaagaatgtttaaataaatgacatacagaatctattggttctctaccttcgaatttagcttctcgcatttcttggtgtgtacacccaacattacaatactcgcgaatttcgcacttcatacatttcttgaattttcttgggtctgcgtatttagacataaacttaagattctttagatttaatcctgattctggactatatagaaccattttattagttgatctgtatcgctcgcaaggccagaatttaccatctaccgcatataaacaaccgttatttcctacgaaacaaccgtggtctcttttaccaaatctagcacctgctaaaatatctaaagcatataaatcaaataatcctacacttgctggtattcctttatgttgatattcaagtactttatgtgctaatctttcaacttctatagcaaatgtttctatttgacttttagtataaatgttatcacgaactaaacaaaaatcgggtcttaagaattcataatcgttaacaaaaaactcaaaattttcagtcattgttgtgaagttcttgggttgtatcataactttacaggtatctgtaatgctatgaattaatgctttattttgcttaaaataatctaaagttccttcaaaagtaccttcagccactggtcgattagtattttgccatagaccatcaaaactcagtgaaattccacaattatgagcctttaagaactgaacttttttagggtctaataatgcaccattagttatcacaacatagctggtacatcttggatcttcttggaattttggtaaagttgcttcaatcacttcccagtttaataaaggttccccaccaaagtatgaaatatgatagctatctttatcataataatctaacatataattaattctatcaaagaatttcatagctgtgtctatagacatagggtttggtggcgtatgcgcactataacaatatttacaagctaagttacatttagtatctaagctaaattctactattagtttacctgccattttaacctttgtttttagttttggtcttaggtaagcaagttaaacaagctaaaaagtttagttcttcttggcttaaatccgaatctaaacttgagttagattcagaatttaaactaatctttttagcacaacgcaaagcatattttatacccactctgatgtcttgcaaatcttgtatttttaactgaacttcggcttgatttttatctattaaatcttttaccactgtctttaatcctttgtaaaattggacccaaataagcatcaacttcactagcatcatattttacatcatttataagacgttttttagtttctgcaataattttgagaacattttcttgagaagtttctaaaattaataaagaatctacacttaattctataataatatctttaaacatttgctttaatttgttatattctggtttatcggtaaacttatacccaagtaattggaaagcactcataaaatccattattataatataatcacttaaaagttctttataattaacagagtttattttagcatctaaaccttcttgataaaataattcttgtaatgctttaacagcatcaaacccataatcataatcaccaagttctaaagaatgtctaatcttaagataatttttataacttggtctatctactttatcaattgtttgtctaaatacaaccttatcacctaaataagtcagacatttattgatattattaatattatcatcaaaatctttaccattgatagaaactctgtacaacgctggtgtgttgtaaactactgggttatttgcttgtgcgtaatccaaatcatttttatcaaatgttgctattaatttactatattcaattaaattgttttcataacaattcatagctaatttacattggagcattttgatatctggaaaaatatcagtagcttctaattcacccaattgttttaaataatctaaaactttagatttatcatcagttgtatatattttcgaaattaaatacgcagttcttgtttctataccctctgggttattttctatgatatattcgtatttttcgaacatttctacaacttgtgaaagtaaacgttcatcaaataatataaaaattatttttcttaattcttgttgaaccattatattcctttcgaatctttaacttcagtttctacctttggtgtagatttagatccatttaaaatctcatcaaataaagagtctacttctgcttgttctttcttattaagttgaatcttaggctcagttgttttagtatatcctaattcatctaaaaatgcttgggataatccagcttgatctaataattcaatagccatagaattaaacattaaagacatcataccattggtttcttgaatatattctgaagcttgacttaagtgataggctgccattagaacttgttttgtttgatcttcagtaaaagaaaattttggattttgtacattcatattcattttacacctttaaatttaatatatttatgattttttataacaatatctaagtcgattattagcttctaaaatatttctaaagaaatctccagcttgtttagattgtttattagactcaaacgtcagtgcttggacatctttaggaaaacatttaccaccaaaaccttttttaccatctacacataacttagccattaatccttgagaatcaaaatcttcgaactcatttaataataattctatttttctaacattgaacccagcttcatttaattcgtgaaagaataatacctttaaagcacctaaagcatttctagcgtatttaacttccattgcttctctaagactacaaaaatcataaggcgtatctattaattcagcaatttctttagcatacataatattattagcgcctatcacgtgatattttgctcgtttcaatgattcaacttctgttagaaattctggccaggttacaaattttaaattgtattcagattctataaaatctacattactaggtaacaatgttgatctaataacaactaaaccactaaaatcttttgattctatggtatttaaaatttcgtataatgtttttgtgtcttgatttgaatcaatattatcatttaacacattaatgcatataaaaatcttgctataacaatttaaaccaatttcattaagatctttatcattaaatcttggatctattatattatattcaatgcctttagaatcaaaataatttcctaagctttgtccgactacaccaaaaccaattattaagttcatattaactccttaaatcttaaatataaattcaatattagttaaacctatagtatagcctaaacttaaacaagcaaacgctgctaaacctaaaacaataaaaacgaataacttataaaatactcctggtattttaaacacactgataatgctaagaactgctaaaaataaagccgacacatagaagcctaattcaactaataataacaaaaatttaataataattaaaccagttgtttctaatatattatattgtgcataattacttaacattatataccctccttagtatcaaaagctaaaatatgtgctcttggactaaaactaaatccgtgctcagcacatttttcaaacacaaatggtgtattcttaatctgtaattcacgagtttcacccataggcattagatatacttcagtatatataggtaaatcataaagtatttcttttatttcagtgtagtccgtatcccaagtttctggattaactacaaatttaagataagatttaggacaattttcaagaatcttactgattgtttttatattaattcttttctttttaggttctcctgaacaacttaatttaactgacatactgaacataatttctttttggtattctttaaagaactcaatatccaaacttgcattagtctctattgttatttgatgttttcttgaaatataataagctaagaaatcttgaataacattagtatcccaatataataaaggttcaccgccagttaaaataatatctttggtatgtttaatttcagagtttttaaatgtgactaatgggtcaataattgatgttaaatctttgaaattatcaaagtatttccattgtgatttaaattttggagatactgcacgaatagtatcacaacctgttactaccgaaccatctggagctactgcagagcatccaaaacctttacaagtattattacaaccagcaactctaacaaatactgcagattttaatcttggcccttcaccttgaatggtgtcaccaaaaaattcatagaatggaacttttttagttcttgttttgaaaatcatttaatctcctttttcatattatataatataacaacttaaagttttttgaaattgttttagttttatatttaaattaacactaaagtgttaaatatagcttattatttaatgaattcttcaatataaaacctagctctatttcctaaatgatttagagtttcaggatcattaaagttagcaccgataaactcattagttaaaaatcttactaatacctggtgttcaaaaactgttaaagtccaagaatctaaaaacttactgatattagcttcagcttctaaaatatctttcattaaaacttctgcattttggttattcatttatatctccttttgttttattatataataaaataacttaaagttttttgaatttagaaatttaaatgttaaagtgagaaagatctaagttatcttagatctttatttttgagtgtctgtagtctgatttgaaggctgagctgaattttgacgattttcataatctgctttaattgttgaaaaccatcctttataatccatagttacgaaattcttttgagcgttcgtaaaataatttaaagcttcttgtaagatttgatctaaagttgcttcatcatctgtcatttccatttcatctaaaccatttaagaattcttgatacattttttcatattgatttaattgattcacaatcttaagatattcttcaagactagcgattaatttatcattatcagtttcaagaattttaatatacatctcttcacgattatcatcagttataaaataaccttgtgaagcaaatatattattaagatattggaatctaaaataagtatattgtggtattctcgtaaaaatctgactaattgcagaagttaattggaaaatatatgaattcttaactaagttagcactctcgtcaatttccaagttttctaaagttaacacatcaatatctttatagaatttacaagtttttttatctgctaatgcttccaaaactgctgtaaataatttactatcaaaaacttctaatgtgctagaccccggtaacaaaaaagcattgtctctttgcgcggaaacaatcatattataagcaccttgatctatatatgttatatacatactcataatttaatcctttcttaacgttttaaccattttgggggtataatatctggtattacatcgaaattaaaagttgaactagcaccacaacgtgaacaagttactgtatgttccctagattcaattttaaatatcattttttcaaatgcttcagaaatcttatccattatattaatatctaactcattgaagtagtccttaatatcttggaagccttttgtgttatccccattgatagatttaatatggaaaatcaaatcatctgtgcttggtgaatctgaagttcttaatttgttattatagagttcgatattttgaacatcttgtagttcaattttgatatcaccaatatcaatatcttggattttacctgattttgttgtaaataatttgcttaatttaattttagaatcagtagttttttcacaacttctgcaccaccaactgtaatttaaatcatcaccaagatttataattcttaacaataaaaacaaatattctaattcgtcgttatttaaagctgtcgggttttctaaaacatttgtaacaaaacattcatatcttgctttaagttcgtcttctgtggaactagtattttttaatttacttttatagagttctctatctttaactttccaattacgaactttaatagatctattacctaatttgatagggttatattctaataccattaaatctccttatttgttattatattatataaatgcttaaaatctgcttaagtttttgattacgatactctgatgaataagcctttagtatcgcttattttaccagtacatttccaagtaccttgcatatatgcataagtgtctgtagataaaccagatcctgcatataaattattaaaaactaaagttgtttttgaatctaatatagctatactgccaatttcattaatgccaatattagttaagtgatttgtgaattgagttcttgttatattaatttcagcatttcctgaacctgtgatatcagttccatttatagtttttatagaatctaatttcttagataaagctaaatcatttgaagttttataatttgttaaatcattattaacttggttgtatttagtttctaagcttttaatatcatcagtaatggtttgtatttgttcagcagcttttaaaagtttctccatattttcgggatctaattgttttagaactgtagattgctcaattattttatcactaacagtttttaaccacgtaataatattagcaaagtttctatctacttcttggtgtgttaagacatctaatttaacatctgtagttaagttatcttctttagaatctgtgaaacttggtaattctggtacttgctgattattaataatacgtaatcttacgttcactgctgagccttttttggatatttatttccgatctataatataatttataacaaatgcaaagctaacttctctgggtttaaatctatatcttttgtgctgctagggcacccaataaactagttaaatagccatttccaccagttaagaatatcataacactcctttaatttaaaattgatttaaactctgtttttgataagatatgaagggattttagatcttactaaaatcaacattccaaggtgtcatttctatgggtttactcatttcattccataattgactaaaccattgactacaagtagttatattataaaatgaaaaatacttattaagattttccatattgaaatcggtgctagattcggtatatttctttaagatttctaattcaatatcaataggtatttcactatccataactaacttataattacgattataattaagtctatatatttcgttagaatctaagaaggcgtctaaagaaccaaactctttaatctttttatttaaagcagcttcaccaaatctttgttttttataaacttcaacatcaggataaatttcattaaaattattaataatacctagttttaagttttcatctaacttatagaaatctaattcggttccttgataataagctttaaactcaggtgtaaattccgaaaaatccacaacacgtggtacattatcagcagcatcacctaaacaacaatgtattctttcccaaccttctggatcatcattaatgatccatttattagttattgctgaatattgttttatatcgcctaatttatgcaattgtttaaagtctttatcgggacttagaattaaaatagattctgctttgcagaacttcctagttaatacaccaatgatatcatcagcttcagctcctgggacaccaatagctttaaatggtgtataatcatttagaattctaattagtatattaatatgtttataaacttctttaaaattaacttcagattcttctctttgagtttttctttgagctttataatctggatataaagattttctccaatatggaacactatgatcatctatacaaataaccatagtattatatttacctctataaagtctataattttctaataattcttctataattctaaaaatagtcccacttatgaattcttcagtaatatatttaccgtcttttttatgtggattcatttgcttaatactagtatgtaaagctctgtgaatcaaagaacttaaatcatataaaatcatatataatccttacaataatggtgctaattccataatacaagcagctaaatttaagtttctatctcttgagaaagcactttggtattgatatttagctagtattatgatagcttgtggtttattattattttgaatatctaattttttaaatgcatattcataaaaagcatctgggtttgttaaaccataaactactttcattaaattatcgaaatcgcgagatctaattaagttaattaaaccttcaaaatcagaatctttttgaatgtcaagaactaatttattattgaaattacatttttgtaaacaagcaatcatacctcttatacttggataatagttcttaataatattaacaagatcctcatttgtataagaaactttttcattatctaagatttcttttagtaaattaaaagctttttgaacaagttcttgtttattagaagcgtgaacaacatcaaaatcaaatacttcaaatctgttaactataggaggcattatattagaaacataattacaagttaatatgaatctacaattagcagcaacttcttcaataagtgctcttgcagctgcttgaccattttggccaaagtagtcaaattcatctgctaaaacaattttaggttttccatcaaagctttcagtactagcaaattgtaatattttacttctcatagtatcaataccagattctaatgaagcgttaatatataaagattcaaaattaccttcttttataatggcttgtgctgtgcttgtttttcctgttcctgggtttactgaacttaataaaatgtttgacggtttttcaatatattttctaaatttatctaaataaacatttggtaaaattaagtcatcaattttttgaggacgatatttttctacccaaatatcgtgttttaaatctactgtcattgaactccttttaatattttcttaattataatatattttagcttgatacaaaattaaaatttaatttaaaattataacattaatataaacttacaccatagtggattattaaatttaaatacgacccaaatctatgaaatgatacaaatttttacagattttatatcttaagaatgtttagcacacctcataaaatattttattaagttttattatttcttcagatatgacataatcttcatcttttatatcaccatacaaaacataatccatattagaatctaaaacaagttttaaaatttcttttttgctttctaagtctaaattttcaaattctttatcttttaaaattttatttatatctactctataatctaaaaaagctttagtttttaactcttgataaatattatctaattctttttcatcatttaaattttgtattttttctttataaattgcatttaaaggcataagttcagcataaacaaaatttccaccaccttgccaatttattgctttgctgataccaccttgctcaccttctatgacttttttgagtctttcttttgtgatagtttctatataatccatttgttctatgcctatccatttgcgtttcattttatgggcaacagctagggtagtgccacttcctgcaaaaaagtccattactatgtcgttttcgtttgtacttgattctataattctttgtaataatacttcaggtttttgtccatttttaatagttgttttcagtccttctttacaaatgttaattgtagatatgtctgtccataaatcacctaaagtataatcaagattttcatttaaaaacaaaactttcataattacaccattattcatataataataatgtgttttaccttttgaatttattattttttcaaaagccccttcttccatattaatattaatgttattatcaggttttactaaatatatcaagtttttaaaataatcttgtttatttaattttgggtcaaaatattttatttcccattctttataatcgctttcaatatttggaatgtatttgttataaaatttaatatatgatgataatttattttgtgatttttttaatctaatttgttttaatacagatttattatcttgttttttataaagtagaatgtattctttatttttcggtaattttttatgacaattagcattttttaatcctttagattcgttcatcttgactacaatacaattaacaaaattctctctaccaaatatctcatccataagtacttttaaatacgcttgctcgttatcgtcacattgaacgaatattacaccatcatctcttaaaaattccctagcaatttcaagacgatttttcataaaagtaagccaagtagtgtgtttaaatttgtcgttataattaaaactagtattgcctgtattgtaaggtgggtcaatatagataagtttaactttattcgcaaatttcttttttaaagaatgtaagccaattaaattgtcaccttttattaataaattaggattatttttaagagtggttttcaaatcaccgttgccaattaattcaaaactccctaaaacttttggactgaaaagtgtgtctatttcatttttatttaaaatattatcaaagaaaatctcattatttttctcaccttttgacggaacttcctttaatacacaatttttggatggaaaattaagtactatattttcgatactcttttgtctttttaccattttattatcctttttatttataattaaaatcataataaagattttaaatgtaataaagcaccgaagcctttcttaaaaacaagttctattttaatattattttgaagcatttcattaaaatctttttgtgttaaatcatttggataacatataaaatgactatttggtatcgaattatattttatcattttttcaattccaactttgtcgttatctaaacaaaagaaagggcactttattaaatctaaaacattctttgctattgtggaagtatttaaagctattatttgattagttctgtatatttgtctaaaagacaaagcatcgagaatagcttcaaatataaaaactggtttatttaaatcaacattaaatagattccaaactccataattttgattcaatgtaaaattaataaatcttttttcagttaaagatcttgcatagaacccataataattagagtctttagaaaatggaattacaagatagtctttgattccataataaacaccatttaaattaaaagatttagttccattatagaaatctaaaaagttaatagtatcatcgttaaacccacgagattttaaaaactctatttgtttacttgtattagtgtctaacactgaagttaagttaatatatttgaacccattgttggagctttcaatgctagtagagctagcaatgttttcaatacttgtattgctagattcattagaatcgctagtattgctagcactagaatcaaaacaagacttcatagtctctatttcattattactttctatgttagatttggtactagaatcaattgaattaattttaaatttaaaattctctgatttatacggcaataataattctggtttataaatctttaagaaattacttaaactcatttgagtatttaattcacaatcaccattaaaacaatgaactaaagtaactccttgtttttcatataggtgtagtcttttaacagattttttatattttgagtctccgcaaattggacatttaacagcaatatccaaagaactttctttataagttccaggaactgctaacttaaaatacttaatatctacaaagtctaacacctatatctcctattagtaaacgttttctaatcttaattcaaactcttgtattaacccatcactacccattgtagataattttaaaatatcagttttacccgctggtattaattcacattcattaatagatttaatttcattttcatttaataatgctagaactttattatagttcttattaaatgtatgttgattaatattttgagattgaactacatattccttttgtctatgataaaattttattgtattcatacttaaatccttattaagaattattaaaatgtgcaaatcttttaagatttaccactcgatccaaatcctttagaccctctttcttgcttagcttcaaaatccttgaattcagaattattaagttcgacgaacttaaaactatattttctatgaattaaaacttgcgcatatcttgaacctttttcaataactatagtttctttaccaatattattaattttaactccaaaatctccagtatatccagcgtcaataataccaatatgtggaattagatcttttttaaaacctaaagaacttcttaaatgaacggtcatataaaaaggatctttttcatcaattgaaattcttaatccatttggaacaacttttgattctcctggtttaatttcagttgtttcggtgcaagtaatatcaaatgctgctgaagttccattataagcaatttctggtattacggcatcttcatttgttttatgtatataaagattcaaatccattatttctcctattaattagttttagattttatagcttcgattatttttaatatcctagaatctgggtctaatttagaatctaagtgaatgacgttttctaagtctactttcttaaaaatattgtttattttagatctaaattcaggatctattgatctaacaccatttgattctaatggtatattttcagaatctaaaacaaaaataaaatcgaactgtttataatattttattaaagaatctgtgaataattttaaatcgatgtctttgttaatacctgtatatactataacatccaaaatacacctatcgtgcacagtgggtgcatttatattttttaaagcattaacactataatacaacatttgcaactgtgttgctaagtttgtattttctgagtgtttcttgtttgttttagctattttattagaaaatgattctatgaaatcaaaattcttaaaataactatgtttcttcattaaattaattaatgtagttttaccagaacattgagctcctgaaattgctattctaactggtctcattacaatcctttttgtagatcttcaaaattatatttaatattattaatttcaattgtatcattttcattcataatatatgttttaccatctattgtgacttcatagaatttaccatcttgtagatcttcaaattctgcgttctcagaaagtatttgatataattcagataattcgcgattggctgcaaatttttgattagtgacatcccaagaatttaatggtttacctttaagaacatagaagctcgtatgttcatttccaagaacttgtgatataccaccataagcggaaaaaccttcacaaatacaaagatatttttgactttttgttgctctaaaatatttttcagattttaacttcttagatttttctacactcttaagagctttatctgcatttaaagcttctttaactttatatatgtctataataggatctataatagatttatttttaagaattttattgatgaatccataatctatgttagagaattcattaaattcttttactgagtttgtaattttttctttagattgtgaattaaatttaagatttggcattccattaataaaacaaacaatcattaatttatttttaatatcgccaggtttaatacttttatattttttgactaatttgtctcttataccctgaactacgttattcataatagtatctatgtgaacaccaccgtctggtatttttaaaccattgacaaaactaaattgtttaaagtcatccaattcatttggaataataccaattttaatattttgattttcgtataactcaaaatctggactaaacatatttaaataattcttaaaagatttaaaatctattttcttagaattaaatttaaaattaatttctgggtaacaaatagctaagtttaataatctttgatagattatattcttatgagtttcatcgatttctttaagattaaatctttctaaatctggtttaaattctactaaagttcctgattttttagaagcttctatattttcactataagtttcagcattgtttttagatttaaaaatatatctatttttaccatcgtctgtaatacctttaaaattaatactccaaacatttgtacaataacttccaactccgttggtacctattgttacacgattagcatcatcatcgaagttagaacctgctttagcgtgattccaagctagttctggcatatagtggtcacctgattttattactggtataccagttccatcatcttcaatgctaacagtatcattagatattttaacactgatatttaagccagatttaaatttagatctaattgcagcatctactgaattatcgataatctcattgattattttaattaaaccgggtacataattcaaagtagtgtatttaattttacctgattctataataaaatcttctgtatttgtagaatctatagcacctatatacatactaggtctttttagaatatgttctctatcagtcagtttcttaatcattatatctcctttatgatattatattgtaaaatatcttaaaagtatcttaacgttttattattcacactaatacaaagcttcaatacaaatattttaatttgtttaaactatcagaataaccactacaatataatctacgtttagtatttaaaccgtcaatataatacccggtgtgtaaatcccattttaaataccaagtatctttttcatttttatgaattttaagccctttgatttgtgctattaaattataaaaaaattctttcatttcaatctcctttgagtaattatattataaaatatcttaaaacattcttaattcaaaactaaagttttaaatcaaaaatcataaaatcataaataatattaaaagagggtctatgaagaatctaaaatgtttcgttatagctttgttagctttgtttataatagggtgtggatctgattattccagcgataaaacaggcaaagaagttcgtggaacttcggattccagaattaatcaagtttgtgtagacggtgttttatacttatcgacgggaaattatgtaacaccacaacaagatcttaatggtagtttaattggttgttctaaaaaaccagaagttattattgatcagctcaaagaaaaacaaaaaaataaagatttagctaaacttgctgaaaatattaagaatgatattaaggatgatattaaggatgatgtaaaatctgaagttaagtcagaagtcaagaatgacttaaaatctgaaataactgttgaaatcaatgaaagtattaagagtagattagataaaaaccatacaaagtaactcacacaagcacttaaagactaagattgttttttaagtgctttattttgttcttctacttcatcatttattaaacttataaagatttctctttcaaatggatataaatcatttaaaataccatctatggtaaacttacctagaaatgataatcttgtcaaacttttgtagaactcacctataggattctctgaaaatatatttttatatatttctgggtttgttaaatcaatttcaagatctttcttacaattataacatttaacaactttaataaagttaaatttagtagtattagcttctaaatacatatctaattcagaatcacaatccacaatattagattctaagtaagaatcactgtatatgtcggttaaatttgggctataaacgtctttcaaatctgggtatgtatttgtatcaatactatggagatctccaatttttcctaaatctatgttagatttaaaagtacaaccacaatcacacctagtatttaaagataattggtcagaaactgaagttgctcttaatctataaagtaaaaataatttttcttccggatataaatcataaatgtttatattagaatctatataaggttctaagattcttaagtaaatgtctaagtttaaatcatttagatctttactgcatacagtatcatctgagcttgcagttaataataaatctctttcagttttaactttgtaagctgttaaagtaaattttctatcgttgtatttaatatattctttcatttagaatccaaaattttaataatattccaaattactgagattcaaatccttattatcagtattagaatctggctctgtacctagaccatctgcaaaagctccaaatgttagatactcaaaactttttccttcggaactttttaaagaatctacaatttctttcatatcttcaaagttcttaacatttgtaaaaataccaaaacataaacaacaagacattactaaatcatcgtgatatcccacagctgcttggtacttaccattatcatttaatgtaaataccccaaactccttaatagtttctttgtccactaataataatttattagcttgtgctaacgttgatacagtttgtaaaataacatcccttgataattttgtagttctgaacccaggatattttaatctttgtttttgtttattgacgtcataatataagttttcatattcataatctcttttgagaatatcagcaaccacttgaccagagccttcattattttctacaattattaaagcttgattgaaccttaaaccatactcattgagtaactctggtaataacatataatctattttaagttttgctgatgctacttgtctgaaatttaaatctgtagtatcaaatatttggactcctgtaaaatcagcaccttctttagcagtatcaacacccataacgtatttatgtccgggtattggttcttcgtatattagtattttagaatccttaatattatcaacttctattggttcttgtggtttataagtatctaatatttcactaggtatcaatgtcatcgcagaaccttcaaatttgcattcgtatgcagaattccaaacaactaaaccaccggttttaatttgttgttgcttgaattcttcaggatcatacttagtaccgtcagatttaaaccttggtactaatctccaatctaccctatgtcttacaaatccattaatagaagtttctaaagtgtcaccagcaccctgccaaatatcgtaaaaatgattcttacctttaggtgtagataaaatgactaattttttgaaagctaagccggcttgtgatggtaaaacaccgtcagtgaaatctatccagcccgcaggatctaaatatgcacattcatctacaacgattatatttgtggacgttccacggaatgcgtccgaacttggtacgtccgttaaaatctttatattattttcacattctattgaacctttattccaagtaactgttccgggctgcatccatattggtaagcctatcaacattttctttgttttgtctaagaactctcgtgccgagttaccactgtaagcaactatgcctatgttgatatctttcttaaaacagtataaatgcgcaagttttacacttgttgtagttgatttagatgaattatgacttaaaacaccattggtgtaataaaggtgataatgctctaaagttaaatcataacaatgatcatattttataaatgttttagatattattttagaaggtcctgattttgttttaattaccttatttaaacaatctctaacatataattcgttatcattttcgtctattaatacgtgtaattcagatgcttgtaacttgaatccattttcggtttctatctcaaaaatattgtatttaatagttttatggacttcgcgaattttgactttacctataggcgtttctacatatttgtctttacattcataactttcaataattttcaattttatcacctttcaatacatctatatcgaacgcttcggtagtaaataatctgttatttcttattatattaattctattgctatcaaatgattttaaaatattttgttcttttttaaagcattcatatattaaatcttcgtatatgtctataattatatattgcatacctttaataaaaaacttaccaaatctaccatctacagatcttttagtaatacctattttataaaatgtaatattattatcaaaaaatttgacataataacataagcccttagtattatgtagttcaccacctggtttatatttagaatcaatattagaagctttggctctgtttattctaatcttttcttctgtagacttattatttagggttgttaaccatttttgaactgtgttattaaaccttttagtaccttcttcaacgccatatctatatataaacatatttaaagaccttgtgttacagcgttcgtaatacttttgttttgctatatcattatccccatataatttgacataatattcataacgcgcattttcattttcggggtgtttttgtttcgtttggtgagatttcacacgtacatcattaattttattttcaatttcagtttcagttaatcccttatacttaataaaattcttagaatttgctgaatacaaaccttggtgattaaacccagggttattaaccttaaacaacgagttattataacggtaaataccttcagtcaaaccaaattgtaatattaaatatgcaagcgtaccactaccatttatgttgtttaaaagtcttattctttttaatatgttcgtgacatcacgagtcattaaaatttttaataaattaataggtaaaaattcgcgatttatacgtcttgtgtggtatatctccattaagttattttgttgattccgtgttaatttcacaccactaagccctagagattttaatatattttctggagttactttagtgtttatttttgtttgtaacttacttaaatcttcgtatggaattaaaattgattgtgtattatgtttgagtatagtacctgtataatttattatataagcgcgttctattttacaaacataggtgcaattaaattttttacgattcactaccacgcttacactcctcaaataattcaataatagtagtttcattaccatttacatttattttagtatttgcttcaatgcattgacgaggctgcattgatatcacgttttcgatagaatcgtcgctcagcaattgtataaattcatcctggtatggcctagaatctacgaaatcaaaaccttttggtgtagtcattcgcacataatttcttaagaaataaagtggatcattcgcacatttttcaagctcgctgatatgtatcggacttaagtttaattttgtgtaagcttttttaagaccacgagacccattataactaattctcgtattatacgcatctaagtaatagttatcagagtctttaggtaaatctaagatttctaaggcttgtgcttttcctagttttccttgagctctaattgtttctaagagttcgtctgttatttcatttttatgtgtttgaaaatattttatttcttctttgcttaacattataaatctttttatgattttgttttattatattatattatatattaaaattaactgattatggtttgaaatttgaagctgaagagctaatattttagtattttaaaatgttagctctcgagtaaaatttggattttaaatgtttaagaaatcgaatctcgatctgggttatatgcattatttgcagaaaattgtgaagctctcatatccctatatttttcaatagaagctagtcttgatctaatttctggcatatagtcgaacttatcaattagaatagctctgaaatcattacttgcttgagccagccctttattttgaattacattctttacaatatcgtcatacattttttaactcctgttatagattatttgtttttatttttgttcttaagtatttcaataaactctaagaaatgttctttaagaatagattcttttagtttcgaatcttcagtattatctttagaatcgtttgaatcagaatctttcgaatctttagtatcagctttgctatcgctgtcagaatctttagcactgtcagaatctttagattctactaatttaccatccaccattacaaattctttttgtgattcatatatagatgttccttccatagtagcattataatcgcttggtgcagatactaaatcatatgtaattaaatcaaatgattcgacaataccatttttaactctgccagaacctctactagatacagacaatttaataccattatctattaaggattttaattggttagctcttggattatctaacaatgtagcttcacccataacatacttgccgttgatttcaagtttattgatggcagcaactgcttccataggatcaactgtacctctttcaggatgttcccactcacaaagtctattaatagaaccgctttttataacgtcttggtattttttaacattactttcccagagttcttttgggtaaattctaccgttacggtttttttcacctattgttgaaaaaataccagcaattttatattttttaactttttcttttttgtcgttaactgattcttcgataagtacattagcatcgtgatattcataaagtaattttaacttatctgacatttaaaatccttgttttttttgtatttatttatacacttggttttgaatcagagttaaatccaggatctacaggctctggatctctactaaaatcagaatcaatagtctcagaagttatatcaaagacagattctcttaatatcgctgtttcgttaaaattgaaatcaatattgaagtggttagtatcatctaaagatattgattcactaaaagttgcgggatctggtttagataccaaattaatagaatcttgtatgctatattctggatcattttttattggttcgttatataagaatatattacctttataagattctgctaaatctaaatcaactttaagtggtgatttataaactaaccccctcattttaatccttaagcttcaatttctttaataataaaatctacagttttaattccaatttcttttattttagtatagagttcgttgcaagcatctgctgaactagaaacaatgccagcacctctggttttaccaggtaaaatacaaccttctgtatcttgtgggtaatttccaatatgtattctgattaatctattgttaaaattagcatcgtttggtcttttaacccaaattgctatggttgatcgatctttattataccattgtgggtattttttagctaatccaacatttttagaactagcacaccattctaatttataagaacctgctgttatacgtttatcagttcctgattcttctgtgcttggtccggcattttcacaagcagcacctttccaaagaatttgaccattgtcatcatataatattaaatcagataatgtagatccttcgattttttctttacttagttttctaacattggtacattcttgtattctttgcaatattaattttgccattatgatcctttttatgtatttattcacttatttggatactaaatatagtgctagatctaacactcgagtgtagatttttaaacattaatagcttgaatttttttgtcttgacttgaagcacttaccggttgaggtaccaacataaattgtggtaaagaacctttagatcttaattgcaatttccataatttaccgtctattttaatattccatttgatatcagcattaccatcacaggagacaacacagtattcgatttttaaatctgaaggcaatgtatcaaatacttctaaatgatttcctgaaactttataaaaattagaacttaatagagatctacttaaacaattacaaacaacttcaaatataatatcattaaaatattttgaactcatagatataaatgctaaactcggtggaaacccttcgaaaaaattagcagctttagcattgctggcaatttcatcataaatgtcagctaagttaatgttattagttctaactctaatgatatctgaatttttatgcttctttaattcaaccatacattctttaaaaaaattaaaaaaattatcatcgaatgatttatatttaatacttttaaaatttggtaaaccataattacctgataaattattcaaagcataggaaccacctaaagcttctttagcagatttcttaagacttataggtattatattatcaaaatcattaatttctttgttaagttcttgataagttttgtatgatttgattttatatgtaggtttaaccaaaaagaaatctccaggattccatttatcctctgctaatttagttaattgtttaccttgctttttaagatcattaaaaacatcagttttgtggtgaaattcataatttctaaggttttgttttaaaataatttcatttagaatacatttagatgcatctttacaagctttatcccaatctggattttcaaataaaaatgttttaacagaatctaatggcgtcttagtcctagtatttttaacttgagtttcattatagaatttaatatcggttaatttagtatttaaaaacatatctaaatagtatacaacgccacactctgctaagtcgtctttgttgtcacttttttgaccttttaatgtgataccagatacattagatttatgaattttactaaaaggtgcttcacctttctttccattaatagaacctttaaagtttttatattttttagtatctttgtcatatatcaaaagttctacagcatcgacattcatacttttaattaattcaaataatctaatatttgtaggatcttttaaatcaaaactaaaaacaccaagatcaccttctaataaaaaatcatttgtttctaatttcttaagaaaaggtttaaaatattttggtttcttaataaattcatttacacttaaaggcatttgatttgtcctatctgaaatactttgttttcaatatttaatcctgttttgaatctcgaattcttttaataacatctgctgttgaaataacttcaaaatcttctttaacttctgtacttggatgcaatgcattaattttattaatattaattaaaatatcagatatccctttataagaatccgttagaatttttaaagacttgtttgaagtttcaattagtttactataagcagttactaagtctgggttatatccttcaatttccatttcttgaactaggttgtcactcataacttttaattgtgctacattagctaaaataatttgtcttaatttattataatcgtctactactaaatccaattgaattatttcatctggatttaattgagctttattaattttagctttctcagaatcgaactcaacgatttctgcttctattacttgttccattagaaccctttatgattttataacagcttcttttaatttaatagattcaaaataatcgatcaattcgaaattatcgaaattaaaggtaagatcaaaagtttgttcagcatcatcagcattcgatattagttgtaaagcacctaagtttgtgattttacaaccatacatagtcatactgactaacgattctcctttattgtcggttatttccacaccacaagtaaattcttttaatggttcgatattaccattatttgggtgaactctatcgaaaatatatttgattaattttgtatatattttgaaatcttctcccacaaggaaacctacagttactgggtcatagtctatgtggtcaccaccaacataaatagttttaccgccgaagttggcttgacttgggttcagactaaaccccggtaatgctatattttgagcatatatccattcatcgcctagaaaaggtaaaaatattttataattactagattgcgaatagctattactagtcatatatttccttgcttgttatattatattcaagtatttattttttatacttacggtattatattaaaatataactgaattttaactgaaatgtagtcattgttatatactattaaaaagccaagcattttttatactttttaatattgctttaagttttaagcatatgctaggatatatagcattgttatatactattaaaaacccaagcattttttatactttttaatattagtttaagctttgctttaagttttaagcatatgctaggatataatactatagtatatactactaaaaaccttagcattttttatactttttaatattgctttaagttttaagcatatgctaggatatatagcattgttatacactattaaaaacccaagcattttttatactttttaatattgctttaagttttgttttgaattttaatgtgggattccaagtccttgaaatttttttttaaaaaaatttttactctttaatatgatatattataatataaagctttttaaaaaagttttttcgagtttttaaaaccaaaatttttagtttagatttaaaacttaaaacaatattaaaaagtataaaaaatgctaaggtttttagtagtatatactatagtattatatcctagcatatgcttaaaacttaaagcaaagcttaaactaatattaaaaagtataaaaaatgcttgggtttttaatagtatataacaatgctatatatcctagcatatgcttaaaacttaaagcaatattaaaaagtataaaaaatgcttggctttttaatagtatataacaatgactacatttcagttaaaattcagttatattttaata

SEQ ID NO: 15 - DNA, 41892 bp, Camplyobacter Phage CJLB-15
aatctttaagtaattttaataagtataaaaaatgcttggctttttagtagtatatactatagtatatgcttaaagcttaaagcttaaagcaatattaaaaagtataaaaaatgcttggctttttagtagtatatactatagtatatgcttaaagcttaaagcaatattaaaaagtataaaaaatgcttggctttttagtagtatatactataatactaaaaactcactaaaaattaataacattttaagttttaataatatataataacaatatttcaaatcaaaaggatttatatgaaagatacagttttaagcctaagtggtggtttagactcaagtgctttactatttgagtttaaagatcgtattaagattgctgtaagttttaaatacggttcaaatcatcaagaaaaagaactagcagctgctaaaaaagtcttggatgaagtaaataaattaggtgctgaaatcgaacatagaataatcgatttaacagaagcttttggaacttttaaaagtgctttattaagcggttctaaagcagttcccgaagctggttcaactgaagtttcaaatgtaattgttccgtttagaaatggtatattcttaagtatcttaacgggtatagcagaatcagaagattgtagatttattgctatagcaaaccacagtggtgattctaacgtatttccagattgtagatatgattttatcgatgctatgtttaaagccattggttcaggaaccgaagacagagttcaggtattcgcaccgtatacaaatattacaaaaactgatttgacaatccgtggtatatctaatggtttaaacccagattggacttacagctgctataaaggtggtaataaaccttgtaatgaatgttctgcttgtgttgatcgtaacaaagcagttcaagaagccgcaacagttctaaaacattttagttcttaatttatagactattaagttttaatatattataatattctaatcgtttacactaaagtgtaaagcaacaacactttagtgttaattttagaactttagtgtaagtcactaaaattagaaccaaaggagaaatatgaaactattcgaagcttgcttcaatttaggtaattttgaaacttatgaaagattctataatacagaaactaataagtctgaaattcaaaaagtctttcttaagaatcaagtttttattgaggatcctaaaggagaatatacatttttattagatccaaatattaaactaacaaaagttcaagctaatcaagctaaagatttagaaacttatggtaagactaatattgctgctgaacatattaggcagaactattggaaactcaatgattcaaaatataataaaaatataagtattttttatctggatatagaaactacggcacactcacctattgacaccgaagcttgtagagaaagaatagtttcaattcaagtatatcataacttaacgaatacaaattatatttttacaaatgagttctttgacaccgaagctcatactaaagattctaaatatattttcgatgataggacttatgattttaaacttaaatactaccaagtagaaggtgaacataatttattaattgctttatttaaacttatagaagctttaaaacctttattagtattagctcacaatggtgaaggttttgactttgcttatctttggagaagaactgaaaagttaggtttaactgaaggatttagtccatttggaaaatctgaatttcaaataaatgaattagataatggaactaaaaaatacagtataaaagcgcccggtgttttctatatggatactatagatatctataagaagtttagacttaaaccgagagaatcttattcattagattatattgcagaagttgaattaggtgaaagaaaagttaatcacgattgttttaaaacttttgatggttttagaaccggtgaaggatttattagaccagaagttgaacctagcaaagaatctattttagaatataaactttataatgctaaagattctgaagaaataaaaagaatttctaaagaatattttattcattatagtattatagatacatacttattatatagaatagataatgcaattaaattatctgatattatgattagtattgcttctattatgggtattcaattacctcaaacacttggaacaacaactccttggagtacatttatccgaaattatgcaatgcaagataaaatagtattaccaaatccaagtgaatttagtggtgatgtagaatttaaagggggctttgtagctgaaccattaattggtagatatgattgggttttttcagcggacgttaccagtatgtatcctagtcaaattatggcatttaatttaagttctgaaacatttataccattttataaattgccaaatgatttacaagaagctataaatgaattagatcttaatgaagatgaacaatatcatattaataattattataaaaatcccgaagcttataaaaaatacacggatttacttataaagtataattattgcggatcattaactggatctgtgtatgataaatctaaaaaaggtattctaccaatattaacagaattagttttcaatcttagaaaagcagctaaaaaagaaatgttaaaatatgagcaaatggctgaagatgctaaagaacctgaattaatacaaaaataccaagcattagcaactgaattggatgtcaatcaattgacatttaagattttaattaactcattatatggagcttgtggaaataaacattttattctatataataaagaaatcgctaaagctatcacaggaaattcaagattttatataaatcttatgagtaaaaatatcaataattttttgtgcgatttatgtggttctggaaattatataatttataatgatactgactccgttgttggggattcaattattaaagtaaatggtaaaaatattaaaatagaagatttttatgattctataaaagttgatcctattgttacaaaatctggtaataatgtaaaattagtagataattgttttacagattctgtaaataaaaacttacaaattgaaactaaaaaaattaattatataatgaaacataaagttaagaaggaattttttaaaataaaagtcaataataaagaagtggtcgtaaccgaagatcatagcattatggttttaagaaattctgaattaattgaggttaaaccaagagatattaaaacaggagacttaataatattaaatgactgaatcatattttaacgatttcaaacaatttttaaaatctgaagttaaaaatggtaaattgccttatacaactatgtacaaatatttactcacgtttagcgaatacagacctaaaaatttatacgcgcgataccgacgtttacgcaaatacactaagggtggtataacgaaatataaatgtttgctgctatacggtaaaaccggagcgctaaaaaaatggacaagttattgtaatagacaagcatatacaaatacaaaagaatataaaatgaatgtgctgggtatgagtgattatgaagtagattgttataatcaatccagagcggtgactaagaaaaatttaataatgcgttacggtgaagacctaggtaataaaaaatgggaggattatagacatagacaggcatacacaaatacaaaagaatactttgttgaaaaatatggtgaaattgtaggcgaacagaaatattataacatcaacgcaagtaaagcaatcactcgtgaaaatcttattaaaaaatatggtgaatacctaggtaatgaaaagtggcttaattttttaaataacaaaaagtgtataggttattcaaaaatggctacaaaattatttgaagaattggaatccaaattaggaaataattatactttttattatgaaccaaaaacaagagaaatagtattaaattctaacggaactccgtatttttatgattgttatatcaaagaattaaaattaataatagaatttaatggtgatgtatttcacgcaaatcctaaaatatttaatagccacgacaatcccaatccatttgacaagacattgactactgaggaaatatgagaagcagataatagaaaaattaatcacgctttagataatggctataaaattataataatttgggaaaacgaacttagaattaatacaaatttaagtaatattattatagaatatataaaatcgaataatttattagatttaaaggagtttatttgatagtaactgaaaatttccaagtagaatctttaggtatccaagaattagatgtctatgatattgaagtagattctaatcataatttttttgctaatgatatattagttcataacagttgttatgttcaagtacctaatattataaacgaaaaattaccaaaagacccacaattagcaacagatataattgataaatttatagaaactaaaatacaaccggtaattaacacaagctcacaagaattagggtctatttttaatgctttagatgcttcaagaatttctgcaaagcgtgaagcgattgcaagctctgctgtgtttgtagcaaagaaaagatattttatgaaagttatagattctgaaggtgttaggttcagtgaaccttatcttaaaacaatgggtatcgatattgtcagatccagtacaccagcattttctaaaaaatatcttaaaaaatccgtcaatattatattagaaagtacagaagaagaacttaaagaatggttaaaaaatattagatcattatacctgggtcaaaatctaatggatattgctaagatatcttcggtcagttctagcaaatataaacttggtgtggataaatccataccgattaattcaagagctttcttggtatcaaatcattatataaatagtctaaatacaggtgagtttcaaccattagaattaggcgaaaaggttcgtatgctatatcttagagaacctaacccattaaaatctaacatttttgcttttaataatgaaaaatttgcaaatgtatttaaagattatatagattgggatactaattttaataagttctttttaaaaccacttgaaataatgacagacccacttaattataatttacataaagaaactgaaactttggaggaatggtaatggatatactcggtgtttacaattatattaaatcttatattttaaaaggatacaattatttaaaaagtaattattcttttattactataatgatattattatttggcactatttggttagcttataatttattatttgctgtaatttttattgttttctttttaataggttcgtttgttttatttgcatatcttgattctgcaatagacgacattaattttaaaaaataatgattaatagggctgttataactaggtgtttcaaatataatggctctatgttcgatgcttttgaatatttttatagactttgggaattagatcctgatactaaatttgtttcattgtacagtcatatcaataaagattttttaagcattaaatacaacgtagatccaaaatgttttgataattttatatataaagatccatatgatttagaatttaacaaagttttattattcgatactcacgatttctataatataaatcacccaaaatcccttaaattaaataagttatatgtaatcgctaacagcaccatagggttcaaagaaaatactgaatattttgatgaatattttttaaataaaaattatattaataaaatatattatcagattcacagaatatttaatcatttagataatgtatatgttaattgtatggataattgctgcaagagttatttaaatattcttaaaatgtatccgaaagcaattatcaaagatcctaaaaataattttcaacattacacaatgactaagaattttataccggatatttacaagtattttaataagtacatatatgttaaaactggtagaacttatgatagacacccaagacaatttacagaatgtgcttaccaaggcattgattgtgaatatatttctgaaggttctaaattcacaaaaaatgataattcatattatagattcgaagatagatacgattttgataagagatctatatacaacgatatagttatatctaaaatgctcgattaataccaaaaataaataagttaaaaggtttatgatgagattcttagaatactatagattaaaagaagctgaagaatttagtagaaatgacattaaaaccatcgttaaacaatacaacaaagtattcacaagaattctaaatgcaaaattctatttagttaatgaagttgaacattgtacttcaaatggttcaaaattaataggtattagatttgccagtgctgatggctatatgataagatttaattacactgcaaaaaacgctaaacaaattcagaaaattaacaaagctactaaagaatttcacgttgaaagtatagatttttggaatccaataactggacatttaaataaaccaagtatcagagtttctgtgatttcgagtttatctctcaaatattttatagaagacattacaacttctattaaaaagaatcttttaggaactttttattataaagatcttaaatttacagacgatataaaatcagaaaaatatgtgattaacccagatgaaatcatattcattaatactaaaggatttaaagaatccaatgattttacattaaattcacaagatcctaatattcaacttatacttaataacatcaaagaagtttatggagaagcttgatgaaaagaatcttaaccttatcagatcttaggcaatatatcaaggaagaactcggatatccacaattacaagttgaacttacagataatcaattagaccactgtattgaaaaaacagttcaaatgttttgtaatgttgcatatgatggagaattaacaagatatataaaatttgaatgtcagggccaaggcaattattttgtagatcctgaagttgaagaaatattacaaatatgccaaagtggtatttttgtaggttctgatttaaatggattaatagatcaaaatctatctaattatatactatctacttctggtgttgctttaagttacttagttactttaagttctacaagatccttagtcgacaaatactttggtcaacgtattaatttcgagtttaactctcataagggattattatcaatatatcaaaattaccacgggcctttgttaattgaagctaaatgtaaatacataccagatgaacacgataaaatatatgaccaagaatgggtcaaagcaatgtctgtggctcaagccagattgatgcaaagtgtagtcttaggaaaatattcagcacctttaattaatggttcgcaagttaattatagtgatattagacaattagcccaagatgaaatacaaagattaaacgaggaactttccaataaatttacagaacctgctgtatttatcgttggctaaataattttatatttaaggaactcttaagatattttatattataattatcaaaaggagataatatgagagtttctaaatacaaaatgttgagttccttaaaagactcagaatacaacttagttttaacaaattacaaatacccacaatctaaaatagatttagaagaatttaacgagtttggagaacgcttcttaaaagataatgcaattatcgatgttaaaaaactcaaagatcctgaattaaatcttagatatgattatgttttaatacttagaacaaaacttactgatactgctttagaaattataaaagaagcttatcctatgctaaaaactattgacgaatataaagcttcattaacaggagattttaatgaattatgataaactaaataaaattggaataattttgattattattttatcagttgtttattttatgcttgatattaataatacaaaagttaaaaatttagaatttaaaattcaagatctccaaacagaacttaataaaaccaaaaaagaattaaatgataccaaaattaatttaaatcatttaagttctaaagttcaagatttaaaaatatctttaatgaaagatatgtcgtcaatgtatcacttaagtgataaacaacaatctctaatacttgatgaaatatggaaacaatctaaaaaatacaaaataaatccagcattcttatacgcaatactgtggaaagaatcaagatttagaaacgacgttatccataaacctacttatgttagaacacttaaaaaagaaatacaagcccaaggtatgggtgctattgtttgggatttctggggagataaactcaaatctaatacaagtttaaaatctaaaaaagatcttaaaaattggaaaaagaatatagaaggaactgcatatatacttagttatttgaaatctttaccaaaggtatctaatacaaaaaataagtatgaatcagcggcttcaagatactatggaaaataccaagcaaattacgtgaataaaacaatgtcaaaatttaatgaactaaactcttaatgctgaaattaaagtgggtttaaataacgattttgaaccgatatgattgtctaataattaagtacattttaagtgctaatatgttataatattgttagatttcaatagaaaggagaactatgaatgaattaagttttgtaccaaaatcagaaattcttaataaatcacaagaaacttgtattaaagaatgccaagatattgtatttcaagaaacaaaagaagtttctaaagacctcatattagatacattattaggtatgatagattctgtcaagatttcagattctgcagttcatataaaattcaataaatctttaatcatacaaagtgaaaacattgttttaggtgcggataatttaaatatacaacttgcaggaaaccgagtagaattacaaccaagaatcaaacaaaatccaaaggagattaaatgatcacaaaagatttcattaaagaactttcaaaaatgtcgagtataactgataaagttattcttaagtatccaataacaacattaaattctgaagctatagatatgcttgtaaatatagatgcgtctaaattaggatgccaagaattcccagatactggtatatatgaattaaataagtttgttcatatgttcgcattatttgataatccagaaattacaagaacaaacaatgcaatagaatttgaaacaccgggtacaaaaagtgtttatacaatttcagatttgtctgtaatggaaaactttgatcaaaaagcttcaattattgaaagtttagataattttccagaagttgccagagttgacattagtattgaagtcataaaacaaattaaacaagcttcaagtatttacaacgaattaaatgttttaagtatagaaggtaaatcaaatgatttatatttgtatttagatgcacataatagatttaattcttctaataatacatttagcaaagagtttttaaatcattcaactatggattttaaactgaaaatcaatattgaaaattttgttaaactgccggtaacaaattatactttaaagattaaatataatgagagtaaaaacgcatttagaattctctttgaatctgagttttctaagattttgatctcaaaaattgcagattaaagattttacaccaaggaacaataaatggataatttaaaacaactttcagctacgtgtatgcaaatctttattaaattaaatggaatgcattacttagccaaaggcaatcaatttcacagacttcacgaaataacacaagaatattatgaattttttcaagagtcgtttgatacattcaatgaaagattggttcaattgagtttaacaccctgtgttaatatacaagaaatccacgatctgaaaaatccatatattttagatctacaagctacaaaacttgatttggataccatagctagcacattaataaatgattttaaattagttgacaattcagtagcagttcttattcaagaagctattaaaattgaagatactgttacagaagacatcttaagaacatttagaattcgtctccaaaaatatatttggatgctcgaatctatgcaaagttaaggaggtataatgttaaaagaagataaatttatttggagtttatttcagaaaaaatttccagaagtttcaagagaagcttatgaagattttgtagaagaatatttaaatatcaaaccatttaaagctagtgaaaatatatttgaaaccaatcaaagtatttcaaacgaagctcattttattatgagagcattagctactaaaaaattacaagaagtttttgaaatacttaaaattgatttagaagacccaaatgttaaagcagattttgaaaatggtaatttaggaacaccaggcagagtcattaagctaatggctggtgccaacactgatgatgatactgagtgtggctctggtagatttatgaaacctgttagaatagcaacttttccaaataaagacgcagctaagattccaattactaaaaggattaacatagcaagcaattgtagtcatcatttattaccatttaatacagattttgcggaagattcctatgcaatagttagttatatacctaaagattatgttctgggtatttctaagttacaaagattagcagatttcgtctcgaggcgttattggttgcaagaagatttgactaaagaaatctacaataaaattaaagaagcagcacaaactgaagatgtttatgttaagttatgtaatattaaacatacttgtgaatggattagaggtgcaagaaacactgaggggggatttacttcagaattctacgggggtgcttttggtgatcctgaattaagaaaacaggttcaaatccgagtttaatgttaatacactatagatcttagcatttaacactttagtgtaatttgctagatctttagtaaaaaatttaattaaattttaatcgttctttatatataatatcatattaaaaatttaaatttaaattttaaaagtctaaatcaaaggagtttaatttggataattttgaatcggttcttctaaaaaatattatagaatctaaagatttttttaataaagtaaggccaatcttaaaacctagtattttcacagattttggtaaccaaaaaatctatgaattaatagataatttttattctaattataatacaactcctagtattcaagaaatagcacttcaaattaaagatattcctaataaagaagcaagaacccagattgctactaaacttaatgatgctagaaactcagaaaatatcaataaagaattcttagatgatttaactgttaaattcattaaggaccaaatgttcacaaaagcattaatgttaggtgctgagttcattgataaaaaagatgaaacttataaacaaaaagccaaagatcttatagatgcttcacaacttgtgaatattcataaagatcttggtaatgaatataataatatagaagaacgcattgattattatcaaaatccaagaaaaggtatcaaatatttaagattcaatactttaaatgagtatatcggagaaggctttcttaacggaactttgaatatttttatggctcctgcaggtattggtaaaagtttattaatgagtaccagcattggtgattttcttaaacaaggtttaaatgtattattagtcagcttagaattatctaattttgagttcttaaaaagaatagatgctgacttattagatatacaaattaatgctttaaaagacgtagaccctagtgttatcagaactaagtttgaagaactaaaaagatctggtattggtagcttatatgttcaaaacttcccagctggttcttttagttcaaatgatttaaaatctttattagaaatgtataaagctaataatataaaattcgatgcaatattcttggattacttaggcttgatgaaatctgatagagtttctgcaagtgcaggtttatatagttatattaaggccattggtgaagaagttcgtgctattgcagtcacagaaaatattccgatattttcttgttctcaattaaatagatcagctgtaaataatacagattctaacaatgaagctatttcagattctatgggtactgctatgactgctgattggatttgtttcttattacaaactgaagatcttaaaaagaaaaatactattagatttaaaataactaagaatcgttataatggtagaacttcaagttttgatatgcatattaattataataatatgcgtatagaagatatagtttcaaatgatatacaaatgttaagtaatgctgatattaaaaacgttccacaattagaaatacaaaaacctaaaactgattggaactttaattagtctcataaagattgacactatagtgttaaatgttttaaatttaattaaactttaagtttaaatattatataattataatgtttaaaaagtttttttaaacggttagattctaaccaggattttcaaactgttaatgtaaaagttgcagtttgaatcctttttaaattaattaaactttaattataaatatgattgaaaatttataattttcggggtgtagcgcagtctggttagcgcacttggtttgggaccaaggggccgaaggttcgaatcctttcaccccgaccattctaacattagtaagcattcgggtaattggtaactcaccagactgtaaacacatttaagatttcagtagaagttttaaatgtgtttatgatgtcagcgttatattatataactaaaactgatgattgtaaacacaattaaaaatcatttgtaagttttacccatgtttattaaattgtgatactatatgtttatataaccaataaatatatttaaatatattttggaggattaaaatgacatttaaagattatttaaacaatattgctttaaatgaagcgttgaaaacggatgtgtctgctatagaggaactcagaaatagatatcaagaagtagccaaaaaaaagatggaattgcaagccgaaataagtaaactagaagctgcacagactacagcttactttaaactaggtggcttagctgcacagattgcacccgataacgttgataatgaaaaactcaacaaaggtttagaacaatacgacagtgaaattgagaatattgagaaaaagttagaacctctttataaaaaacgagaatctttactagacgagcttaaaaaaataagcagagttgctaataacttagtaacaagaaatgcaaaaaaagctggtgtaagccctttgaattatgtttttaaacataatttatcattttaataaagttaaagagtcatcgtatagaattaaactctatacaatgactgaatataatgcctgattagctcaactggtagagcattcgccttgtaagcgaaaggttgagagttcgagtctctcattaggctccattgtcctttatgtgggaattaatctacgtttaagggaattgatagttaaggtaacggtaaatatgatcgttgtggtattacagacctaagagcttccttgtagctcaaaccttataagtagacataaaccttataagacgtatagctttatatgacccacatttactaataaacttaattattcccatttaattttatcgacagatttaacagtttcagatgaattaattttttcttttaatgtattcgctttaaatattacttcctgagtatattcggttacttttgaaacaaatgttaaaaattcttgaggtgtaaaattaaccttttcatcattcaagtcaatccaagtaatctcagttattgaattagtaccactttgtatatctaacaatatattagcggccattccgttaatattaagtttatccttttccctagtttggaatgtatggtctttgaatacaaaaccagattctaaagctacgtccctttttgtttgtatttcaaacttcttcttttctttaattatattaagtttttcagattcacttgcagtatttagtacatattcataatacaaatccataagattattagctaagcagtattctttgactgcttgtgtacccgcttgaatttcttcaggtgtaatgtcatctatatgctttatgatatacttatcagataaacttgtatccgtggttaaaggtctgtttaatacacacaattcagtattagcttcaatagcccatttaattacatctgaatttaatacaccttggtcacttaaagttttttttgctactatcatttttactcctatatatttgttgaaatgtaacctgatgttgtccattgcccaggtgtttgtgaaaatttagttccaatatttccagtcatagcaatgctaggattatttattacgcctccaccaactacctgtaacccaactttataattaccgcttatatctatacctgtatgccaccatactgaacttatctttgaattagtcgctgcgctaatagctactagtttttcaggattatttgataaaaatttaacattagcacctatttgaagattggcatttaatactgataaatcatagcattcttcagctccttgataattattttgaatattaatgttactcacttctatatttcctgaggaagctatcactaaattagtgagtgacattcctattaaatcaacattatatatacttccatttgtaccagtagatatgtatattgatgagcaattgttagaagatgctcttattgtaatatcgtgtatatgaacctcgcacatcacgatatataacccaaattgcgcccaagctgtattatttaaatctattataagttcatcacttcttccattttcaccaactatattgacgcctaaaggtaagttataaaatgtagtaggtttagtaatagtatatccattctttatttttaatgttatatcatatatagacttaccatatttatatatttcattaattgcatcatctatattttcaaaattacctccctctccgacagtccattctaatttttgtgttaataatgtagagtatctgttacccgcttgtgtcaacacatcttgcaatttagtatcgatttcagatttatcataaacagattcggcacttgctttaagttccataaaagaatctatagtagatttattataatatgaattaaatttagtattaatttcagatttattataaacattacttgtgttggctttagtatctaatttagaatctacttcagatttattataataattagataaatctacacttagaactgcatttttccattttttagtatttgaatcatattgtaaaatatgattgtttgtcgggtcaacaatacttgtatcaattaagttagtaatacttgttttatgtgggttattaaagtctgtcttatgagtattaattaaatctacattaaaattctttttggcgtaagctaaattaatagcgtgccaatcacttgttgggtctgcaacattaaatacttgcgtttcagaaccacccagatttgcttttgtatttaaattattattgatgctaagaatgttattttctatattttttttaaattgggtatactcactatacctagtatcttctaattctttatttgcagcaatggtattttcagcagtcgtcactcttttttctaatttataatgtttatcttctatatctttttcattagtacctactgtagtttctaatttggtaagcctagaatcattagcttccttataagtttcaaaaattatttttcgaaggaaattatcttctatatatttagaactgtataataaatcttttgaagcttcttctggattttcagttgtatgtctaaaaattgcttgaagatctattaattcatctgatgcttccatagtctccttagtttcagaatccatacaaatccaatatttaccattaactatatcgtgaatattagcgatataactaatactaggatttgattctttgcttattttattaagttctgttagaactttttcttttaactgttcttttgtgagattttctgatattaaaacatcaacttttttaaattgcatttttcacctttaaactaaagattttataagtctatctattcttttatcctgaacgatattattactagtattatttatgatcttaccatcagagtttattaaaataactctaccttgatctacgtctgttactctaacatatactggtgcaccatcatttttagcaactaatccctgcatttcatcaacagcttcttttgtaatttgacttaatgttttagttgtttcgtatacgaaatctattatttttattttagatgcttctaatgccatttaattttccttgtatatttttaccatttagatactaaattttcaaaagtatcttgaactgcattctgcgctgcgcttaatccattttttaacatattactaaaatatgaacttgctttagattgtacactatcattcccggtcgtgttggaagtgcttgctaattgaatatttttaatatctgtattatcgtgatttggttggttcattttaaaactaacattgaattctataatttcattgttatcttgagataattgtatttgtgaaacatctgtcaacaatgcatcctgcgtctccattactaagatgtttttagaaccattgcttaaataaacctgaattagccaagcacagacatcattgtagttaccttttgaaatttgaaaagcattgataaatctacgatacatactagcattatcaaaatctctgaaggtcatatccacttggtatactgggtctgcaccacgtgctaaaacccaagtccctccaattaataattcttcaaatctaccggtatattgtggcaaattaatactttttaaacaaatatctatactattttgtgtttcggtagggtttccccagtttataagattttggaaagtagcattaataggtttcataataactataaaatcagaggttttactccatttgatagtattaataacactagcaagtttatttaaggtaacagttgccatttatcctacttttttgtatatttattttcgatttttggagctaacatttgtcgtttaaagaccataatttaagcttcttttaagcggtgtttagttataataacttcaattaaaaagttaaggaaattaaaatgataataaaagaaaccatttcctcaacatcttttagagaatacttatatgaacaagcttttagtaaagatgtaatgatctctaaatttactaacaattcagacaacatttttaatcatattttaaaagtcttagtatatgatgataatttaaataataaaaaacatttaagagagatgtcaggaatagtaagatctttacaaaacaaaactatcaaatcaaaaataacaccggaagacttgtatcatattttctatggaaatattgaagaagattcgaatctgaaacaatatatcttggatttagagattaattacggttctcttcaaaaatctaagctatcagaaaatgagatacatttcagactagctagaatctttaaaagattatcaagtgagatattaacaaagtcattcaagtcttttgaaaaatatccagaactaagggatagattttaaaacaacaggctttgatataatttatacccgattatatcaaagctttaaatacacaaatgattgaatcataaatatttaaccaacgattaaaggactcaatttgaatttagacactatacatattgttaaaaataacggagaacgtgaaatattcgatgctgaaaaaatacataaacacttacattttgcttgtcaaaacctcgatgtagatattattagcattattaaagatgctagattaaaaatatttgatggtgccaaaagtgtagacatacaagattctttaattaaatctgcacaagaaaaaatcagtgaagattctccagattatgagttagttgctggtagattattaaatcaaaaactcagaaaagaagtttataaacaatacacaccattagattttaaatcacaagttaaagaacgtattaaaaaaggtttctatactgaagatcttaatgcttatagtgatgaagagcttgactattttggatctttaattaattatgaattagataacgaactaccttacagcgcattaaatcaaatgtattctaagtacttgatcaaacataataaaaaatgcattgaggttcctcaagaagtttttatattgataccaatggctattttttataataccgatatagaatatagaaaaaaatatgttaaacttgggtatgaattattatcacagcgtaaaatttctttacctactcctattatgaatggagcaagaacaagttataagaaatttatatcttgtaatttattaaactttggtgattcagttgaaagctttgctaggggtttagaagctgttttaaaatgcaccagtgctaaaagtggtttaggtatcaatacaagtttcatcagaggtttaggagctccagtaggtaaaccttcaagattagatcatactggtatgctgccgatcgttaaagccattgaatctgctacgtctgcgctgattcagcacggcaggggcggtgcaagcaatctgtcaatgcctttctttcactacgaaatagaattattttcacaactaggtgattctaaaggatctttagaaaatagggctagacatactgatcaaactattatcatcaataaatggttcttagaaaaagctcttaataaagaggatatatttttattccatatgaatgctgtaggtaataaggatcccaaattagatttatatgatgccttaggtgattataaaagattcgatgaattatataaacattatagcgctaaagttcctaataaaagtaaaaagaaaattaatgcttatgatttattatctttaattataaatgagagaatgattactggtagagtttatattgtttttgcggataacttcgttaattcaagttttaaagaaaatctatatatgacaaatctttgttgtttagcaggtgatacaattgttgaaacttcacaagggcctaaatttctcaaagatattaaaaaaggagatcttgttttaagttataatcaagatacaaaaaaatatgaatacaaagaagtactagcagctgttttaacaaatccggaagctgaagtttttgaagtagaattcaatggtaaagtggtcatttgcactagtgatcataaattcttaacccaaaggggttatattgaagctcaacatcttttagaaagtgatacaatagtagaatgttcctcccgtatttagaagaaataacatatttagataaaccgaataaacataatcttaatttctttagaaaaacatatttaatggatttctttgaattaggattagtattcgacgaaaatgaagatttaattggtattaaaaatgaagatactacatcaggctatttaccactacattttaatagtatattagaactctcagagtttttatatgcttttaatggcgcgtgggtagcaaagaaagtattggatgattgccagaaaatggatatggtgattaagcaaatgtctgaagaactcggtataccagaagaggttattagaaatggcaagttttaaagaatattattacagtgaaagtattttatctcataaaagtgattacaatattgttaataaagatataattgatatattatccagttgtatagcaagtttcaaagaaagggctattttaagaatggctacatttagacacaataacttgttatattatgttataattgaaaggagaaggggtgtcaaaggtgaccatacttgtgtagaaccacattttggtgcttttgtaactgatatagaaaatatcttaaaaatttctgatactaagcaattgttgttacaactcaaacacagaaaggatattttaaagattttaaacccagataaaatagaaacaaattctcaattagttttatcctatgtattaagtgttctaagagattatattaaagaacattatacattgtttattaagcttgtgactaatgaagaattaatgaaaaaatatataaaattattaccttatgtttgtactgatttaaagtatactcctatagatatttcaaatgaaattagaacggattttgatggaactaggaagcgttttcttgtgctattgctcagaaaatcaaaagatttagacaaacaagatgtactaaaatcacttagtaatatcaatttaagtaattatatattataataacaataaaagaggtgctatgataaaaataactaaaaaaactgaaaaaatacctgtatacgatatagaagttaaggataatcataacttttttgcaaatggattgtgtgttcacaattgtgaaatatctgtgcctagtcatagtttagataattataggggtataccaggagaactaggaacttgtatcttaggtaatataaattttggacattctaaagaatctgacatcccaaaagttgctgatttcttagttaggttcttagataatatgattgatatttctgattttgctatgccagaaattgaatactcagctacaaaacgtagaacattaggtattggtgtttctaacttatttggatatcttgctaaatcgaaattattttacaatacaaaagaagcacgcgaacatattaatgatttaatggaattattttattttaacttagttaaaacttcaatagatttagcaaaagaacgaggtgcttgtgaattatataatgaatctttttatagtgataataagtttatattcgaaagatatttagaagctgggattaaacctgaatttaaaacaaaattagattgggagtcacttcgtgaagaattatctaaatacggtatgcgccattcaagcttgtcagctgtaccgcccgctgggaacagttcaaagccaagctcagcaacacctggtatcgaacctccaagagaattagtaactattaaaacagaaaaaagttctactgtaaaacagttggttcctttctataaaacagccaaaaaatattatacgactgcttggggtgttgactttaataataaagattatcttaaattagtgagtacaatacaaagatatgtagatcaaagtattagtacaaatcaatattataatatcgtagaaactaaaaaagttaatattgaagatgttatagaagaatttatagaatgcttcaatttaggtgtcaaatcattgtattatgctaattttagaactacagatgatgcagatggtgatcaagtaattgaaggttgtgggtctggaggttgtagcgtttaaaaacttttaggtttaagcttttaagactttttaagcttaaactttaagattcggtttgtatttcagaaacttttaagttattttatattataattatttcattaaaagataaaggagataaaatgaaacacattacaaaaatatttttaggatataaaaacgacaaagcatatttcaatagaacacaaagacaaattacgtgtgctatcaaaaatcttgaacgtttaaaaccttcatttaatattaacgaagctagatttgaagaaatctacgaagctaaacaaattgaaacaaacccaaatatactttatattgctgttacagacaaacaatatgtaattgtagccaatagtgattggcacggtaatatcacattagattataaaaatattgattttggtgtagaaagaagtctacaaatatcaaggcttaaaagattatttagagctggtgttagaatatggaaatgtaatacttacttatatgatagaaaacgtaaatccataggtttgaagaaacctagtcttgaagatcgtttagcagaatataaaaaatctaaaatcaatgattttaacaaatattgcttaaataaattaaaaagtgttagtaatttaaatctaaatgtaaacaatattgaagatttagattttaataatttagaaaaacaaattgattttatgaaagagttgttatattatactaaaaaatatattgcgaatgaaaaatataaattttgtgatgaaccttattttgaaagcacaaaaagaaaaactatgaatgctattataaatttaaagatttgaaatacattcataatcacacaaaaactgggattaaacgatgatattagatactaaagcagatatattagtaactcatagttttcactttaataatactaaaatgcacggattatcaggacatttatttgaagtattagattattactggtattttaaaaataaaggtgttaatgttaaatgtttaattccagaagtagtaactaaagaaacttttaatgatttcgtaaaaggacactatagtgtagattttgatttaaatgatatatattttttagatactaagatattagcaattaaagctagaaatatactagtaaccgatggtgggtattggtttttaaatcaatataagtctaaattactaggtaaagtattttcgtttgcttgtggtcctagttttttagaatccgaagataaaccagaatatgtgacttttttagcagatcataaaatatatcctggtttgggaataaattatactaagaaggtgttaccccatttaaatcatataccaggagataaaccttttgctcatattactaaaaattgtagggcattatcagaatctcaaataaaagatctaataagagattatcctgatattgtaatgtatagtgattatttgaatatacagaattcgacaaacaaacctatcaagaattttaattttagtaagtatgtgtatacgcctattatgagacattttgattgttcacctagacttataatagaatgtagaatattaggtatagattttgatttatggaatatcaattataaagatcctggtttagaaagacgtttagaaacagatctggatcaatttatattggatgggtccgacacaattataaattatttagtttaaagtttaaaagcacacaaaggtttaaaatgaataaaatagacttctcgggttctgaatgttcatatgaaaaactactaaatggaacattagagtttgaaggtattcgagctgcgataatgacaaccgataaatgttgttttagttgtgaatattgttgtaattcaggttttacagattttaatgctgctaaaaatactaaaagcgaagcagatttaaaatgttttaatttggttaaagctatatttcctagattaaaatccgcagttttatgtggtggtgaaccactaatgtgtgattatctttatgattatttagacttatttaaggatctaaaagacgtaacaattttaacaaatctattatatataaaagatcattataaacgtctaaaagaatatagaaacctagatttagttacaacttatcacgcttctcaaattaattctaatcaatatattgaaagacttaaatatttcttagacatagatttaccaaaagaagttaaattattttttaaccataaaaaaccagatttaatagaaagaactcaaaatgttaaagatttcttagaatctcaaggatttactaatattatttgtactcatatttcaggatttggttttagtaatccaaataaaaatgtagcaggcgttgaccttaatgcagatagagactacgtaatgatttctcaaggaactaagaaatatatgaatgaatctgagtttgcgagtcaaaattatctcggtatggtctgcaatggtttgagacttcacgtttacccagatagaatcattgaaaattgttcaagaaaaactttgactgtagaagaagttctaaagttaaaagattatcaagtttgtaaattcaaaagttgtaatgttggtatgtgtttgaattattttaataaatacaatgttaaatacttaaagaatatcaattttaattgtataacacctcaaattgattatgatgaagaaacaataaaaatattagattgtttgaatttttacggagtagaagactatgaaaaatattgatttgttaagttggattagtaccataaaagatattgaattacttgaattctttgagaatctaaaaaattctaataattctaataattctaataattctaataattctaataattattcagatgtgacaccagacttaattgatgaatatattagaaaatataatttgtagttgactgtaattgatttttaagattctatattatataatattacaaggagataaaatggattcagattttaaagattttagtaatgaattgactgacttattgaatagtatagatttgagtcaaaatttcgatgatattgttaaatcattgaatacaaaaagtatagttaaagaatttataaccgcaaaaattattggaatagataccgatggtaattatttgtttatttatgtagaatttacaaataataaaaaagtgcgtagtatagtaggttatttttattgttcttatattaataatcaagtaattcttgctgaagaaatgtacgataaaaattataaattatttactaattctgtgagttatttagtttaatacacaatacgggattttaatgattttaaataatttaaatttattgatttgttcatttattatattttttctttttattattagtgttgttggtttttattatattaatggtaaaaagatcaattgtgtttatttgtttgcaataatacctttgatttcaattttaatactatggtgtttactcattatacaaatatcagtcaaaaattagcaccaaagcttaaaaaatgtttaaaacgaataaataatataaaatcgtaaaataaacttgttttaaataagcttaaaatcagttatttaagattattatataatagaggtaaaatgattaaaaatcaaaaatacaagaaatttttgaaaaagttttgaaggaaaaagaaaatgaatatacggatgaaaaattagaagaaataagaaaagaaagagaatatgttgaatctattataaacgagggtattgaaaaatcagaaaatattaagatagaaatattaagtgaaactaatttttagaagaaaataaaaaattagatttagacattaaaatattttttcttgtataaaaaccaaattcataagcaatgatgtataattttaatcttattttaagattattattatataataacagaaataaaaaaggagataaaatgattaaaaacacaaaaatacaagaaataaaagattttaacaatgatttaatatctaaaatgttaaaaaataatccacattttgacttaaaagtagactatagaactcaatttgtagtttttaaagacaactcgataatagaaagtgcttattatcctactaaaatagctacttgtgaatatggtgtaattgaagtagatgaagatgcttcagatggcatctcaatatctcacaataaaatagaattttttagaaatggtgtacctaatggtttggcaatagaacttattgaggataatgaaaccagaatcaaaattagatttgatttgcgagatcgtaatattttctatgaaaactattacgcttgggattgttttggaaaaagagctttcacttttagaaatgatttaaatcgttttaatgatcgttttatgactaagattaaacttaagaattttttaacaaaaaactttgatttatttaaagattttatcaaaagttctaatgaatatttagattttattaataaaagtttataattaattatagtcaaaggagcttaaaatggaaataattaaatctgcaacttcaggtttcattaaatacacaataacgttatttttattaggatttttttcaggtatagcttttacattttttatgactaaatggtatttcgaagatcgtggatcaactataggttatgaaattcaaagagccaatatgataaaaaattgtataaaagaagttgacgtttccttagaaataatgaaagaagaaaactcggttatagatgcaacacaaccattaaattaatattaaattaattttaaactaaatataggatttaagatgattattgaaataaaagattttccattaaatgttaagagagtagttttagaatttgatgattctggtgcttgtacgatagaaccagaaacaaaagttaaaaaatctaagatttctaaacctattaaagaagttgaaaatgattcagctgatatgactgaaactgaacctgttttagatattaattttggttctaaaccagtaaaagcatcaaacacagaacctattgataaagttgtaatcccggatatagaaagagaagctaacgtttcagctacaatgcaaaacttgaaactataaagtgttatgtgttaacactatagtgtaaaacttagaagcttaagaatctcttaagcttccgtaattgcaaacttatataacatcggagtagttgcagaatgtaaagggtgtattgtatatgcatttcttgtaaatatacctacagttctttcacctgatttataattataagcagttgttaagttcatacaatatgggctataaatcaacgaattaacacccttttctttatgagattttaaacccacataagcattattatcatcaggatttggatttaaataatatcttgtattattaatcttacctaagaaataatcattcgctctattttcatctgttgagtcatctattcttgaataagtaaaacttaatgataatataccacctacaccagtttgtggaagtatacaaaaactatcgtatgttctaaaattaggtgaattcattttaataactaaatcatttacctttttagatatatgaaataagtttgtttcggcattttgtttagaatcgttgttatcatctaacgtaataccttctgattcaactgcattttctttaataagatttataattttttcagtttctttgtgtgctgcagaagacttgacccagttaatgaataattctggtgtttgttcatttccggctttattaagattacttaaatttaataaatcttcccaagcttcctgtgatattttgataatagatttattagtatcaacatcaatttgttttttaataattttaaatgtatcttgagtttcttgtcttgcgaaaacatatccagatggttgcatcataggttgaacttcagcaatgtgatgacctataaacgatttgattttatcttttaagatatcacctaacataacttggtaaaaatctgcatctataccttcgctaattaagtttgtagtctccttaagagaattttctaataatagtttatacattttggcctctatgtatttttaagttatttattatcttaattaacttcgatatttagtatttagattatttaagaaacttttaagttattttatattataattatttcatcaaaagataaaggagattaaatgaaaaactttaaatcaaaattaggtgataatagatttacatttgacttagtttacacagttgtagccgtagtaatgatgatagcatacccagcttattttatttggggttaaaatgaacttcgtaaccaaagattatatgttaactgcagaaatagcggataaattaaatataagtatgactaatatttcaaaatggtatgtaaaatttccagagtctgttactaataaacatttagtaagaataggtaattgtgtgtttgttcacagagactttcctaatttaactaagaatatgaaaattatttttaatgaacccagaatagattggagtaataaattaccattgaattatatgattaaaaattttaaaattaatgttgcttattgtgaaaaatataatataggtcataaaacaagttatatttttaaaacacatagaaatcgtgtaattcaaaaagatttttttgcatttgaccctagtattttaaaattattaaaagctactgaattagaatcaaggaaggttgctagcttaaattcaattcaagtttcaaagaattacttcatttgtttttgattatttaaaggagtaaaaatggattcaaaaagctttattaaaaaacaagttctaaaaatcttaaaagtaactaatatagaagaagaaattcttcataaaatgttcgtagatgaaggtgttgatgccgatttcttgatacaagttctgaaagatctacataaagaatctaaaattaaagttctaattaaatctgataattgcttgtttgaatgggattctcacaagccttatattaaaggtgtttattatataactagtaaaatgtaaacaaaggttctaaatgacaatatatagtttttcgaaaatagatacatataaaaaatgcccaaaacaatattattatagatatattgaaaaggttccagaaactcaaaagaacccagcattaaaaaaaggttctgatatacacgaaatacttgagtttcataacactgaaaaatacaatgaagttcttaattcaaaagatccagaaatacaaaatattacattaagatttattgattctgaattaggaaaagaaatactatccagaaaatctttaagagaatatgaattattcttagattctaattatgaaccttgtagcaaagatactgctatttttgtaggctatattgatagaattaatacgactgaaaatggattagagcttatagattataaaacaggtaaatataaagaaccatcttatcaagattttacacaattaattttatatagtttatatatatttaaaagacttaaactaaatgaaataaaaataagatatgtttatgttgaacatcttttagaaaatactttaagtttgtctcaagattctgcaatttattggcaagataatcttaataatcaaataaaatctattgaaaattctattgaatctaatacttggaatagcaaaccaaataaattatgtccttggtgtccttatgcaggattatgtccagattttaaaggtaaacctaaatgttaaaaaataattttaaaaaattaaacgaatcatttagtttaatatctttaactgatgaccaaaaagctaaattaatatttaagaaagatattcgttataatatatgggctcaaatgaatccaaaattagcttatgaatacttctataaagatttcaacaaccaacaaattgtaccaaacggtgttttagaatacctgggtataacaactaaaccagaaattaatgaaaaattagattcgcaattggaaataattataaaacatttagaaccatttccagtttatgattatcaaaaacaagctataaaagatgctatgcaatttcataagttattcattagagcagccacaggtgctggtaaaagcgtcattattggattaattgctaagattctaatattaaaaaaattaaaaggtttgatactcgttcccaacatttcactaacaaatcaatttaataatgatttaataaattataaattggatatagaaacaagattaataggtggtgaaaataatattaaatcttttgataaaccattaacaattagtacttggcaatctgttaaaaactttaaagaagccttaaatgatttagattttattattgtagatgaagtacatacagccaaagcagatcaaatatttgatatttgtaataagtgtattaatgctaagtataagataggtttgacagggactattccagataatgaaatagatgctatgagattaataagtatttttggtttaccaagaacatatattacacccagaggtttaatagatagaggtctggctacaaatgctattattaatataatagatcttaaatataaatttaattttgaaggtgaatattcaagccaattgaaacaattaaaagaatacgatccaagaaataatttaattcaaagaataggcgatactgtagtcagcaaaggtaacactttagtattattttctcatactgaacacggtctaactttattttataagttcttgaaatccagaggattaaactacgataaaaagacttataaagatttggcgtttcaacaaagaaataatgtattttttattaacggaatgatagaaggttcacaaagggaaactattagacaattaatagattcagtaaacaatgctatcgtagttgctaattatgcgacaacttcaaccggagtaaatattaagaatttacataatttagtgcttgctagtccactcaaaagttatgtcacaataactcaaagtattggtagattattaagacttcacgattctaaagatattgttaatatatatgatattgctgatcacaatggtttttttaagaaacaaataaatgctagaataacaaaatcttatgaacctgaaggttatgaaataaaaagatttacttacaatatataaccaactaaactattataaaatattatattttaattttaaactaaagttctaaaatttcagcaagaattaagttcaaatatattataattctacatagctgtttaaaaggggattgatagtcacggtgacggtaaatacaataagggtattgtagacctaagagcttcctagtagctcaaaccttttttacggcttagattaattttaaacttagatctaaacttgctgctatagtgttaaatatgtactttaggtttaaacttagaattaattttaaaaggagatacaatgttaatacaagttaacgaaaatacaactgttaaattatcagcagtttgtaatattaatgttttgaaagacaaacaagttttcaatatgtgttatactttcacagataaaaaaggagcaatgagtggttattattatgtagataatagtaatataaactatcaaaattctaaatacttcaaagaaaaattcatagcagttcgtggtattgatagattaatatatattaacacagattttgtaagctttattaaaaaagattacgcaaattacccaaaagtggtaattggttttagtcatagtgtattaagacacaatgtcgaatcttttgcatttgcacccgaatatatgtatattagaaccaaacctgaagatttagattctacttatgaacaaatcttagaagctattacaaatatttcaaaataaggaggtaaaaatgagagatgaatttgatgatttgttagcaagcttgtcaatagaacctgttaagaaacctgaaatagaatatcaagaaccattagttgttaaacctgcaagcaacatagaagttaatggagtaaacgagcaaaacgcagatttaaatgattttggtgatgttcttaacagcatcgaatcaggtgttagtaataccagcaataataacgaaaatatggtagctagctcagattcagaagcttttaaggaatatatagatctcagaaatattaaaaatgaatcagatattgaagttcctgatttagtggatacaatgcatttagaagaagcgccaagtttaataccagaagcacctagtgaacatacaaatcaaacacaagaatcaaaaacaagtggttacgaagtcccagatatcaagggaactatcaaaagggtaccagatgttgacgattctgaaaataatgtttataaattagaaactgaatatattgatattatattaagttatgaagaagaattaaaagatcttaaacgtcgttttaaacttaatacattagaatatcaagcaaaaggtgttcagactaggttagttattaaagcagttaaacaagcagccaaagacgctaaaaaagaaggttatattattaaagatgaaaatagaatccaagaaagaattaataatgattctaatttattaggaagaatttgttcaattattaattcatcaatctaaaagtttaataatattttaagatattttaagatattttaagatattttatattataatacactaaagtttaaaaggagatatatggttcacaaaagtgttcaagattattttctaaatgaattaactaattattcttgttatagtactttaagaatgatagctagttctattgatggtttaaaaaattcaagcagaaaaatcattaacacagcattagacaaaaaattaaatacagaaactaaagttagtatatttgataatatggttcaaagttatacacaatacttgcacggttcgtgttcaggtgttattcaaaatatggctgcaagctatactggttctaataatattccattgcttgaaggtaaaggtaattttggttcgaggtttattaatgagccagcagcaccaagatatgtttatgttaaaaataaaaaatatattaatgatttatttgatattaaagatgtcttgatttctcagaattttgaaggttcagaaatagaaccagtattttacgttccaagtttgcctatactagttttaaatggttcaatgaatggtcttgctagtggttttaaacagaatattttaccaagatctttggattcagtaataaaatatattaagacaggtaataaagttgatttaaagccgtatattgcaggttttaaaggggctgttgaattagtagaagataccagttctaataatacacaatggaactttataggtgttgtcgaagtcaataaaaataaagcaattataacagaaataccaccatttatcgagtatacaaaatatctcgaaatattagataatcttgtagagactaaaaagattaaaaattataaagacttgtcagaccaaagaaaccaagaatttaaattcgaagttatatttttcgataatatctctaaagagaaagctatcgatatattaaaattatctaaaagagaaacagaaatatataatgctttggatgaaaataatcaagtcagaacttttgaaaatattgaatctataattgattattacatagacgttagaaaaagatttttggttaaacaaaaagattttgatttaaaagttcttgaaaatgatttaaatattaatattcaaaaattaagatttgttaaattaatcattgattcagagttacaaattatgaaaagatctaaaaaggatattgaattggatcttgaaagtaaagagtttattaagtttgagaatagttatgattatttgcttaagttaccaatacattcgtttacaaacgaaacttttgaaaaattagtacaaaatgctaaagaaatcaaagctaaatttgaaacattaaaaaatctggatacatttaaaaattatgtcgaatctttagattctattaagaacatattaactaaagcttaagaggagttaaaatgagatacgaagctataaacaataaaacaaaaattgaggattctgaattggatattatatctacaaaagatacgaggcattcattatacaaaaaaagttttaattatactaattatactttaaatatcaattcatttgatcacgaagaaggtgaattagaaaatatttttgctgatcttaatgacgctaatgaaggtgattctatacaaatctttatagccagtgtgggtggttttgctaatgaacttaatagatttacaaatataattagaacaaagttctatggtaatgtaacaacagtattaaacccatttggatattcttgtggtgctatgatgttcttaattggtaattcacgtgtaatttatgagaactcaagtattatgttccattcagtaagttttggagtttctggtaaacattcggatgttaaaacgcaatttgatttttctaataagtattggaatgaatatatgaagtcattattaaatccatatcttaccaagaaagaaattgaattattaatagatggtgttgagttttggttcgatgcttatgaaatgtgtaaacgtggtattgctactcatattaatgtttttggtttaagtatgaaagcagatgcttattgtgagtacatagataatttagattatagaatagagtttcttgaatatattattaaagaaggtgaccttgattctattgatttacaaagggctgaaattgagttagaacaagctaaaaaagatgctaagaaagccagcactactaaaactactaaaactactaaaaccactactaataatgaaattgagtctaaagatcttagctaagatctttaggctttaagaatctttttagttcagctatattataatcatatataacacctaaggtaataaaatatgaaaataacaatctttggaactgcaagtaaaaatgaaaagtttgctaagtcgccatacgatgacaattcttttatttttgaaacaattgaagtccaaacgacttaccaagcatttcaactacttgttaataatttttgtttaaatattgccttagacttaaaaggacctggcaaatccagaagattaaaaacagatttagaacctcatataattaaaacatttgatcatttattatttgattttgaatgcaaatcagagtttaataaaaatatggcattagactattttaagagcacacaatgcactatcggtcaatccagatcttatgatggtgttaataattttaatttaaaaggtattattaaaacagctccaatgagcttaaaagaactaaaagttttgcaagctaaaattcaaaaagaactttctgagtatggtaaatatactactgatacattaagaataacttattatacagcgcctttgaataaagataatatactcttggataacccaaacggttctatgttaatgcctataggtacgaatgttacagattactataataacatagatttagattgtaaatttaatattacctctaaagaaactactgaaatatgcaaaacaatttttaagaacctgggttttatcttagtagatatcaatgctaatggttctataaaatacacaaaagattctgaaaattatatttggtacccaaataatccatatattatgaatcatactgaaagttatatgtcagtaaatatttggaaagaagctataaaatatgaacctacttttgatataactccttatatagattataaagcagatattgtagttgatagaaactttacagaaattaagtctgaattagattcaattgtagaagcttttttgtttaagcataatggtgctctgactttgagagctcctatgggttcgggtaaaacaacttttatagatagaattatagaagcagcactagagagagattttaaggttgcaattataactaatagagttacgttagcagaagattacaaaagaaaatataagaagtttttatattataaagattatactgatgctattaaagccaaggattctaagaattctaacaacataagtggtgaagaagctatcagacttattgaaagttatagtaatgttgacaacgttagtaatttaaataatgctaatactagttttgtcacaaaaaccaaaaaaccaaaaatagttagatcaaaaggtaaatccttaatttgtcaatacgacagttttagacattttgatttagatgactacgacctaattatactcgatgagtttatgagtttattaatgcatacaagatctgcattgaatagtaaaacagagaacttaataaaattctatactgctttaaataaaaaagttgttgtagctgatgcatttttaagtaaatacattgtggacaatatgtttactaaacctttaaatgttgttagctatacaaaaaataatacagaactttatagttgcaatgacagcaataccttttatacattaattaaaaatgctttagattctaataaaaaaataactatttctacaactagtataaaagttgttgatattattaaacaaatgtgttatatactaaataaaaaaataattatttttaataaagaaaccggctcagtatcaaaaaatattatatatgataaaattaggtctaaagaagcgctagattgtgatgtctttatttacactccagtgttaactgtaggagttaacattctgaatgatgttgatatacattttcattatgatagtgcaagttctacagacgttattagttctttacaaatgttaggcagagcaagattttccaaaaagataatttactatgttatgaacaaaaaatataatgcttgtattaattatgatttattaaaaactactgtagaaaaaaagcctaaggagcatactgatgattctaaagacagagatgttgaatataagaggggaactgttaaaaatcttttatatcattttcacgtaccacctggcaaagattatcaagaattaagccatattggtaaagcttgtctaaaagtagacgtttttaacaatatgactttatgtgactataaaaaatcttttgatgttttattaagttttaatttcagtaagatacctattgaattaagaaaaataggtggtgatattttgaaattaatgaatattaaaatacaggattcgaaagattccgagctttagtttaagtttaaaattagtccaaatatattataattaaaaaatcaaataaaggagttgaaatgcaattaatagatggctattacacagattctaataacaataaatgggattcttctatgtatactgaagaacaagcgaaagaagcttctgagtctttagtagtttgtaaagattgtttaaattgtttcaattgtattgattgttataaatgtattgattgtattgattgttataaatgccgcgtttctaaagattgtattgattgtaaatcttgtattgattgtattgattgttataaatgccaaggttgctttaaatgccataaatgcgtttattgtttggattgtcacgaatgtgtggattgcaagaggtgtcgagcttctatagattgtttgaattgcattgagtgtgcgaatacttcgaatgaatcacatactcgaaaatcacatacagtattaaaaatatataaaatcttaaatgcataaaatcacagattcataaataaactaaaaggtgataatgatttatattacaagtgatttacatatatctcatcaaaatattataaaatatactggtaggtatattgatgatgctttagaatattcaaaagaagttcataagtattttaaatctgttttaaaagattctgatattttaatgtttttaggagatttagattgtggtcctaataaaaatatagaattcttaagacactttattagttcattaccaagcaaaaaaatttttgtaagaggtaaccacgacaagtggttagatactgaaagtattttatatattggatttagtgcagtttctgatatcattagatataaagatactttgttttgtcattatccgttagattcaaaatcagtaatacctaaagaagctccagagtttttaaaatcatatgatttaactggtattaaaaaaatatatcacggccatactcacaataattggatagtggattctaaagatggtattgaaagaattaattgttgtatagacagaaatccagaagttattggtgctttgataccattcgagcctaagacttaaaagcttaaaataaaaggatattaaatgaataaagtttctgaagttaaaaaagttacaagagttttccaaggaaaatctgtgtatgattgtttagttcgttggaatgctgctaataaatttgtgccttgtacagttgatattcaaaatccaggtgacctgaagccattagcagattacttacttaaacataatcttatctctggtctttaataaaagaccttaccaaggttcgtgatgcatagtgatgttatccaaactctaagttcagcaggcgcttacttacctaatgacactatatgtcctagagcaaaactagacactggcacatactgcaactatcgttgttatttttgctattaccaaaatgagttagataaaaagacaccatttgaagtcattaaaaaaagaatagatactttgtatagtataggttgtagagattttgatttaagtggaggcgaatcttccatacacccagatttctttaaaatcctagaatatattaaatctttgaatccagataataaaatatcttgtttgacaaatggatctaaatttcagaataaagattttcttaaaaaagcaaaagatcttgggttatctgaaatattattttcattacatagtgttaatgaaactcacgataaaataactgggataaaaaattcttataattatataattaaagctattcataatgcaaaggatcttgatattgttgttagattaaattcaactattactgatgtaaattataaattagttgatactgaatatttcgaagttgttgaaaaattagaaccacttgaaatgaattttctaccattgaattattttagtcagaattcaaaatcaaaaggtgttaattattctgagattttagaacctataaaaagatttgtagattcatcaagtatacctttgatcaatgtccgatatgtcccgttttgttatatgactgggtatgagaaatacgttgtaggatattatcagcacatctatgatatttacgattggaatattgctatgtatgaatacttagaacctaatttagtaaatttagcaaaacaagctgcatctaatagacaaaaaagttataggaaatgtgatgcttgtagaacttgtaagtatttttatatctgtgatggtattgagcctcaagttcttaaagcaggttgtgaatttaaacctattcaaggttctaaaataaaagatgttaatacatttagaaaatcattctttaatttttagtttatagtttttgaccttaaactttagattttaaactatagttttattttttttaacattttaaaaggagtgtaatggatatttcattaattataggacctatgagatctgggaaatcacttgaattgttaagacaagcagagaaacttcattttagtgacaaaccttatgttttatatagacccaaaactgacacaagggattttatatcaagaagttttagacctagtttagacttaaatatacaatactatagcaatgaaaacttcagtgaatctaaatatgattatatattattagatgaatttcaattttttgaacctgaaattattaataatatattagaatctaataaaacatttgttttatgtgctttacaaagtggtactaataatatcaatgaaccttataatgtagaagtctttagaaatgtcaatagaattatgccattttgtagtgatattagattgttaactagtatatgtgaaaattgtggcagttcttgtgctacacacagttataccgatgttatcactgtttctgataattataagattctttgtaataattgtttagattttaagatttcaaatgctggtatttttaagagattaaaaacttgaagcattttttatactttttaatattgctttaagttttaagcatttgctaggatatatagcattgttatatactgctaaaaagccaagcattttttatactttttaatattgctttaagttttagatataatactatagtatatactgctaaaaagccaagcattttttatactttttaatattagtttaagatttaagcatatgctaggatatatagcattgctatatactactaaaaagccaagcattttttatactttttaatattagtttaagatttaattatgatagctgtattagtatataaataaactaaaagaggaactatgcaaaaatatgtagctattgctttcattattgttgctatgctaggatatataggatggcttaaatatgataatgctcaattacaaacaactatttcgagcttagaagccaaaaacaaaggtttagaaacttctctaaatatccaggttaatttaaataaaatacaagaccaaaagaatcgagaacttgttaacaacattaaagaacttgaaaataaacctattaaaactgaaacaaaatatgtaacagtcaaggattgtaaagttcaaatatctaaagtagacaccaatattacctcagctaaaggtatacctttatttttaggaaatataggtaaaactcaaatatctaaccaaaaataaggaatctttatgaagtttaaaaagtttttattggccttaataccttttatttttataggctgtaccactgttagaactgagtttgtatacccaaaaataccggatattaaagaaccgcctataacacaagattataatctaactgtaataaaaataaataacatagaatattattcgttgagtgctgaagatgctaagattttgtcagagaactggatcaagtttaaatcctgggctgagacgaattatgaattattaaaaataattaaaaataaggacttaaaatgagtttcaaagacacattattaaacctagtttatgagaattctagctgtgaagtgctggattataaagaccctgaaatcaaagaaactgattctggtgatatagatacaacacctaccactaaagcagatattgttaaacgcaaagattctaaaatcgatgaagatgattctggcgatgattcagagcttgaaccactatcaaaggaagaattcgacgatataattaattctttagatccagatacgattgcattaattataagtattcttaacgataatggatatatagttgcttccaaagaagaaattttatcagcagaagattttgaagatattggctatcttgttttagaagttctcgaagaaatttctgagtatgaagctaacaattatgaacaatatggtgcaactccagtagatgaatcatttgatgatgctgaagttcttaaagaagctgctatgattttagaagctaatgatttaagtgatttaagtgaacaattagtagatattgcacatactaaacaattaagacgtgatagaaaaagatcagcttggaaaagatcagcagttttaagagcaagatttagaaaaactggtgaaggtagaagagaacgcaaaaaagcgcttaaataccttaaaaaatatagaagacaacataaagctcgtatgaagagatattcacaaaaatatacacaagtttggaaaggtaatactaaaaactaatgatattttgtgaagatttagaaccaatatatgaggtggtaaaaaagctacctctttataaacagagagctaaggaagaagtgtttttaggtattttaaaatcaaaatctaagaaatgggtcggatggaaatacctaaaagaacttaaaaaagataaaagctttgacgacagcgctatttttattgagctttatgagcttgcattaaattactactggattaaatctcaaaacgactctatcaaatacgataacttaataaaaaactataaattttaaatttattaatattctaatttaatattaaagagtttgaaattttttaaaaaattttaccctttaatatgatattataatataaaaaacttttttaaaaatttttagtagttttattggtacttaaaaaatgcttggctttttagtagtatataacaatgctatatatcctagtacatgcttaaatcttaaactaatattaaaaagaataaaaaatgcttggatttttagtagtatatactatagtataatatctaaagcttaaagcaatattaaaaagaataaaaaatgcttggctttttagtagtatataacaatgctatatatcctagcatat

SEQ ID NO: 16 - DNA, 29568 bp, Camplyobacter Phage CJLB-15
tttagtaggtatatactatagtattatatcctggtatatgcttaaaacttaaagcaatattaaaaagtataaaaaatgcttaagtttttagtaggtatatactatagtataagtctaaaacttaaagcaatattaaaaagtataaaaaatgcttaagtttttagtaggtatatactatagtataagtctaaaacttaaagcaatattaaaaagtataaaaaatgcttggctttttaatagtatatactatagtattatatcctagtatatgcttaaaacttaaagcaaagcttaaactaatattaaaaagtataaaaaatgctaaggtttttagtagtatatactatagtattatatcccagcatatgcttaaaacttaaagcaaagcttaaactaatattaaaaagtataaaaaatgcttggcttattaaattatttgtacttaaaaagtcttaagaagtcacccaaataagcagggtctaaagcttttataatcatattttgataattcttttgtgtcaataaatctatcaaatattccctgtattcggttattaattgttcagtaacattaccttggtatggtttctcaggattattaaaataattggctatcaattcgtcagccatatctgctattctatcattatcataaggcatatcactcaaggcatctttattattaataagcattaataaatcccataaattaggatcattatacaatctattagaaacactttcaatgaaatcatttgcatttattttaacattaatagtattagaatcattaatatattttgttatagtgctataatccatagacctgtaatctctaacattacaaacttctgcttcggttttattagcttcactgaacgaataattatctaaataatttgtaagttgcttactaatatacattctaactcctatagactagcattttcaaaattccaatcatcctggtatttttgacggaattcttttaatgataatgtaaactctattttctttggaactccatctaatgtcacagcaatatcatcaccgttttcataaaccatagaaacaccatctattacacaaataccaggagctatcaacttatgtagcagtgggtttgaaaattggacacctattcttgcaggcggtatcaataagacaccaccagcttcttttttagggtatgaacttctttttaataaccaaaatattcgcatcatattagaagcttcatctatgtttctgggagatattttaaaagtaaattgaaatgttcttaagttagaacctttaaagttttgccattttaatggatctacttgtggtagttgcggagcaaatgccatattatctgtatttccaccaaaatctccaaatctaccataagcttcaattataccagaactagctgtacttgataattcattagcagcatttgacatagaacctaaaataccagtatcttcagaataattatgagagttttgttcttggaacgcattcattaatggtaaatgtattgtatataatatattgactgctgacatatctacaatgtcttgaccagcatcttttagagtttggctagcatctgaagaatcatacccatcaccagaaaatgctgaagttcctgctgtcatcaggcttgacattttttgaccaatagcatctttgacttttttatagaaatcatttgggtcataaacagtcaatattatttgtttgtgtttaaaattatcagattctaaagatttggtaaattttagaatttcagcaccattgttggccgagaaagttttcgtagcttttggtaaatcaacacctgaaataacactactgacagaaccaaataatcccaaaatttaatcctttgcatttaatgaaccttagctcaaaacaaaagaatcagtcaaatctttattagaagtttcttttgttttagtctgtatattggtattatttatttgggttttattgacagctggtatcacatcttttgttttaacattactagcaactttggtttgtactgtattgtttaaccctgctgattgaattgcttgtcttttagacataccataagattgtaaaaagtcagattctgaaccttcattaagtatttcgtaatcgctgatgccatctaacccaaacattctagcaattttaaaactgtttttagaagcccaagaataatcacttggagatgaattattctttatattaactacaggagttactggtactactgagccagcattgttagtttgaacgttagatttcgaatctccaggtaaagaaattggtgatttggatttactaaagttatctcctaagttgttgaagtcttccattgtttctgcatcatattgacctctgtgtggtgtaccatagctagcagctttaggaactgcttttggagctgacgctactggttttgaagctggcttaatatctgcttttgtttcttttggtgttgaatttgcagctgggctagcagcttgtggggctgaacttgacccaaaactagtacttaatccagattctgtatacatttgagttaaagattttctggttgtaatagaattagcattagcaaaagattggatactacttacaccagaacttataacactagctgcagcgcctgctgtatttgtaacaacatttgaaactccagaatccaaactataaacagcacctttagcacctccaccccctaatgcaactttaaaagaactattcatattggataattgttgatttgcaagttcttgagatggattttgacctgaagtatctcttagaatagttatattagcatccggcccaccgaaagcatttacgtctctataaattgaaactgagttttgtttaaaatctgaaacccaattagaaccattccaaatagcaatatgcccatatttgtgatttccaaatctctgggttattgaaatgtcacctacttctgggcttatttgtgaagctctaccttgaactggtgtaaaaccatatttaggtaagaaatttatataatctgcagctgctactggccaaccagataatggatatcctgctgccatcaaataagatctaacatacttggcgcaagcgcctgttgctctagttcctaagttatattttttactgaattctgctgcagctcttgctcctggagatcctcctgaactcgagccttgggcttctgtggattgagctccttgaacttgcgccggagagattgaaccagaagcttgcgaagctacactagcactagcatttgtagaatctggttttgtatcagttccccctgaactagtacttgaatctccattagttctaaataccgataaatctgcattagctccttggctttgcaattttttaattcttgcttgtccaatagcttgatatttagaatcgatagaatctaagctcattttagataattcatcagataatttatttctttgtgtaactaatttattaaaggtttcagtatctccagaattcatagctttttgaccttgttcaaaaagcgcatctaattgtgcttctttttcttcacgtttcttaaaataagcttgcttttcagcatcatatttttcagattctacccaggtcaaacctttatatatagaacctgttttagcagctataacggttccgttagaatccactttatgtggtgtatacgaagcagcaaaatcgttagcagatttaccatcaagtactttagcatttaatcctttattacttgaacttgaattagaacttgaatcttgaactccagattgtgctttatctttttctacttgacttggttctaaaatacctccagtatcattattttgaaccattttatttgctgtatttactaaatcattttgttctttattaagattatctacatcatctggacttgttataatatcagtagcaaataaacctaagtctaaacacatagatatgatcccaccaatacctggtaataatgaaatacaagcactaagtgctgctattgaacccaatacccatctaccacgagtaaagaaatcccaagcttggtatatacctacagcaaacccaacacctggtaaagcttttgaagctattttagcaccactagcagctaatcttgctcctattttttcaagatttccaagtatactaggtagaactgaaaataacttagaacttccaaatagtttcttacctactgaactaacaaatttctccataggagctaaagcaaactttttaagcatattaaagcctttttgtgctgctttaactgctgaatcccaagcagagcttaccatatttttaacagcatcaaatccttcaatagctttttctacaatatatttttgtgctgcttttaatttatcatatcctgcagatataattttacctactttagaatttttaatatcttgatatttcttactagcatatgattttaaatcatctactttttgtgaagcccaatcatatccattttgcatagcacctttaaaagaatcccatttcttagacatccaagattgttctttagctggattagatgaacttacttttggtgattttggattttttggattatcattatctgagattttccatttatcaccaatattaatttttttattaataaaatctactaatgagttccatttattttttaagaattcaaatccattttttaaagggtctataatagggcctaataatggctcaaataaagtccataatttattaataccaccttttaatagatctaaaatgaaatctaaaggctttgttaaaaaacttcctaatgatcccaataatggtaataaagcacctgccgatatacctaataaacctcctaaccaacctaaaagtttatcaaaaaaacttttattctgaggtacatttactttagattctgaaacattttgaacgtttttatcaaaaccttggtgtcttatttctgtatcttgattatctattaatccttttttaatatccgagatttgttttgaaatatttttaagagattctgaaatttctgttaattttctagcattcataggatctaaagctttggctgcactaacaacttcattggctacattgtttaattcactaacaattgaatcattatttttttgagttgtcttagatactttagaatccgaatccatccagttattgagtctttgagtagcacttctaactgtattcataggatctaaagcagaatttactttgtttataccactaacagcactattataagcagaattaacactattaactgcatttttgcctgctctataagtacctctaatacccctagcagttgattttattatactcaaaataaatcctactttttgtatatttatttttggattctggtatatgtcagtatagttctaaaatagaacactatagtgtcaatttagaactattttagaattctaagaagcttgaatatatttcatcaaagctattctatatttacctatgaatttaaacatataacataaaccaggttggcaactataatcagtccatctttctgcgtaggtttctttattagaaataccaaattttgtagaattacattttaaacaataatgtgtaaaacattcttggcaagctttgggcatattttcatttaatatttttctatgatcttgtgagctcttaatcaatgtttcagtaaattttacattctcaaaattaatatcatttaaaacattatttggtttatattcttcactaaaaacaccgtgacaagcatacattttaccatccaattcaataccagaatagccatcacctgctgtacaaatacttctatttggattcatccaaccaaaattaaaatatccttttcttttaaagaactcaacttcagcatcacgtatttttaagaattcttcttttaaagtatttgtcaatgcttctaattgttcttttgtaaaatcatatttagacatatagtctatcgtagggttataattaagttcaatacctaagacatcggacattcttttaaattcgaaataattaatagcaatcttatcgaaattcttagctgcaatcgtaggatgtacaataaaaggtatatttctttttgctagttcaaaaacagtttctttaacttgttgtgctgagcccttaccttgtaaattaagtctatctgaatcgtgacttgccattccatcataagatatttgagtcaagaattttggttctgacccgacatttggcatatacttaaatgtttctaagtaatcaaaaacgtggttgtatttataaccatttgaatacataaagaaacaaacttttgggttgtgtctatagtattctacaaactctttaacaccttctaggttagttgtgggttccccaccccagaatgaaattctaataccatcataatgtttattgaattctactgaattcaatagaaaatcaaacttttctatcatttttttagtaagttctggtgataatttttcaaatttttgtttattaaaatcttgaatacagtatgtacatcttagtgtacacgcttgagtcatattaatatcaaaattataaagttttttaggtccttgagattttggtaaatattccataattctcctttagatatattatatagtatttatgattaaatgcaatttaaatattttagtatttttagattctaacacgcattgtcatatcaacaccaaaatttaaaagcatttttcttatatatttccataaaaatgtcaaaatggatcatagcagtttggtcatcaccatcatatgaatatttaaatactaagtctaactcatttaagagtctatttaaagtatctaattctttttccataccttcataagctgccccaccacaatcatcaagccaatattctcttttgattttaagcattttataaatcaattttaaatcaaatattggctcataaggtctccaaattattaattcatttctgaatttaatgatattttttataaatctataaacttttgaatttctgattatttttggtactagcatattaattactcactttcttagatttaaaacttctgggttaatatcccaaggaaaaattaaccaaacatcattcaagatgatattgatagtctcagttttaaatggactattatatctttcaaataatgttttaaatgttatgagaccattgaaaactttttggattttaaatattgttttacttgtatcgttaatatcatctaaaaataaaacttttttataattttgaatattgattacatcagaattattaattacataaacaggtaatttaacaccctgggtgtattgcaacatactagttattattaatccacctctattgggagttattatacaatcaaaatttttaagatctacttcatttgtgagattatgcaaagcttggtgaacatcattccaagttagtttaattgtgttcattttatacctttaaaacttatgagaaatatatactgcaaaaacactcaaaatcgcacttatcccgccgtaaactgcaatataatatataaatgaattcatttaagaaaaaccttttaaagattgatttaagacttgattttaatattatataatttatagctttaaaaaaaccttaatatctcgcaatttgttatattttaacatagattttttaacttgatctaagacgttgtctaaattaagtttatttctacataatttaaataaacaatctttggctataggatctatattcaaatcttttatatataaagctggagcttcaagatctttagctttaatataattagaatctatagaatctaatatttcatttaacttaacttttactgaattagatacagaatcaacataagccacagcttctggcgataattttggtaacacatcatctatagtttcttctaatatcattttgtatatcacttttaaatctaaattagttacagtattatgtaagtctaaatattcttgtgtttttaacttgtagacttttttagttactttatgctgcaatataacaccttcgtaattagatatggtgtttatataatctttaagatcttttagagtcctaatatttaaatctttaaaattaaactcgttagtttcgtgaattttaaattctaatgttctaagatctaattcagctattaattttaattcagttttattataatctactactattctatttaaaggtgaaatcaactcgaaaaagtactgggtacctggattattttttattagatctaatatatctggattatttttgatatacttattagctaatttagtttgatcgttgtcaatagacattttagttctaaattttataccatcatattcataaggtatcattaaagaaccatcgtattttgtcactatagtgaaatcttcaagatttgtagaatctggtaatatccaatcttcattttcattaatattaaagaattttggtattggtatcgatataccaggtgctaaagtatctttgtttaatatagatttagaatctatcattaaacctcttatgaaaaaagtattattttctttgaagtttttataatctgacaatatataagtatagaatttaaaatcgtttaattttgttgacctataattagaatcttttaaattctccgccatatttttaagttctaaataattcattatatctcctttatatacagctttgataaaataattataatatattttgacttaaaaagatataaacttcatataaaacttataaaaaattataaaattccgtataagattttataaaaagtttcctgaaaactctagatgaatctatatcatctagagaaactctatatctcaatttagaattttttacaaaagaatacatctccataaaactattaaaagactctttaataccgatttcttccaatgatagataataaagatttttatctttttcatagtttccaaagatgatattcttctccatctttttatcttttaagatatattgatggtagaattcataactccttcttccaatttctatacttgctagaacataatcaggaagctgatgaactctatatacaagatttccaataaatgaactatattgaggttgaacctctagagttctaatcttgtatagacaattcattttctttatttgtgaaactaaaagacttctacaccactgattattacagagtttgttgaacttagttcctttttctttatctccttgcttcatattaaggtattctaagctaaaaatctcacacccaaaatgatttgctaacttagatagctgatggactatttgtatgatttcgtgatttcttttatttgaaatgtattttctttctttactttgaccagaatacccttgtccttttaaagaatcatcataatcatttagagcttttaaagaaatagaacccgtttttatgattttataagatccatcgtttttccaatctactactgaatatccaatgtagttgggatttagatcaataccaaatactctgtctttaatcttatcttgtacttttaaattgtgtttgagtttattaagatcaaaactgatataaacatatttggtatctagcttgtaggttatcggtatagatttgtttatttgtaaagtaatcagctgattcaaataatctctatatctcttagaagttccatttaattttagagtgatatgttcttttcttgagactttaaaaattattgtattttcatcttctatttggaattttctatttccattcttagatgcttcacctacactatatagaggaagcagtctttttagttggtattcttctcttgaaatttttccttttaatctatcaaagaaattctttttaccaccaaatataactttttcatctttctttttcttgttcttaaaacttttaacatcaaaaacagctgagttaaaaaaccacttatcaagaaaaatattattcaatctagattgaagtcttgttgtttctgcttgttttaagtcaggaacttgctgataaaatgaatatgttgatctaaaaagagagttgtagtttttgatacaatcaagtattctttctgtatcagaagacttatagtctagcttgattgttataatattttgtatctcttcattataaatacttttagttttagacatatcaatcctatgtttaaaattagagaaataaagaaattggtagtttctttatttctcgttttattatatttaaatttcaaaactttcaatttttgaaaattctaaaataatttctatatttatttagtttaatatacttttaagtccagaatatataatatttgatataaaattatatctatttgtataattttatataaaaatgctttaatattttaaaatttaaactttagttttaaatctctgaccttaaatttttaaaaagcattgaagctctttttaagaacttcaagctgattatatgttaattgagttttaattgtattgtttgttttgaaattgagtatagtcagtgacatatttatattctctattagcagaacaagcaatttgtctatttgtgttgatatcacaaacacatctgtaaccgccttgacttccagttgacccatcaacataagccattgttctatttgtagcacattgtgcagctattgtgacgtttgtatcacaaacacaaactcttacagtagtacttgtttgtgaatttgaagtattgttgttgacaatattatcgatttgacctgtagattttttatcccaaattggtttacctgtaatatttttagtccattgtttatcaacgttacaagaacatacttgtgttacagtagcgtgttgtctaacagaattaatccagttagcattacatctacacgcgtaatcatatatttgaccgtattgattgtattgcggaacacttctatccccttggcaagaacactcagtcatatattggttttcataaactggtgtatacccaggaccttgagtttgacaagtaatattcgcattacaagtacaaacaacgccattccaataatcaacactatcggtgtattctttattattattacaagtacaataattacaatcacaagtacaataattacaatcacaagtacaataattacaattacaagtacaataattacaatcacaagtacaataattacaatcacaagtacaataattacaatcacataaacaagcaacttcagctttatttaataattgtttgaatttattgaatctagcagctgtaatcaaagcaccttttaatttctcagatattgtatcctcaatagtttgatcaattgtaaaatctaaatacccagaaactatacgtttttgaactgttttattagcgttttctgtattttgagaaactgtgaattttaatgtacttgctttaagtttaacgttattaaaccatttaattttcttagaactaaaatctgctataccaatttctacgtcagtaaaatcttcaagagctaatatttttgttaaagcatcataattaatattaacttctgatctaccttgatcataccaaagttgagactgattataagttaatcttacaccaccagaaatattagcaatcgcacttgctgtaaattctaatcttgcaaaataattaccgtgtgctaaaaataaagatttttgatttaatttaacttgattaaaatctgcttggactgcggttccaaaatttataattccatcacctacaaatgattctaaaacaacctgcatagcagtataaggtgtgcttaaaactacagaaccctgcaaaacaccattttgtggaacttgtgaaacattttgataatcggtattacctttatagaaattattgcgagtttgaacctccacattcatagctttgataaattcacgaattttagtaggttctattaattcaccagtttttgtattcacaaaattggtagcattatctgggcgtttggtgcctttacctataccatcttttagaacgacatttttaagaacacttctaaagtcattatctgtaaatctgcgttctagccacaatgctgctaattctttcattaaaattcctgagttttaaattatttatttttaatttaaagctataaaagttttaaaaataaagctaaagcttaaaatgtttaataactataagctaaagcttaaaaatgtttaataactaaagaaacatatcgcaatgcaacaagattatattatccttgatattgagttcttggtgtaattcaaaaagctgagctctcattaccctataattcctaggattgaatcctcagttaaaagaatataattttcttcaatatcttggccttttgtgatatcccattgaactgttttattaaccaaatcatattgacatttaggcccttgtttaattacaacacctttggttggtcgatcataaagatttgatttttgtatttttgtaatgatgccagattcagtttcaaatttaacgggttctgtttttattagaacaaaatcttgaagtggtttaaagttttcgatatcgatcataattcttccttgagaagaagcccatcagagcttctataagttactttaataagtcagccatcaaatcatcaagattatctgcttggttagcacttggcgctttagcttttggtgcttctgtttttggggttgctgccgatgatgtgccgtgtggtgctgttggtgcttccggttcagcaaaacttgttactggcgctgcttgaaccattgaatctaaattgttagattctactggtgtatccaaaccatctagcaattcttttaatgcttcgtaagatttgtagctttctggtttttgccaatctgacaatttataagcattatttttaatatctgctactgcttcttctacactattataaattgcacttggatttgcttcagcatcactttttgaatattctataaacccattggcacctttagttgcaatcaatttaaagttaaatccttttataggatcaaaaagatttttagcaacagcacctagtgctaattcttgttcatttggtgttaaaatagatttaattttctcaccaagtgtttgtgacatatcaagtaagaaaattttaccttcatttgctgggttttttggatctttaataactttaatattagcaatgtatcttgtagaccttgcatatcttcttgcttcatcttgtttgccagcattccaaagagacgcccacttttcttgaattgggtcaggtaaaccaattgtacttggactccactcagctataaatcttttagaagttttagatctaacattgtatttgaatactttcataatggtactcattgagccattttcgtgaacttcactaggtaagaatctaattaaagctgcaccattaccattttcatcttttgctagggtataaaaacgagtatcactttcataacttttagattcgaatgggttagctcccgcattcattgaattccaatcaaaattaatgtccataaatatcctttaaaaaaattaatcagttttaatctattatattaaaaccaattataaaaaattaaaaaacttaatttaatattgattccattatattataaactttaaattataaactaaagtttaaaacttagaatcaaattaaatcaccaaaatgtaaaacaatcaaataattacagacttgctatactaaaagaatgatttctaatataattctttcttttatcactctcttcagagcctaagaagtcattaattatattaatattatcgaaatcatagacatcgatcatattttctaatccatccttcttaataacaaaatctaataattctttttgccaagatcctaaacctttgaaatacttcgcattttcaccggatttaaccggtaactcttctgtgatgtcataagtccatttaataggagtttcgccttttaaaaccattttaacaggcgtgttaaaccgaccaaatctacctttgtattccggcctaaatctttctataaaccccatcaataaagcgcctatatgaataccatctaagtcagaatccgaagttacgagaacgtgctcaaacccaccttttacgatgcgttttctttgtgttattctttgagctttgtattgcttcaattgttcaggacttggttgtatttctttaattgaaatatccatttgatctcctttacaatgttattataatgtattaatccttaaaatattcttaaatttttagtgattttagcagttttagtatattcaataattaacactacagtgttatttttaataatttacactacagtgttaaatcttttaaatttaaatttttcacatattatataatattaaaacttaaaaatttttaaatctaaagaatatttaatccaatagattttcaacaccttgtacaatttcttgaccttcttggcctattacagtatcaactatttgtccaattacacctttatcttcaataggttcaaaatctgaatatgcaaaagttacactaaacatagataactgattttcattttcatcagaaacttctactgcacctacttcaataggaaaagcattagtcaaagcatacccatatagtttttctttgactttggttaattgccaaatgtttacggttgtttgataatttgctggtagtggcttgcccataatcatatttttaagccaagaaacaccaccatcaaactcccaagcagatttaatttcattaaccgctttcaaagttccattagctacctccattaagtcacccatagcaccaccaaataagcctgctaaagcattagtccctttaggtgtggtattatctacttctctcatccagctatcgaacattcttctaagtttcatttcagaatcatcagttatattaatagtgtaagtaccacttaagtctgtttcaccacgcattttatattttctacctttgtagaatatgtcagtggttccaatatttctttcaggtaatgctgtgctttggcaaagaactgctaattttttagaaacagcacctactacagcaacttctagtaagtaagcatttgatctaactcctaaaccaggacctaattgtttctttatatccgataatgaaaatgaaaaagtacccattctaaaccttaattatcatttgaatcattattagtatcgaaacccattgaatcgttgtagccaatggctatagatttcaactctgttttgagctcgagtttcatagaatcttttattttaaaagaatctttaaaaattatttcattattatgaaaatgtttaaaatatttagcttctctaccatcagagcttctaataatacattcacaatcaaagctaactttagatttatatttaataattcgttgtgttaaatctaatttttcaccgtttataaaccattcaaatgtatatttaatatttgatggattactgtcagtaaaatcacattctaagaatttttcatccctaattaaatcattaataattaaatcatatcttggttcatcagaatagaattctttttcaaagatatcactctcaacaatatcagtaaatgcttgaacttttacaatatcaccatctcgtggtgcataatgtaatttttcaatttcgctgtcttgtttgatgtcattgacccaccaattaaatttaaatttaataagtttctcacattcagaatctattttacagagtaaataatcttggttgaattctatatccttaataaccgctttgtattgatttataaaagtttggataccagattctgtttctttagaaccttcggaataaactctcgtgactactggattagcttcagtagattctggtaaatcagtactcataaacaattgaactaattctattaaatgttgttcttttattgctgggtatatattacctcttaaggttaaatcaaaagtgcaagttacaatattagtacttaattcatccatagattcttgatctacactagtcgagtttaattctaatatacaagaggtatctccaaaatctggtaaatctacttctttaattcttaaacaataactaggattaaaataactagcgacttgttctaatatcatactagcttcattcattccacgacattgtataattacttgataagtaaaatcataaggaactgaattgaattgataatttaattttttagtttcacctttaattatttgtgattttctatatatcttagcaaatttattttttgctctgttgatattagcattcataccagtaaacaaaagtatacctctgggtaaaacttgagtattaccattaaacatttgattataagataattgactataaatatcaaatctttccctgttagcatactgaataggaactatagaatacaatggtttaccattactttgaatagtttgtatttctaaattagaaaataaatgtatcaaagctccagtatattttcttagggtattaaaatgaaagaaagccattaagaatcctcggcttcaatactagcccatctaggttcttttaataaacatacaaaaaattcttgtgtaggctctctttttggttctatcattgtacaatcctataaatataaaattacaattatatttatcgaactttatttataattataaagacaatataaatatctctgttttctttaataaaatgaatcaaaaaataataatgatgtttccaaataatatcttttaaaaagtctttagttggcactatcattaatacagccttacatatctaatttatattgaacgcatatatataagaactatcgtttgtttctgaactattaacactaacttcaagttcattatctacagactcttctactttcataccgtcatcatttacataataccatatagcttttacatcagatacagaagtctgaccataatgtccgctacctacataagtaattttattagggactttttcagatattaatgttatttttaattgtttagtgctagcgtcagaccataatgaacactggtcagcatttccaagatactctttgaatatattagtaacacaatgatatgaagggtcgttatatattccagtagtagtaacatcacctttgatatcattaccactaggagataaagaacctacttcagaataactagctagattacctaaaccgtctaatgaccataatatctgaccattatttaatcctttaacaatttgttttgtagaagcatacccgttgtcaaatcctagttttacaccactcatacaaccgccatactgtccacttctaagtttaacgttacaagttatttctatttttctaagattaggtttaatctcttcactagttattatattaacccatttattagctccagcagtattgtctatacacatatacaactgtttattagttatatcagagtataatgaacctattttgttagggtttaatgaaaatgaaggttttccatttccagataaaatagatgagttattatctataatattttttaaattagatacagcctcttctataggaattaaagaaactccatctttaaaatctagtttaatattaataggtttatttgtattatcgtttttattttttatattaaacgaccttataagtgtatcatcagtgtatatttctattatacattctttagagtataataaaggattggtagcacttgttccatataattgtaattgtatattttctacttctttagagctttctaaagttacttgatagtaaggattttttaatccatcagaacttaaaaatacgcaatattttttattatactctctgaaaggattacaaatctcatatactccactataatcgtatgcaccatttgtttttactgtagctacagcattactaccactagataaatcaatacttgagatattaaatcctgaaggttttgtttctgtaatagcaatatcatctttatatacagtgtcatctcctgttaagtttaatcctactttttgattacttctgtcagtaacttcaactccaacaggtttaagaaactcagtatctcctttaagcttaactttaagattacttactacaactgtatctccagtggagtaactagagctatcagtttttgcatatattttaagtcttatatttttagtattcttaccttcaatatttgtaaaaggtattataggagtttcatttatgatatctttagttgtagtctttatacttccatcaagatattctttatttataatctgcttatcatctgtaattttattactatctatgtttaaataagctttgttattaaatctagttacaccatttatttcttgatgagcatcagatgttaatacttttaaaggttttaaagctttatctactatatcatatacagaaccactctcagttccgtccctacctattacttttctaccagttgaaactagaaagtctataatttttcctgtattttttcttaagtgtattactaacgaactagcccaatacgaaggtgctcctatttgtatagtatctgctttaacagagcttcctatctttagtagtgttattttaaatggacagttcatatctaggtttgaacccatataataatcataacataaatcagatacagaaccccaatattctaacatagctccatacccgtatttagcagaatattgcttagcagttgaaaatgatatttctaataatatctcattttctgctacttcataagattctaatgttgatacactatcagaataagttacatttgttttactattatcagaagtgagaactgcaataactttagttccactagttgtattaaaagcatttgaagatactttataagctttatatgtaatatctcttatagtatcttttatattaacatacccacaatatcctgttccatagcttgcactaccactaaatgaaacatctatgtaatctccattttttagagttacagggctctcatcaaacatagattgcaatatattatttattgtttgtttaaattctttaagtcttacaagttgtaattccatatctgcaggctttaaagaacatatattattttctaataaatgtattgatttgattgcttgagatatattactatacagaatatcacctacagttttgcttacaggagtatgaatataagtcatatctgcagaatcataaatgttttctataggatttagttcatcagttttaactgtaagtttttctgaaccatttgtggtcatagatatacttacaatatccggagtattaatgccaagtttatctatttttatagatacttttctattatttgttatatcattttgacttccaaaataataatcatatattaaatctccgtcttttttattagcgtttctagaaaacatagctccataaccatatccactagaataaacagatacaatatcgtaagatagtataactctaacttctccttctttaagctcatattgtttaagctcatcaactgttttagttatgtcaaaattaacatctatattttttgtataatctactctagataatattacaactgtttcttctgaagggcttactgtaaaagacttattatctgccataatagctttataatcattacctataatgtcttttaagaatacattttttaatgtttgtgcagaatatgatactggatttgcatatccaaaagttatttctgtaacagaattctgtgtaagtgctgtatgatcagggagttttatacctccaggattgtctaaaatatatcccaaattaactgcgtgatttctttcagaaggaacagattctagtaaaatattgtctaaataagtttgatcccctgtaaatgtatttgattcattagttttagccgttgttttgaacttatcatccacactatttatagcattaactaaattatctttagaaacttcattatttaatgaatttaaatcaccaacaacagatttaactttatcatttatttcttttatgttattgtcaaattgtttttttctaataacgtgattatctagtgttgcatctacttctaccgaaggtgcttctgtaaaagtattagcttttgtaaaaatattagctgcatctttctttgcataatgagttaagtcaatttcaggtggtactattgcatctattttattatctatttcttgtttagtatatgtttcttcttttgtagcaagtctatctaaatttaaatctgttatatcagctacaacgtgtgtatgatttttatcagctttgttattaataccacttgtaaattcagtcttggttacataatcagctggagaaataccaccactagaattatctttaaaatattttaaagtaattacatgggtatctagtgtaggttcatcacttatatttacttgttttatgttttgttcttgaataaaagtattttcctcacctaacttcgcataattaatatcatcaatagttatgttttcaaatttatgatcaatctctgatttgttatagacactgccagcgtctgctttaagatcaagttttgaatcaatttcagatttattataaacattgctagcatctgctttcaacttaacatcatccattaaagctatttctttagaatcgttataagttggtctggtttctgacccatttaagttaataggaatttgggtagatcctaaatctactttatcccatttagaaaccatagcaatattgataccttcaccagtagtactaacaccggaaatgctatcataatttttaagttgtatagttttgcgagtatcatcaattttactatagaaaacagcttcttcaagtcttctattgatatccgttatatcactagtattatcaactacttttgtatttaaatcttcaatagcttgcttattagcttctgctaattctttagtgtaatccgcagtagattcaattgtcgtgattctttctattaatggatttaacttagtatcaatcatttgattaatagcagtttcatttatagtttctttataagcatttaaattgtcaagaacttcgttaatagcattaataattaaatctttagattcagtttttaaattatttaaatctccaatagttttacttaattgatctttaacataatctataacatactgagcgttagcagcttgtttagattctgtaggatttggaacataaatcttattaaatgttttagttcctacaatagtctgttcagtatctaaagttactgctgtttttaagaattcattaattttatcaatttcagcagtttgttctttattaatatcttggatagcatctaaaagtttatttgtattatctatgaatattttaaaagcttctgaatctttcttaagttcttctatagcttcttttatagaatctatattatcaaaactttctgtactacgtattaagcaatagttcaaagcatctgataaatctttttcagtgtatctacccaggatcaataggttaacaaatttatcaatagcttcttttgtagtatattttggattttttatatattgatttgtttcaatacttgtagctttagaattatcagtgctgaccatcttgaaccttttgattttatttattttgattacttaaaataaatatatcaaaaatgaggctttaaaattgaattttaaccagcatactaatgaatatgatctgagtggatctgttaccgaagaactcattagactttatggtgctccacttaaattaatcattaccaaaaaaattaacagggatttaacatttggtgattttagtcattttaaagcggacaatagagcttgttttgaaatatttggtatgccagaaaattcagaagagtttgaccaatatgaaagattgcaaacacaatttggtgtcccattagatacaagtataggtttatatgtttctaaaatttccacatttaatttagttcaatcttcaatgaattctaagaatgaatacgatgtaactttaccagattccagaattcacgatttaataggatctttaataatcgttccaagtggaaagattcttgaaattaccgaaattacgttagattgttttgggttaaataacgtatttctttataatcaatataaaaatgtttataaatttaaatgtaaaacttatgtatttaaaaaatctgatgaacttgaaagtgattttgttattagatctgacgaattattagacaagcaaacacctaatacagatatgcataacgagcttgaaaaatatttcgatgaattgagttctattaaagataaacaacaacaagaaacaaaagatttttatacaaattctgatgatgtatttggtaggttctaatgaatccgggaactcaaagtctattttctcacgcttgtgatgtcaaagattttactttatctattcttaataataaatcaagtaaatcacttgaattaaaaactggagaaacaaaatctggtgaaatctcattcaatggttttatcatcttgtcttattttacagtcaatggtaccacggatttacaatactatttagatcaatccggcgatatgcgatttattccttttatattagatgctagtgaaggttactatagaagagaatttcaagttgttaaaaataataaaactcaaacaactgataaatccagttttacaatacaaggtcaagatttaatatcttatttgtttagtaaattatatatagctaaaacatataaaaataaaaaactttcagatatttttaaagatatatatgatacttatattaaaccaaaattaaaatataatccagattctgttaaattggaattatctagcaacatcgtaattgaaaacttcgttttaacttcacgaaaatctgtattggatttcatatttgaagaatgtgatagacaaggattgatattatttcaagataaacaaaaaattattatgaaaccttataaagaactcaaaccaaataatttaaaacttcaaaatatacaatatgatgattttaaaaaagatcctaacaacccttatgatattttatctaggaagattataaacacaaaccaagctctgaaattaccgaaatcacaaataatcgcatttgataaagctactaaaacaatgaaagttatgaaaattaatcttgaagatttagatttcgatgttccagtagaatctcaagatcacgatggttttgaatatcaagctcaagaatatttgtacgatgataatatttttgctgatacttataaatcgtttttagattattctaagttagaattagtagtacctggagttgttaaggcgccagaaatattcacaaaatacaaagtattatttaaatctaacgaaaatactaatgaaactcaagaaggagacactaaaatttctggtgagtatattttaactgggtttatagataaaatagaaagttcacaattttatattacaaaattgattttatcaagattcaaggatactgatattcaacagtactagcaaacttagaagtttacactttagtgtcgtttaagttcgttaacactaaagtgtaatatttactagttcttaaaagtcaaatggcaagtttgttcgttaccccaaaccatatcgtagaaaacaatagtatttccgtctttaattctaaatgtagtgctgcttaactctcttatagatgaaggtaaactgtaaatgtaattatcccattgtgaatcaccatcagaatcttttaacttaaaaaagtcccacaaatcctcgtcagtgtcgtcaagatatccacaacctaataattttgatttgagttcatcaattgaacaattgagttcaagtctaaatgattcaaaacctgtgtcacaatttgaacattgtaaatcggaactaaataatttttcttgtattttgttgtgtagagcttcatcgtagctgttattcaacataatattaataaactttgttgttaaatctttcatttttgctccttttaattttatataattttataataataaacttaaaataaaattatttttttaaatattttatacatttatcaagcttagaagtttacacttagtgttaaatttagatctaaagtacaaacgaactaagtttaatactacagatctagtaaatatcatcaaagcattaaatttagatttttaatttcttcttaagtctttcaaaagcagaatctttaatttcagtgtctaaaatatccattttataatttgttatttcagattcttgcgggagaacttcatttttatcataattaatatatgtttccacccaaggtatagggttcttattaaacccagcaaaaacttctttgaatccaatagcttttaatcttttattaataagatatttaatataattcttggctaattctggtgtcatacctaagaaagcacctttactaaacaaataatcaatccacttaaactcttgatcagcagcttctaaatatctatcagttatattatctttaatagaattccaagcatttataaagccttcttcaggagatcttgacaatatcttaattagattttgagttattgctaagtgtaggttttcatctctacaaattaattgtaaaatcttgccagttctttccattaacccttggctataatgcatactccaaattgtcgcaaaaccagaataaaatctaacaccttctaatatattaatttcgactaacatattaagaacttttactttaacttcttcagtatctattaatcctaaatgatactttgttacagcttcaaaagcttcttcatatggttttgaaatactatctgcaagttctaataattctggtatttcaaaagattcatcaaatatcttacttgggttagcataaacagatctaagaatatgagtgtaacttcttgaatgtcttgaaatttcaaatctttgccattctgtcatacaaacttctagttctgggttagtaacaatagatccaatagtttgtaataaacccctgccttgaatagaatctaagaaaattaacttgtttaacactctagtataagaatgtttcattgcttcatttaagatattgaaatctgcttgatctttagtgcactgtacttcatcttcttgccaatcaaaaccagccattttcttaaacaaagtttcaaagataggatattttataacatcatatctttgtgagtttttacctgttccaaaaaataaaggttcttttgtaaaatcaatatattcattattatataaaacgttcattaaaatccttggttcttagctctaagcctttaaaatcaataattagcttttatgaaatcaattaattttttatgcttaggaaatgattcaaaataattttttttgtattctatattatataaatcatttaaaaaatcaaaattaaattctggttctataagaccctcaaaaaatactattttagatttatcgacttcaattaaatccctagcatatcttaagacgtcattgtctttaaattcatctaattcaacttcaacttctacgtctacttcttttgtaacatacattttaactccttatgtttattctgaatattctaaatcattgaaaattaattctttgtgtagatctggtaatgcatcaaacaacaatttagccaaataccgaatctcgaaatgagcacctttagataatcttagttctaatagatttcttaaacttctagcatttaaagaaaatcttaatgaagttctgtaacattctggtaaacaatacttggcgtagtcttgggtaataccgtttgtattgactatgttatgaagttcttttaagtttttgtggcttgcagcatctactaattcattatcagttaaaacaataaacttacttgcatcttctaatgtagaaatatcagcacctctaagttcttttagtgtatatcttgtactcttaacactgaatgaagccattctgtgtcttgccaactcttgcaaacaaagtcttgaaattcctgtgatttcaaaattataaaacaaatgttctaatgtagaatggtgtttatgtttgtgtactattctatctattaatgctttatcattttctcctacattatcaccattagtatcacatttactatgactatcccagcaagttctgacagcgtcaataaaaacattgataccagaatctgctattaatttaactttaatatttttcacttaagctccttaatttgctgtattgttaaagtctaaaatctaagactttagtctaatatttaatatttagaacttagattcgataggtactctgttattaccaaaaatatccaaatctttaaactttagtttaactgcttgggtaaaatgtgggtttctcgaatcttgattatacggaaaacaaaatgatttaataggtatattatgattctcaaaaaaatctaaagaatcttgaatatcttttattaaagatttagaatctttaaaatatttatgattataagaatgtgaacctatttcaaaattatacatattttcccttgaaatttgctgaatttgatctaatgtcatataattttcaaaacagcctttaaatgcctttttatgggcgttatagcactgtatatactctttagattgtttctcggaagattcgcaaattatggacggatttacaaagaatataacacgtttaaataacgcaaaatgacttctataatgaaattgtgtatataaaccatcatcaaatgtgattatgctgtctgggtctaaagattctacagctttgagaactttatcatttacttcgtgaatcattataatttcactcattattttccttggttttcttagatttaatgtaattaagaacgcttataaacaacttcaaacggctccgcaaaacctaaattgctataaatccctacgaactcattaaaagctaaaatagttttgatatgattttctggtatatactttttatatttagataaaaacttaagtttttcatctttatctatttttttaaattcacaagcttttaattcaaatggattttcaacataataataacttaaagatttaatataatcatttctattcattctagcagctattagggttgcttttgtaatagtattatgatcttgatgcaaatcttttggatggtgaacataaacattttctggtttaatggagtctaaaacgtctttaatattatcagctaattcattaatatcaggcattttaaaaaatgaatattttaaacatttttgataatccaaagctaatttatctttgactttattacgttctgtgttagcagtactataatcatttgtgatgtatagaacaccaacagaatcttctagtagtatagaactacaaccaattacctcatcatctggatgacctgcaattattaaatgttttagcatatttactccttgttgattttaggttttaaattttatctcaaaatggtgggtcaatataatacaaaatatttttaataccagtttttaaatttgtaaaatcgatatgaacaacttcgcttaatttaacaatactaggaactcgtctttgtatttcataatcattttcattttcaatagtttcgaatttatattttatattatacccaaaatcattgaatatttttatgatatctaatggatttgctctagccataggatttcctatgttaaacacaccgctgacattttgtttaattaatttataaagaattttattaaagtcatctacataacaatagcatctttcagtccctgtttttggctcagcatcgactctgattttaatcacttctttaggattgaaagctgctgctaatactttagcaatgaatccattatttggattttgaccaggaccgtaaacattaaaaggtcttattattaaataattatttgtttttgattggatatatctttccataaaaagtttttctaaagcataattagatcttaatttagaacttataattaaatcactggattctgagtaatctttagaatcaccatatacttcagaagtagaaaaatatacaatctttttattgtatttagtggctaagtctacaacaattttatcatttttaaaagatttaaaaggtaagtttgggttgtctacaatattttgaacgcctaaatggcttgcaaaatgaacaactatatcactatttttaattaagtttttaagcaacccagatttcttagcatttttaataccttgtgtactatcagtatattcgcctggatttacatctaagccaattactcttggatttgaatccaatgaatatagtattttaataaagttagatcctaggaaaccactggatccggttacaaaaaatttcatagacaatttttacacctttcgttcttcgatttatattttagttctttaaacttaacattttagtgttttagttcacagagatgaaatctttaactctttgtgagtactttgattttagatttttaatttcttctacactcaagtgttttatttcatttattttttctattatataatatatcagctctgtttctaaattttttggattttgagattttacaacatttaatgattctatgtttaaaaatttaagaaattctgaatcttcagttttagaacctactggcatattagactcatcaagatcaataataagtctatgagttttagatcttaatttgtattgcaattccttataaggtctgatggtgatgccatacataggtatcgactccgaactattattgaaaagatatggaatcatagaatcaccatttacaggaacacttaaagcagaatctaaatcagttgcaattctaataattggattcgttttgataccagctaaagtgcaataatctaaaacattatcaaaatcttcatatttggattctagtggttttgaaccgactaaaatgtcatacattatgactgcatatcctgcggtatcagaatcattagacttgcttactccaataggaaataatgtcaaaaagaactcaatatggtcatcttctgggtatttaatattaatcaattcaaccaatttgttaattaaactaacttcatcaatagtatcattaagtgctttaatttttggacttttattagattcaaaattaattggtttacttttagtaaaatatttaatagagctatttattttatcgaacttaatactgaaattaaatccttttatagtttctaaaacatagaaatgtgttcctaaattttccggacttaatagtgtatcctcgatagcttcaatcattttatcggttttattcattgtttttaacctttgtttattctattgatagtattatattatgaaaatacttaaaatatacttaaaattttaagcgaatattaatactatagtatat

SEQ ID NO: 17 - DNA, 57303 bp, Camplyobacter Phage CJLB-15
taaagcttaaagcaatattaaaaagtataaaaaatgcttggctttttagtagtatatactatagtatcatatctaaagcttaaagcaatattaaaaagtataaaaaatgcttggctttttagtagtatatactatagtatcatatctaaagcttaaagcaatattaaaaagtataaaaaatgcttggctttttagtagtatatactatagtattatatctgaaacttaatataaacttaaactctaaaacgacataaataatataaaaggttcatatgtatttaaataaagaaactaacgaatctacgtatacagcaaaagaaattaaatctgattattttactaataaattacataaaaatattaaaggcactgctggttatgttatattctttggtatattcacagcagtttgtttaatatttcaatgcttagattatatcatagattattatataccaggttcgggtatctttaataaaaactttcaagtcccaatggaaacactaaccacactatatgctaccctatgttgtgtatatgtgggtgtcgacagaacaacttctgttattgccacttttaaaggaactaaagattctgctaattatggtaacccagaaagaaatagacatattataatacagaacttttttatatgttctttggctttaattcttaatagattttttgatgcaaatctaggattagaacctttgttagtatcttttggtgggtcgataatcttatatgtttctggtcaaaaaattgtttatcaagctagtaagtttgcaccagaaaaagatattaataaaaatgggatagacgatagaatagaaaataataaagatttgattaatgttttaaatgaagcagttaaaaatgatagacattttaaagtatattatatagacccaagaggtgtagaatctttagagtttgattctaatcctaatgataacactcctagtataccaaatgaaccagcagtacctattccaattgagccaatggtagaacctataaatccagaatcaaacttaatagaatcaaagagttaatcttttaccattaactctttgagttcgtttgcgttttcacttacattataaactttatattcagagctgtatttagaacttagtttagaactaactactaaatctggattgtcgttgatatccacaagttttaaacctttatgaattacaattaattcaaataatctttttaaactcatttgattataaactttataataatcatatattggagcaatttgattaaaaccataaccacctgagtgagaacctctcatattaaatggttcaccaataacttgtagaaaaccattttgaattctaaacgcacatatatctttgaaatctacatcaacattgaattgaaaaatagcatcttggagatttataacaccatcattatttttagtatcacctggtagaacaccaacaattacatcatattcactgagtgaaactttgttgtaactatgaacatttacatatacttctaaatctgatttaggatctaaagtcaaagtacaaaactctgctgtaattaatggatttttaggatcaaaacttcttgaactggtccaatcaccagagtgtatttgaatcttaccatctatgctagtttcaagttttgtataatccaaaacattctttagtgaacctgaactatctctgaataaacaagataaatctaagtctaacgaacctttagaattatccttccttttccaagcaacgaatacttgaaatttagaatctattctaaggctggatccttttggaaagaatatatcagtttttaaagaatctttaggtttaattggaggaaccatagtttctaaatcatcagaaattgctattcttttagctgagccaaaatcaattaaatcttttttagattgtaataaaattgaaaataatttacttaagacttcccaaagattaccgcttggttttttagcttcatcaaaatataaaatatttcctttgatattagacatacgaactttaccagttcttttataattaagaactaaatccaataattgtttgagtgttttaggtctatgatacaacaaaatactaaaatcattgttattagttttagctgctaaattaaaaacatttttataagctaaatttatattatacttataaatttcaataaaagcattattaaattttactgggttatttagtaaagttctgattctataagtacccgtttgtttataatctctttttaatattttgttaaaaacatagtttgcaactattagatttttatatcttttttgtgttgtaacaattaaatactgtatattttgccagaatttcttgtatattaacatttcatttaatatagtttcacgatccaattttaattcattaatagaattcataacaaaagttttaatatatctaggtaaattgaattcttttgtgtaaattctatctaatttgtctatatctaaatcgtattcagatttaattaagcatttagtaatagttctgaccgcattaacattttctggtttgtattttttagagaattccagagcttcactaggatttaaattagaaatcaaagtttctaaagctaacttatttggaatcttacttggcatatatttaaaaccatattttattatgatatctttttcattatccgtaggattgaattgagattctaggatgttttttgtaattttttcaatttcagattcttgtattaaatctaattcaactagttctttgtttggtattagatcactaaaattaatacttagagtataatcgtgagtatctaagttaaaaatatatcttaagacatagtgatagaattgatcttcataatctgaaatatctcttaatttatgagtatattttttatagaatgttgtgcctgcagctaatactatagattcttcaaatgatttaagatcagaatctgaagcattattaatagcttctaacaatgtctggcttggtttataaccttttaaaagcaacttataaagaactgagtttacatttctttgcgatggttttatatctgatttatcgatataaactttgtttactgttaaaaaatttttaaaatctaccattatatttcctttgtctaaccattactagtcttgtttgaattaaccgcggttgtaagatctgtttaatatattattgatcttttttatttcaactttaatatcagatatgatatctttgttactttctgggtctttgatcaagattgataatctttgatttaaagaatccctgtaattttttaaaactttgtcttgtaacatctgaatctcctttttaatttatataattatataataataatcttaaattaaattgaagtttcagatatttttgcgtatttttagtaatatttaaatatatgtatagaggctcaaaaatcggcttaaatcgattttagatttaaagtgatatttaagtatatttcaatatattaagtggcttgggttctatctatagttaagaaatctaagcctaaagaaaccatataagctttatattgatcataattaaagtcttcacctttaggccctttaaatccgtgtgcatcaccatattttttacaaaataatgctggatccatattaggaactactgtaatataataattttgagctatagttctttgaaccttaagtccaccagaaccagattcacgagtatttttagagccagaacttgagtttgaacccgaattagaatattcccaataagtaacttctacagtaaaaggaaatgttagtatattattatccctataatatccagcaatacctttagttccccaggatttgccagtatagtgcatatcttgatttttaatatcttctatagtagctttttcttcataattagtatccttaaattcagtcccatctaacttaaagccactccaaagatatgtgatcatttttggatgatacaaatcaacatcatctggcagaccagaaagagttaaagaagtgggtgtccaagttttctttaggcctttagggacgtgttctacaccttcatcaactattctagcagatataaactcttcattagtttcaaaagaccaaactatcgtttggctataattttgaacatttctaaggttcttagaatttaaagaattaagtaaattccctgcgggagtaacgaacttagccattaagatcctttatttgatttgactatataatcgttgttatttagccatcttattataggttctcctttataagatttatcccaaatataccaagcatataccatcataccagctttataagttccatcttctctaatagtatcttcaagtaaaccatatctacaaaaaacataaacagtttttaatggaaaatcagtatccttgtatatttcattatatcttgaaaccccgtgtaaataattcaatggtaataacattgcaattttattatttgctatttgtttagcttttaatataaattcttttgctaaactaaatggcggatttgttataatattatcatatctatcaaaatcatcattaatgaaatctttgaaatctttgaagatacctgttaaactaaaatcattgtttaaatcacaataatctacagatttattataatcttttagaactttgactattgctccagcaccacaagaaggttctagtatacttccttcgaaattttcaacttctaataattgtttagtcatactataaggtgtttggtaatagtcatttttattacgtttatttgagtttaagctaaaatttttacctttcatttttacctttcatttttatcctttgggatattatattataaaatatcttaaaggcttcttatatagattcaaataaataacataaaaggttcgtaatgagagatttagctcttggtgcttacacgcaaaaagatttaaccaaaaaagtcaatactattggtgatgtaacaacattaaaaaccgaagcaaaaactacagcagtaggagccataaatgaacttaaagataattatgaaaaaattaaaaattctatagataccaataccgctaatttcttaatagatcaaaaattagatccggttaaagaagatgttaaagctttgcatacacaagttgataattattctataaactataagcaatcaaatgatcccacagcttctataaatcctacaatcgatagtgcaacttttttaaatacagctactggagttatttggacttgtatagataaaacaaaaaataaaaatcgctggataaacggaaacggagaagttgctggtgcacttccaagtaatccaaatcttggtgatattggttttggagtgggtattgcacctaaagaaattactaacaaatataatatgtatcctatgctaggaacttttactcctggtcatatgaattatggaaattatactgatatccacggtaatgttatggtttggatacctaaactttatattaagacttcaaatgtagacgctgcaccatattacggattaaaagttgaagtttccgctactcaagaagaaggtttttggtgccatagagcatttattaataatggtaaagaaattccaggtttttttatagacaaatatctagcatctaaccaagggggtattttaggttctaggcgtaatacagtgcctttaacctgtgattctaaatttaactctgtagctttaatctcaggagtttctgcaaaggttgctttgggtaataaaattacagaagattctgatttagattctgatgatttaaaatctattaagaatagaaattcaagcttcttagaagctgttaaaaatagaggccctgaatttcaagtattaactatatttgcttataattatttgattttgttgtctaaatgtatatatcaaaatgcttataatacaaataatttcaataatattgagtttgctaaatcaagaacagatagatttgcatttattcaaggtatgaatactatgcaaagtgtgcaaagagatattcaagctattcataatttagattataaaactgctgggtatacggatggtactaacgcgttgtatagaacaggtagtgtttcagattctaaaatgggtaaaattagtcataatggtcacgcgtgcggggttgttgatttagtaggcgggttatttaatctggctataggcgctatgtatggttatatattagatagaagttattttggtgttatcaaagaaagcactaatataacagatttagatttagaatctttagtagatactaataattatgatgaaactacattaccagcagagattataacttatataaacagtgactctgatagcccattaggttattttaaggatgttgatgccaagtacaataacacaaatgtaagaacaacttctgagtataaaatagattcttgcggtattccaaaatggagtgttttacaagatgctaccgtagacaccacaagacaaacttttcaatggagaggaaatccaacgtataaagatactttaacatttcctatagtaggttcaagttttaaagatagtttttattcaagtgttcaattccaaaaagatacacaaggtgttgaatttggaactcgctgcatattattacccgaaatttaaaacttaaaaatttaaatttaaaatataatattatataatatataagaattaaaaactcgagtttaaaaaaaaattaaactcgagtttttagtaattaaatcattaatttcattataatactccttacgtttgattagattttgatctcgcaaatccaaaaatctttataatttattatagaacctatacaaatacccactaatggtaaatctaattcagtttcacttgcaatacccaacccattagaatcagcatagatataatcacctatactaggtttatttttgcaataaactggagttctacctttcaatgcaattggaacaccatcacattcattattcagaattacaccaggattttttgaaacaacaccaaataatttcatacctgggttaaataaatttacaccacaagcatctatgcctaatatatgacctgcttttatattcgatttaatagattctggaacttcataatactcagctaagtcagcatatttagcttgcaaagcagttccttgaaaattaacagcatatatattagaccatcttaaagctgtagatcctaaactaaatttattatcttgagtaggggtatcactggttgaacgtctcaagaaatctttagaatctaatccatctaatttatcagcatctattttacccaaagatcctggtactttttgaagtaataaagcaatttcttctggtgtaaatctacttgctggtaagaaataacctgcgtgttgaccatctaatgtatcagcatcaactccagataaatgcccatccacttctttaattttattgagaaattcagcattccaataatcgtaagtaactctttttttcagatcagaatctatgcgatttaaataatctcttaatcctttaatagaatcaatacccaaagattcaatcatatctctatttgttttaatccagttaacaatttcctgaagttcatctaagtttatgtcatttgaagttaaaattgtgttaatatgatctattaatcctttaagaaccttaccttggtaagcgcttaacggtaatctgcgattatcagattctaaactatcaacgacagattcttcagtcaatgctattctaacaaaatcatcaaactcttgtttagagcagaaataatctttgtgttcaccatcaagtctatcagcatttgtaacagttccattaccaaaccaatgttttagacgatcttcaacgtgtttaacggttgttgggtgaaaagtattagattcttcataatcttgcattgaactaggatcataaggatcttgattatctttagctaggtaattactggcaggaaattcagtatattcttgatattttgtaacgacccaaaaactaggttcctcactaggaactttattaacacattcttgcacacatttataatctacttcattatatcttacaatttcattaacctcatagttttcagattgattccactcgagtggtgattttccgtttactatttgaaatttattgtagatatcagttgtctcttttttaagacgaacttgaaatagatttatagtatcttcagtaggtaccataccgtgtttaatagcataatcagtataaaaggttttttgatttttgtgtgtaaaagccatcacaatccttgctttttgtatatttatttatgaattgtggttaataagcctttagtatttacccaaaggcttaagttattagaatgtgtatgtatttttagtttctttaatagattctaacgaaaaggttataatgccatttctagctttaaatgaattttgtttaagtttaaagttattaacagaatccaaactaactctgattgtattataaccagttataaaaaatgatttagcatcatctataactttatatctaactacaatttcatcaggtttaaagtctaattcaattgttttagaaccatcttcttgaactcctggagccaatacaacaacatcaattcccgaactagtttcagttgttaaatacgaagtaactgatgatggatatgtttccattgtttctgaaacattttttaataaatcttgaagatttttgttattaaatgatacgctaggcatatctaagaatggtgatctaagaaaattgtttaattctaacatataattccttttttgttttaattatattatatttttacttaaataattcttaaatcttagagcttttaatgtttaaattaaagtttaaaagttattaccattctaactcatcatcccctggtcctatagttcctggtaaaaaatcccttgtatacataatatcttcgtattcttcgcgtattatttgaaaatcattataattggttctagcttcacccaaggtatttatgtatgtagatttattatcatatatagttaagatttctccggttaaatcttttcctatcaacacaccatttgagaatagcttattaccttcataatctgtagattttaaagttgatgaccaaacttgagaagtaccagaacccgtaacagtcgtttctactgctgtcatattaccatagaattctaaaaatgcagtttctggtatagtcaatgttattatatttccagatatttcataactagcttcaaaatatgaataattgtcattatcatctggtaaatcaaattcttgtgtagtcacaattttttgaaaagtttcaggatctgttttattagctcttgatagataattaccaaaactcgaatctctttccacagttaccataattttagataaatcatctgacataaaactaggatatccatatataaatacaacttttttggtattagcatttactgctacaattttagctatttgtattttattcttaggacttccaattaaaaatgatgcgtgcgtaatatcactaaaagttaatttaataacctggttggtaacaacatcgtatgtaggtgcatcagatattgtttctaaactatcaaaattatcattaatatacttaagatttttatatttagcttcccaataattataggtatttggttttttatatgaacctttgaaggagtcttttgcaattgatacaattgaccataaagctttgcgacttctactatttttactataaaaattatcttgccattttgcttcatttgctatgcttgataagcgagtaatgttatcattaatagttttaacctcagcagctaactcatcctttgaaactttgttttctaaactggtttgaatattattttcaatgtttgataatgattcagaaacagaatcaacaacaccttgtatactattgatattttgagtaatttgatctttaaaattattaatattagtttgtatttcagacatatcaaaattattaataataacttcaaattcttctatttttttagatgtattggtttctaattgttctatcttgcttgttaaatcttgttgaactttttggagattttctgttatagtatccaaatcaatgcgatctaaagagccttgtagtcttgcaatttgttcattgatactctgtatagtttcagtgaaatttaaatctctgattgcttggtttattttagaatctacacctgattgcgtttcaaataatttaatttgtgaattaatagaatttaaagaatctcgtatttctattaacttagcattataatttgtatttaatacaaaatcactagctgggtgtgattctaataatgctgaatttggtgcaacatatgtagaatcatccctatttaatttagaatctaaagcagcttgcaagcctttgatattagcaattgttaaatcatcaaatttttcgcgattttcttctatataattaataatatcttgaagatttttaaaatcatcatctgtaatattaattactttctttatttcgtctattatacctttaagaactttaccttgattagcacttaaagcatctttagtagaatctgattctaaattatcttgtatgtttatatgtaaatctattttagcttgttcaattaatgctctaagttcagaatcatcatataaagtatcttgcgtttctatgctttcactcgagccgtcagctcttcttaaggttattattctaccattggcagtaagagcttgtgtgcttggtaaaactctggaattagtattaaaagtatctatgaaattcttataatatgaattaaagttaaattctgaaagctcaccatctttaatagtataagtagtatctgtaaaaactgggtctttcccaccggcttgctttctagcatcatcccaagaaattttcttatttaactcaatttgagtcaagttagaaattggcttgtcgatgtcggcagtgttatcaacgttttctaaaccaagcgttttctttgttatattgtgtgggttttcagctgtataatgtctttgaaattctaattttgtagaattagaaattggcttgtcaatgtcagcagtgttatcaacgttttcaagacctacgtcttttttgtttaattcaacgtcaccttgtttacccgcaaccgtgttaacaacaccttggataggagtccattgtatttcatcatttacaagcataccaatttcatttgtatcgatagcaagaacgatttcaccttgtgttggttttgcgtcatttacaaaatgttttttaagattacgtcttaataaaataccagtttttatttcagccatttaaccctactttttgtatatttattgctgagtcaagctattttagttcaagcttttaagctttagctttagctttagaacctttaacaacataatatctatctatatctgcttctaatcctggatgtcttaaacgtaattcttttaagaaataattataagcagttaatttaacttgtctatctaatttcaaatcatttggctctatgaattgtgctggcattccaaaaatgatatcaaagaatctttcttgtgttaatttaatagttttttcatcgcagtattttttcattaatttaacaacaccaataaaactatgcaaatcttttattcccacgtttgatttaaacatatatttaaatatttcttttaaatctgttataaattctgaatcactagtatcttgttcttgatatacttgtttaccttcgtaataaacgggttcacctttatctaacataggaaccaaaccaaatctcaaaccccgggtaacactgaattgagccattctaggtgtgcttttatctgcttttaatttgatattgcctggtttagaactcttagtagctacaactatatttggatttgctgaaatagctcctactaacgctcttaataataacttatgtgcaaatgcttttatagattctttggcatcctcgaaacttgaaccgtgactaaatctcgcaaattccgttggttttccatctttaaagtcggcattttcaaaatctatttggcaagctatgttttcgggtttatacacgaatattgttaataattgatctcctaatttttcacgattttgtgaaaagcatccgtgatattcaaaattacctattgttttaccttctaaagaatctaataaatcccatagtttttcttggtgttcagcaggtataacaatatcaatatcaccggaactttgtttatatttaaagatttcttttggatccattttagggttcataatataactcgtggaaccattaaaaacaagaccttttttaatcaaagaatcattagcccaaagtttttctttgtatttgtttaaaaacaatctattaagacttgtgaataaatctatgaattcagctctaaaagattctattgacaatctattaaaatctattttttcagcacttttagattcacccgtttttttattgattgttgtggtattgccaccttctaaaataagtattaattcagataatttcattagttcatacttttagtttatttattgtgaaccaaatcaaggtattatttgttattatagatttataaaattgttttcaaggataaattatccttgaaaactatgctttaaatttgcgcattatttctaagaaatttttagggccgtcattgtaataagttaattgtgttttcgcatcttttaataacttcaccattgtataaagcttgtctattccgctgctgtctatgatgtcagaattaaaaatatcttctaatgcagcctcaaattggtttcggataacattctcgtattttgaaagccccattttacttaaacgaacccttaaacgatcattaaattttttggaggcgtcgtctatattgtaaccacttttgtctaactcaacccaacttgaaccggaatctttcactctttctaattcagatgattttgaatttcgtctatgtgtttgcttatcgcgcatatttctcctactttcactatcgatagcaaagcagaatactctcgaagtcgcactttggtcattaaaatctgctatacacgttttgagcgtggctgttaatgttttctttcgatacattgtactaagtatatagccaagatcgccgtggataaacacatatccaatatcgtgatagattgaggatttttcatcagggtaaacaaagagataatcaaattcacttgatgtgttcttttttaaattattaacttctgctgctgtaagtaatttgatgtcggcgttttgtaaatctacacgatcgtgcaacgcctgtattaaactttttaattgcttcccacccaaacccggtattttttgtgctatataattttgcacattttcatttaaagtatcactattgacgctattaaataaaaaatctttgaatttcatttttaaccttccattttaaatttacacttttgtgctaaaacacttataaaaatattgaattaacaactgcaacaaagtgcatatattaatatcatatcttcataataatattatatttacaaaaagctgaattgtattttaattatttgattctggtctttgctaaataacgtctatatatttaggttctttttctatagtaatataattgtaattcagatttttgctggcaagtgccgttgtaattgattttagtgcttacaaacaatcacctcgaattatcatcattttccttgtcttagttttataatatatttgtaactcacacaagctaaaatcaagaatgttctgtaaaagattcaaatatctttgcattttcttgcacttcaaatgatttatcattatattggtaatatataccatcaaaatctgcaaaattacaacccatacaagccaaacaatttaaatgacaaataggcattttagttcttttaaacacttcacaagtttgccttttcagggtttctttaaactcagatacatttatatattgttctaattcagtttcatagaaattaactacaatttttttataattagaatctaaacttaatgttattaaatcttttaaagcattcatataatttaatttatgtacagtgtaacggatagttaatttatagtttttagatttaaaataacttaaaacaaactcagtatcttttgtagaatctttaccatttctgtaaactcttctggagttccctgataaatcataagatatttccaaagaaaaatggtttaataatttgcgggttctttctataaaataatcagcatttttagtatttttaaaatatgcaccatttgtagttaatgatagattgaatttcttcttggtatgaaatgttattttatcagttaaatcaaaaatataataaacaatatctgggtttaaaaatggttctcccccaaatataactacagtgctaggcttatctggttctctcttaataagatctttaaaaaaatcattaatttctctttcagagatatacgtgttttttattaaacgatctctatcatttttttgataacaataatcacaatcaaaattgcaagcatctgttaagtataaaatattagatttaagtttatatttagattctatgagtggtcttttaaaatcttcattaagattagaatctatagctgcttggaagaattcagcaaagtcttcatctgaaatcatttttggtgcttttttaacttttgtatatctcgattctttagacattttgtctcctttgaatgtttgtgttttaaattttagttttaaattttatattatatattatatttaaagttttaatttttagcatttgaattagtttgaactttaacctgagttctaaaaaatggatctatatattttggtaacactgtagtaccattttctctatagggtgtttgactaaattttttaagtctatcctgcaatctaaatatattataattcaattgcatctcagcatcaaacaaatcattagaacttactaaaatattttcagaatctatgtaatttgttgtgtattgattattggtcaaataaactctgtacttattataataaaacccaaaataataaagcctacctagttgtttagataaagcttcggcacgttctttattcgatatattaacaaagtaaaatatagaatttttttgtttttgatttaaatctatgaaatattgataagcatcattaatgcataattttaaattatctttagaagctgtcactttttgtcttctatattggtatacatcttggttattaactccttttgttttagatatcaaaaacattttagaagcattttgaatagggatataatccagaataaaaggctctaattgagttgataaatagaacttattatctcttgtacacacgtattctgtgtaatctacgttatgtttagataaattattcaaaaattcattgtagagttttatatcgtatttgtcgatattataaatcattaagaacctttattatttttatttgtacacagaataaaaggttttaaaatatcatcacttaacatatatggtttgaatttgtagactacaaatgattcagtctcacccgtgattttttggtttcttttagttgcttctaaattcaagtaatctaatacagatttttcacgagtcaaagaacaatttaaatgatcttgaatgatatattctaatacatcataattgatttcatccatttagaacctttagcttaagatttaaatatacccatttcgtatgcttttgttcttatcaattcagtattgaaatcgcaccatttataagctaaatcaaaatgttcgatgttgacgtcgttatttgtaactaattcattattagataaatcaatatcattttcttcaagtaaatctaaataacaagtcataaaaattaatttaacacgctcaatatcaaaggtatctttagcataaaaagtataatcgtcataaaaatgactataagttatagatctcaactgttcgtgcaaatcactataaactttcgtttgtttgatatcatttatttgagttttagttgttatattatataaaaaataattacgttttgttaaaaattcttgaaagctatctaccaaagatgctaatgtaattttaatattaccttttttaggagcttcatatcccgggtttaagtagtccataatctctctttttgtgattatttattttgtgtgttttacactgatgaccacaaactggtaccagctagtattagccggcacaaaattaatttgtttcgtattctaatttcttagattcaagctcctttaacatttcgtcaagtttataatctataattttattaactttagataatttattaacaatattcggattttctatcgcttctgttccaacgtaagcaccagccatcaaatacatagtgctgcttctaggtactaaaataactacagcaccaaatattataccagctatcacacaaatttttatactttttgatgtcattttatataaacgatcctctctatcggcgtgtgatgccacgttaaatgcaaaagacaaacaaaaaacaacaaatgttaaacaaattactacttcagctgtgtccttaagagcatcaaaaacaccagctaaatatataaaaacgataataacataatttttcctttattttataatcaagtttaattgaacgcaatcaagcatttgaatccataaaagtatgacccttggatttcaaaaaatctatgataacttctggttctacttcatcaatacaagaacaaaattcaatttcttcatcatcagcttcacataaaacatagattttatctgtattatagaattcttctaaaacaatttctaaatcaattggttctgggtctctaggcatatatcctaaactatcgtagatattttctaaaatatcaactgtttcaacatccattaattggtagtcataaccaaaatactcattaaatctagcaacgtacattttatctcctttgtttttatcaatataattatataataataatcttaaattaaactgaagttttagtagattttagcatattttagcattttgttcacactaagcaaaattatactttaaaatcattgacttggcagggtttgtttgtccagtaattttaccagaataactatcatcttgctcttctactacaatatgatatggtatctcatttttttggatgatattttttactaccttttgataaagattgaactttctcggtatccccataatttttacaaatcctatcggctttattgccaggtaatccactaaaactgaaaacacatatgataatacttttagaaaatttacatcagaatttagataaccatctttttgaataaaaagctcactattcactaaatcactgattctcttcgtgtctttatttttaaaagcttctaccaactcattgaatttattttcataaaagactccaaaatgtggttccaactttgaatccttcattattaggatgcaatagtattgtttattatctacattaaaaagagatatttgcagatatttctttgcatccagaacttgattaaacatattaatgtatttctcaccgagcttaatataattagtctttttagtcaaagactcttgcagcaataaaaattctttaaagttagctattgtattctccttttttaatataatttgtgaaatatataagaatatataaatatctataattatattataagttttcttaaaaagactttaaatgtatattattggagaattttctaaaattatatatgttactaagacaaccttaagaaattgggaaaactatataatttatatcaaatattatatattctggacttaaaacagtggctacagatacaacagctggaaccactttaaaaaatcaaagcttgtggagttcttagaaagctcagataaagtctgagaagaactatgaagcaagaaaaactattaaaaatgtaaagaattttatagttctttataatattttataatggtttagttggtattaataataatccaagaacttattaaacctatagcagcacccgcacaaacatctctaaaatgatgttttttcgcagctattctcgaaaatccagtaaaaacagctaaagctaataatatcacagtagctataattaaaattgtattatattcatttataccaaaaaataaacaaccaaaaccagcgtaagcagcacacgtatgacccgaaggcattgaatctttacctccattgggtctaactgataatttaggaaagtatttagaaactaatttctttagactagcggatactaataattgtcctgcagctacataaagccacaccataggtgtaattgtcatattcgtaggatataaagctataaaaaataaagctatccaaagagtaccaaattgaaaaatatcacctacttcttggattacgtcaatttcatctggatctaacccaaaaaactttttgattgaaccataatttatattcatttttaaacctttgttttttatttgagattagcaatatcttcaagcatcaatgcagcgatacaccagttgattaataaactaccatatatatgctctacaccatttttagttgcataataacaattattatcaaataaaaaattttggtaatatttatctagttcatctacacgccgcaacgcaaacctgacttggactaaatctttacaactcatagaagttataggaggtgtgtgatattcataagctggtctaatgaatacaaagcctgtattttgctggtcctcgtacacccccaattcaattttaaatattttaaatagtgaatagcataaaaaatctacatcagctctatatactttattaccagctaatatatcatcttcgtgcgaatcattggttttacccaaagtatccttataaaattttaatacccttgcttcgcgtaacactatgatcctttctatctatttatttaaaagtgtattaagcacttcaacaatatgattatgatttatttttttggctaatgttgtatcaacatctgggtaatctttattaaaatctgttaaaaaaattctaatgcatatattgcataaaacccaatcatataaatcacttgttttatcataattaattattaaatgtttagcaactacattaaattttaaatctatttttgttatataatcataccaataataacctaaatgatcaactcgattaacacagagcttaattattttgttagtcaataataatttaatttgctctattttattaaaaaaatcagtttcttcatttttacattcaaaactataaaaatcacatatattataaaagttggattcaccaacataaatatgtttaactccactattatgagtattgatcaaatctacgtcaaaaaatttttttattaattttacttcagtttcatccatataatttataatagagtccaaaatttatcctcttcttttttataattataattagagcctatatgataatgatgaaaataaaaattatgtatattatatctttgtttaataatatctaaatttgtataagtttcaccaaacattaaatcttttaaaggttttatgtaatattttgatgatagtatatcaaacgacagctcttctaatttatgtggttctaaatcttttactatatttttataagtactatattttatggtattagctatttcagcccaattttcaaataatttcttcgaagcatcaactataaaacaagtattaaatatgcattttgatatattatgttttcgttcatcttgagcttgtatatcatcgtatattaaacaagaatcaactaattctaaatcatttaaataattagaaaaatctctcactaaaaacatatctaaatctatatgaattaaaacatcgtatttgttttttagcatagattctaaaaaagtgcaaccatatatcttattataaaagccatcttttggttcaagatttaaatcattataaatatttttttctatataattgacacctaagttactatatatttttttggtattttcatcaacaccattatttgtagggcatatataaaaaatatcacactgagtgtatttttttaaaagttcggcgcatttcagtgattcagtttcgtacaatcttttatgttttttcttatcggtataagtattgttagattcaactacacatataaatgcaattttcattcatttgtacctaaatgataatgattgaaacatatatttttaagattttcttttttgactttgtgaataggatcttgataagtacctaaagcgtagttatatatagatttaactgatatttctttagaaacaaatatgcaagctaattcttcgacaatatcaaaatctattttatctatattaatatttagctcagaatttatataatctaatagtttattattataatataagccggttaatttcttacaatatttgtaaaataatttggggaatgctgagtttttatcataaataactaaacccgtatcccaaaaatctataccagattttataactatatctttgaaattattatgtctattaaatatttcagtaaatgtatatctaccacacgaagtttcatattcgaataaatgtggtggtaatggtcttgttaaatacatatctaaatctattttaataaaccagtcataatttaaattttctttcgcatattttaataataaaggtatattccaaaaaccacattcatatgaatcagtttcgttgataaaatgctctatatatttaacatttaatttttctaattttttcttcgttttttcactaataatgtttttagtaaaacaataacaatatatatcaatatcttttaattcaccagcattttttcgccattcattaaaacatttaatagcctcactctcataatctctacaccaacctaatttaatattattgataccaccattaccttctattgtagtaattaacgcttttgataccacccacaactcctattgcatatacttaaagttttactacattctacattattatatatagtttctaacgggtcaaataaattgcctataatgagtttatctttttgaaaatccatacaacataggcttaaaccatttgtatgtatgataggttcatttaaaaaacggcaacccgattcaaagcctataggatcaccaaatctgtttactctattatctatttcgcaatcaactatttttaagttttttattttaatcaatgattttataataccattaaaatttttattacgaattataatttcacctctgttatataattttaagttttttaaattgttaacaaaatcattaaacttatctacattagttaattctttaaattcattttcattgttaccataacaagatatgtataaaaataattttttatatttaattaaattataattagcagaaggcgtcaacgaagtaatcaaatgatattctttaattttagactgttctactatatctaaatattcataatggttcttgactgtaaagaaatcgccaaccataggtgttaaatcaatctcttcaacaccttgttcttccaaccaagcaactatttttttaaataaatctatgctcataacatcgcgacttacattattattttgtaaccaacagaagttacatttgagtaaacaattagatgttatgtgtatagtaaatcttttaggtattttcaatcttgtctcactaaatctaaagtcgaacaatgtataccaccaccgaataattcacaatgtcttaatcgaactggtatcacatcaaaaccatttttatataatatgtcttgtacagctatagcatctttatttactaatatttttttcggtgatatgctcaatacattcatatccataccacgatatgaacataattggacaaatggtgtgttgtaatcactataatctttttgtttatatttaaaatcaccattagtacttataaatttccaattatggaatttttcaggcagatattctttaataggtttatgtagtgctgcatcatttactaaaaacacaccaaaatccagtggtaaaatattaccatcaagatgattatctatcatagcttcagtataccatattttagcataatctttcattatattttcaaaccatttagcacccatataatggttatatgtagagtaattacaaagtatatcgtcaccaatttttaaatattgagctgcatctacacctaaatcccacttcatagagatattatcaaaatctctaggtgcatcccaatccttaagatccatagtttcatcttttaacataggtaatggagcttttatccatttataacctttaaacattttttctttgaatatatcatacattgaatcattttcaaaatatctactgcgtatttgaacaggagtttctacgatcaaatctttgtatgtaaatacaagatctctaacattagaagcactagaatggatagatttaaaattaggtgtttgtatttggatcttatctttaaccttttctggtctgtatactttaacaccattttgttctagtattttagctaaattatcaagatcttcattacgttctgcaactaattggctattaatactatattctttaaaatctgcaaaataataatcacttatattatttttataaaaaattttaaacgtggtatcaaaacttctggtactgatttctagttctctaccaactatgacttcttttaattcaccaaattctgtctgagtcatttaatttctccgtaaaaaagtaaacaatattttgttatcttattatcatatatatatatatactataaatgaatcatataaatttttttcatattttttaaataaccatttattgatccctgattcttttgcaatatttagtaattttttaaatatctctgtattacgaaccattaattgaaaacccgaattgtcaacatccagcgtcaacttaattgaactacgacacccacttggtactctttttaggggttcataaaatatcgaattattttttaatttagttttatctaggtttttaacaatattataaattctatcataatcaagttctatataatatgaatcaataatattagtagctaaatctatagaataattatcttgatattcactaattctttctttattgagattatattcaatgcattttgatttagaatcattgtatactgagttggaatagcttattaattcaaaatttttattaaatttataatagaattcaaatttcatcgatttaacatacactccctaaaatcgacaagttcaaattttgtattttctctatttaattgaaaaataggatataaaaaacattcctttaatcccattttcgaacaagcccttttacaaacttcattacatctaatatttttaagtatgttattcataaaatcaaagcattcttgtgttgtatttttattaatattaatagtatcgggtttatctaaaaaataatcttcttgttcgttgcaaggcactagtatacccatatgatttaaataaattgcgttcattgctgcctcaggacatccaagcacttctgatttatcattacgcaagttatctttcattttaaaaaatttaagtaattcggttctaggctttacagatgcttttgggtctaaattaggcggctcgtaacaaggacatatctctaacaaatcaaatgtggaatttttatacatttgtttaatattgtcttcatcatctctattgtaatcaaattgtatgaattgcattattgttgtagcttctgaattctctttgaatattttatgatgttctaaaacatctgctagcttagaacctactctatacttagaatgcaattcttgcgtagatccgtcaacaggaaatctaattatatctcctttcttcatagtcttgcctagcctagcccaatctattttagttgacccatttgtacttaaacgcaccttgatattcctagtattcatatattctaaaagttcaaatatatgaggatataatgtaggttcacaaacagcacccattaatacaacacgtttaagattaggtaaatcatttaaaaatctttttagattatttaaatctaaatgatttactttcattttaaaatctatattttgtcttaaacacatagggcattttaaattacataaatttattaacgacaattcagcaacttcaatatcttctggttttaatgttttttcagtatatccatttttaaaaaaatttttaatataagttggttgagtagtaacaatcataattatccttaattgtcatctatggttaatctgtagtggttcaaaacttcgaatttatcaatgtctagtctcatttgcaagactgggtaatcacttctgatttttttattacaatcaccacaacaacgtatgcaagttttattcattttgatacctttagttattcttgaaatttgttctatacattcttcaaatgtactattatgaattgttttatccaagaagttgaaagcaaactcttccatatcatcacaaggtaatatatgtcctgaatgatttatatataattgatttaaagaatacataaggcattttatattttcaaatggtttattattaacataattatttaattgttcgtagcgcttgcataatgaattagaagctctaatttcgtcgtgtataaaaatagtatcaccagtatgtgtcgtttctaaataatcaaatttattatgttttgataatttaataatttcatctatatcattttcattatacttaaaaattataaactgatttattgttgtagcttctgaattctctttgaatattttatgatgttctaaaacatctgctagcttagaacctactctatacttagaatgtaattcttgggtagacccatctgtcgcaaatctaattatatctcctttcttcatagtcttgcctagcttagcccaatctattttagttgaaccatttgtagacaatatactttttatattcctggaattattatattctaaaagttcaaatatatgtggatataatgtaggttcacctacagaccccaccatatcaatacgatttatatttttaaaattatttaaagtttctattaatttttcgaagttcgtatatccttttggtatagctatatcgatatcattagcttcttgtctcaaacacataggacatctcaaaatacatttatttaataaacctaattctatagttttagtttcatctactatgttgtatttgttcatttatataatccttaatatgtttagataaattatattttttagaatattgtatcaaaatttttaatttattttgagatttttctggttcgtaatgacaatgataaaaataagcatcttggatagcctcgtattcatcaccttctatgctacctatttcaagtttgttaacaccttctatataatttacgcacaattcttcaagcaaaggatattctaaagaattgagtgatggattttttgttatatttaattcatatagtttaccacattctttataatttaataatttatcaaattgatttaataattgatattgctttttataaaattcatcagaaggtttagatatcataatgccagtattatacaatacaccttttttagattctaagtacttatgtgagccttgtgtgtgaggtgaaactgcaggtgttttaaaattatctaagtcaggtaatgctctcaatagcatcatatctaaatctattctaagcataactggattaatatcttgaaacatactttcgaaatatataccacttagtgggatattccaaaaaccacacttatgattttttattctatcgtcaaatgaatgaatataattaatattcaatttctcaaaataatatttagtttgattgcttatatcacatttgtttaaattcaaacaatatatattaccatcaaaataatcacgtaaacatttaaaacaataaattgcttctttttcaaaatatctagtaaatattttgttggtcgtattaacatcttttaaatctggttctatagtagtgataacaatcatcaaacacctttgtttaattatatataattgtaccttaaagattaataaatttatgtatatcttttcttaataatatctttgtggtatcaataaaagcatacatatcagcacaatcttgattacaataaactttattatcatctgatatatcactaagttttttaaaaaattttataccacaagaatatttaattttattgtattctattgtaataaaattattataacaaaaactacctttaaataatttatatattttattatttaatatatcatctattgataaattatttttttgccgtcaacatctaaaattatatctttatgataataagaactggaatcacctaatattttagagtcaagtaaataatcatcattttggtctttcactaatgtgaaatataaatcatattttttacaccacgatgccatttctattgcttttttatgatttttataattatatactatatttaaatgtatagtatcctttaaattaagtatgttatctaacttagatttttgtttttcgaaatattcactatgtaaagacatagatataaatttaaatctcttgaataaattatcattgctgagtaacataccattagtatttaattctaaagctatattttcatttaaactttttacaacttcttcgaaataaggtaaagtagttacttcaccgccagtcattataactttgatcttgtatcgtaaactaaaatcattaagttgttttgcaacactcataatggtatcttttggtattggttttctaggttttgatgctctaaaacaatatgaacatctgaaattacattcgtcagtcaacacccactctatatggaaatcgtagtttttataatcttcgttaatcgagtaaattttagtcatattaaattagtcttacttctagttatcctgtgcccagcgttatattcttcgttttttaattctttagtaaaataattcatttctaatctgacaccgttttgatctatcaaaatgtctggatatttttcacccaaagtataacaatagtaattacaacaactctggcaagtaactccacatttcggctcacaccaacgtgtgtttaaaaatttttcaatatcgctatcagaactttctatattaacacccgtatgaacttcatcttcatctaaagaaccacatatgtttatattacccatatgattaacgtaaatttcgtgtctgttaaatgaatcgcatataacactgatatctttttgtgttttaagtaatttctcatagaaatccatatattttttaatctttgttggtggattaaattcactttgattttgtatgctagtagggtaacacttcaaataacttaaataatcaaacttttcttttttaaataaattataaatattttctttatcattttgattgtaagcaaattgtatattttgtaagacagtaataccacgaaaatctggatttgattttaaacttctatgattttcaagcactttgtctaatttagaattaactctatacttagaatgtaattcttgcgtagatccatcgatagcaaatctcacaatatcattagattttaatagtgaccccattttataccaatattcggtattgtgtgtgctagcgtttgtagacaagcgaatgtctatagggcgtgtttttatatactctaataatttaggtaattctgggtgtaatgtgggttcacaataattaccttcaattattataacttcaatattttttaatttatctaagaaatcaattaatttagagacatttacatagtgtggtgattgttcatatatttttttatggacatagggacataatacgcagcgcaagttacatctgttagacaatcccatatcaacaaccttaatatcgtctagtgtataaagcacatttaactcctaatgtttagcatcagaaccattacccacaagtatttcgtaattaatacctatggtatctatggtatctaattcgatattttttgagtgattctaaacacctattaaataattttggtctattgcgtgttaaaattaatatactcaaatccattcaatattatataaacaactttaatttatttatatattatacagctaagagtgatcctaaaaacaacactataattgtaaaaactacacacaataatatagcaatagttatagaacctatgacactgactaaatacgagaacataaacgtatataaaacaactacaaatatagctataaacaaaacaaataaccccgtaaaaaatctttctattaacttctcaaaagaaaactcactgaaaatattacaaattcgactttttaaattcattctaaaatcctttattaaaattatattatataaagaaataacttaaaagtttattaaactatatcatcgaaataacaaaaaatgatgcaattgcaaaaactatgcataatagcaaagcaatcataggtgagcctataacaacacttaaatataaaaatacacttaaatataaaaatgtcataaacatagttatacacaaaaagaatacattcaaacaaaatagtaccaaaatcttttcaaaaacagattcattaaaaattctacaaattcgactttttaaattcattttaaaatccttattaaaagaagtagaaattgtgataaaatcaaaaaaaaatgtaaaacataaaataagtcgttaattagcttacgattagcaaatgcgaatacggttcgtaatttgaaaatcttgagtactttcgtacccagattaatctaggatttatttcttatatacaaatacattccagaatctaaagtaaatctaaaatttttagaattcactgagtttaatttaatagttccttccatcacgaatatatctgcttgtttttcttccattaatttattaataatttttttgaatttttttggttttatagctacgtattcattatctttaccacgataacaagttatgataatatagcttttaccttgaagcatttgtattctatatttaaaaatataataatatataaaacctttaaaaatataagcagaatcattattatctttaaaacaatctataagtttcattaaactcctttgatatatttatgaactaacattaccagcactattggaatccactaataatgatattatagggtcttcaaggctcataaatctggattctaaatcatagtcaaatgctctcaaattagcaccatcaaaacaatctttatgttcaacaaactcataagggacaccaaaatattgacattcttgaaataatctaggttttacatcaaaaaatacaggatcttgtatatataacatttcattaaattgttcgaatatattagacataatatttaaatcacttctagttatttcagattcttttttaatgtattttgctctggtattaataaatttttgattcttttgaaatctaggtttattcaatatctcaaaaaatattttacttctataattaactgatttaccgacaggttttaaatgctcgtattccacaaaataattacactcgagtgtatgattttttgagccacttaaagcatataaattcttgcattttaaaaatggtttatatctatcgaaatgatctatacagtacatttcaaataaaattaaattattgatagacataaaacattttttaaatattataatattcttaaaacaatctttattaatattatatttaatttcaagatattttttaacaatctcaagagattcaaaagtagtatctattataagaataatatttttattatataaccaagagaaataaaaatattcaaaagcattcgaaagtgacccatctatggggattctcgatttgcaaggtcctattaaaatagcattcgtattcatagctttataagtctagtattttcagcctttttagtataacaagcataggttagaactttgatatattatcaacttctaaaaatttaagattaccatcttcacaaactgaaagatctccaagtctaccataatatatttttacattttcaaaataattttcagaaaggaagttatatgtatcggccatacttttaggagaagtgtttatataaaaattattagcaatacgttgaaaattattatcaaataacgttaattcaacatctttgcttatactttcactaaaagaaataaaatacatatattactccttaattagaaatttttatccacaaataacatttccagatccttgcgctacagcttgcccacaactaatggcatcacctattctacaagcaggttttgaattgaccataacagtaccagaacctgtaacaatgcttccaccgtgtggtggtgacgggctaggacttgggtgtggtatcataggatcaccttgtctaactgtactaattgaattagtcaagacattcgtagaaccactcgaaattgtattaggcggaaacgaagaatgccctgtactaaaatcaacaccaactctagttaaaggaggcattatttagctccgtttaacatatcttttaatatctctttatcagttttagatttagttttagcttttgatgctttagacttactttctttagctttagactcagttttaacatctttgactttagttttagttttagttatcccggcttcggtttcagactttgtatttaaatatctagttttggcattactagcagatattaaataatcatttaatttaatatgaacgtcaatacctttaatttcttctataattttattgcgagtgcatataacttcttctatacaaatagctactaaaatcaaagcataagttgctggctctacgacaaccttacctgctgtaattaaagacactatatcacaaataattgatattattagtattatataaaatgagaacttaatatttttgaatattttcatttaattcctttcattgaatttagtttagtttagtttagcttgatgactccagcagacatagtaatactaggtcctgctgaaattgtttcgctgccggacacatttatattctggttaccagaaattgttacattttcattacctcctactttacgtgttctatcagaacctacctctaacttttcgtttgacttaacatttaaattgtggttagcgtcatatttctcattaacgtcttttttaacgtattcattttgttcaccatcgatatgtaataaattattttcttgtgtatattcttttttattctttacagtattgatagtcatttcaccatctttattcatagtaattgtagtaccagttctgtggtgaaaaataatattaccatcttcgtcactccattcttcgtaatgacctgtaatactatcatatactctagtatttttaggttttgtatttttgtgtatttcgttttcacttgcaatgcagcctataacaataggtaagtttgggttattattgtctaaaacacaaaatacccaagttcctggtgttaatataacgttataaccaaatcctggatattttccagatcttgttatagttttgtatccagatttagaacctttaccatctatattgttggcatattcatcagaaccatctgaaggtgctgggtaataaccaatataatcaatactttgcataacttctgcccaaggcaaatcactttcctgtatttgattatatttagtgtccttttctccagaagttactgggtattggccaggagtagcattttcactcattccgtgaagttcaaatatacgaacttgaactctacctccttttttagggtcatcattattaacaacaataccacgatatattctaaattctgatttattcatcaggtacctttatgtatatttataacattttaagctgctagcacattctaaatactaaaatacttaagatgctaacagcattgctgtagtacgtttaaaaacatttaatgggtcaataaaatcattaacacaaactaattcaccctcacgattaaagaaaatattatccggagttaccatagttgattcgcgtctaagaatatcaaaatctctagcatcggtattgaaaaatgtttgcgatcctgaatttcttaaaaaatcattaagttcatcgaattttaaatcttttgtatttgtaataattataccctttgggttctttgtattgaataaataattgcgtgtagttaattctataaattcattgaattcttttagtgtatccttagatggttcttcataaccatattcaaatggtatagtactaaacttgtcaataatagagcctgagttaataacaatttttctatataaatttttattgtttataataaaatcatatttaattgaaccaaactttatattttgtgttaattctggatctaaaataattaatttaataatattatcaatagattctttagtatctataaaaaataattcagtacttagatcaaaatcatcggataattcgaacttacctggacttgtttcttcgtagtctttaaagaaacgaataatttgaatacttgggttgacggcaatattagataattcaattgcagaaatcatttttaaactcctttaaatgtttttttttacataacaaaaaaattaaagtcgattttaaccgtgtttttgagtggttataaccgtatttagattctagttttatattttagagccagacatataacactaaagtgtcgtatgcttagaactagaatctaaaattgttttattatataaaaaaaaaagcttaaaaattaattaaggagctgtaaaagctccttgaatttacattatgaaaatttagggtttaaaaatctacaatgcgattttggtgtttcccaatattcaactgctacaacattgacgtctaaatcttttaacattttttcagctatttctaaccaccacttacataagttttcactagtaggacaaaaatcaacgaaaacaaaaccttctaatttttcttgtatagcatttttatgttttgtttggttgtatttagattttatttcatcaataacagattgtttaatagttttatatccatattcttgagtatcgaaatattgtggatctaaaccatctaaagattctgaatataattctggtaattcgtggatatgacctggatcattaaaatcccaaacaaatttatgatcaataacttcatcaactagttttttataacaatttaaaaatttgaaatctaaaaccatattattgattagttcatctgaacctaagaatagttttattacgccactgtgcgaatgatgatgtctgcaagcacaaatactatcgatactatattttggatctaatgtttgagtccaaactctgtgacccatacaaaaatcaaattgtttgtctatagtccatttaaatgttttcatttttactccttaattttctttattataatataacaaatcttaatttctatttaaatttcgcattttcttagaacttaacgcaatatatctatcacgattagcataaaagatatccttatgtattctagtatttttattagttaatgtatcaaatactggaactacacctttaggtgcacctaagtattcaatattacgtttttgttctttaaattttttatatatagatgatggtaattttaaaattttaccgtctaacatacatttaatcaaagattcatttattatctcgtggtaattttctaaagaatcgttgaatatactttcataaatctctaattttctattataaacgtttacgcgttttctttcacctgtattttttacaacaacggaaactgtgccagtaacgtcagcatacccacattcacattcactattagctctattaaaataatcgtcgtttataaccacatttaattttttatgtagaaaagcttcgtaataaagtgcttctaacctgttgttaaaaactttaagtatttttaaactgtaattgtcaggattttttaaaatatcatttttctacagcttgaagaaccgtaactccaaaaatccgatatcagatcagtttgtttagaagttctaaatcctatgtattttttattatcaatatttgaagttacttcatatacataagatttaaatacttcatcagcttgatcaataaaattatattttaatttgaattcttcaaaatctaaattattcaattaaataatcctattgattccaaaccctatggccgtaacaacattcaaatgttttacttatattaaacataaaatctccttgtcttaatcattcacttcaatagaatctatattattagttccaaatataaattctccaatagcattataatactcagtatctttaataacacaacgaatataaccatcacttgaagatttgaaaatgtgtgcaccaccgcctagcacaaccaagaaatctagtttatccaatatattgctatatctttcatttactaatgctaaaatttctcttaagtattcttttttaataccttcaatttctttagtataatcatatttttggcctcttagtttataaacacccgtatctaagatttctctagcctctggcaatgaaatagatctgttgtgtttttcatttactaatttagcaacttgcgaagctattttcatcaatccgtgttgtgaaattccttcgaataattctggtgaagtaactcctttattaacaagaactaaatctaatgtattgaatccaatatccacaatacaatatgttgaatcacctaagtattctttttgaagatttggaaaatcatttccgaatttttcataacttaacttagctccagctccttgaggtaacaacattacattataattgtattcagtaccatcaaccacaaaatgacttagtacattttgaaaatatccagattgtttaatttctgcaatacttaatcctgaaactattaaatctactttactgagtttagcaattttcactgcgtgattcaataacaatggtccaaaatattctaaattcttataagtatctaaatctatgatattagaacttggtaaatgtttggcatcttcacctaccatataataacgttcattgtaatgaactatattatcattttgaacaccttcaagttttttggtttggcctataacacttggaaatttaaactttttaattatttgaccatcaccagtgcctacacaaactttaacaaagctgtaacctatgtctacacctaaaataactttttctgttttcattaatattccttgaatggatttacattattatatattaaaattacttaaaacaaaattaatttttagttttagcttcagtcttagattcaattttagactcagctttaattgaagctaaagtttctaaaccaaataacaaagaatctaccaaatcgatagtagcacccactatagcattcaacgcaaattttaaagtaacgtcgtctaatttttgtagtctattttcacctaacataagcatatcaattaagtgttctgtgtctaagagataatttgtttctgaggtgtttattatttcacaaattttatttaaattatttgcaatataaaaaataccgcttaaaactaaatctatttcttcttctgtataagcatctgggtttctcaaaatatccttagctataagaatagtttcataatctatatctaaagattcaatttcttcacttgatctaaaatattgatttacattgtatttaggaattttgtcctcgttttcatagatagattctaagtagtcttctaaataagatttcaatcaatctcctttaatttaaattttaagtattcaataaacgcatctaatctatataacttcagagcttcatcacttaattgatatttaaatattattaattcagctaatatgcaagctatatgatttttattatatagtttattaaatatatcaatatcaatttgtttaaataaaatagttttatttttatatgataatgtaagtatataactatcctctgaatttttattaagattgcaatttattggtggtataggtatacacaattgtgttaatagcattatgaacccttaaacttttaattcttacttaatcatttctgtataacatcttcacatcttctaaaacttgaactatagcttcgtgttttttcataccaccatcaataaccaagatatcaacgttattattgaatatctcacagaaatattttccttgatctttaccttctaacgattcttttaattttttaacgtccatagcaaacctttcattattctcattatcacattctaaatctactcttataccgcaagctcttaggaagttcattctttcttgcttagaatatttcgtaggatactcttctaaaaatttattagttatttcatcccaaaattcattcgtctcttcactaaactcgataccatcaggtataatagcaacaccactggcttttaccataaattaattcctttatcgagaaaaatattcaatcaccaacacaacagtcataactatagccataacaataacatattcggcaccaaacgaacactcaccgtatgtgcaataacaattagcatttaatgtacaattattgcattgtttatcacaaaattttttatttttattcattttagctcctttaatttattaatgtaattatataataataaacttaaaatatacttaattatgaattatcgctcatccagtctgctgttcttaaagcatcctcataatttttagcaaatatggcccctcctttatcaccgaaaacataatacttattaaatttaaacttatatgatatgtaataactaccctttgttgtgcttttgatttttataggatagaatatacacattaattctataatccattgtttaattttattcagagttaccttcctgtattgtaatttttgtaaaataacaatgctgctgcatctttcttttcatccacaaaatcattgcttataaatcttttatagtcattatgaaaaatagattttggattagcaaaatattttccataatctctatgatttataataaaatgatgtccatttaatgttgaataatctacatactcaatgctattgttttttaaaatattttcaaaatctgtcattaatatacaattaggtccaacattatctttgtacttgccttcaaaaacatcaacatccaaaattacccaatttaaatttctatcttgatctgcttctggttttgataaaacactatatgataatgcttggatctttttaccgacatctacattatcattattaataaagttagttaataactgatttactctatcatttaaatgtaacagagctttttcttagacttaggatttacattaaaatatgctcttgtatatggtatattattaacaatatgttcagaaaccttacaatatttttcaaaatcttcttcatttgaaatataatagtttgctattaatctttcattatgacttccaaaaacatttttaaaaatatcttcatcatcactaacaatagcatctttctttctactaaatatttttataatataaaaagtgtcatcattataaaattttaagaaattatttttaatgatttctttattgcttattaactgtctcattttatctcctttagtaaatcaccatcttcgtggatatttccaataacttccacatttttttctgacttaaatacttttaaaaaagatatatcgggctcagctttccttttataaatttcaccgacaaagtttttgctaaaaatttctattttagacattttataagtatcatctcttgtaatgtgataaagttcttcaagatcctcatattttaaaatatcaccttcatagattttatttccatttttatcaaaatagcctgtaaataattctatggaaaacgcattttcattattaaaatattcctcatttttccaattatatgggtgatctactgaaaatcctgcgtggtcataattctctatgatacgattacagttactagcatcgttatgttcggtattttcaatatataaaccttctgatgttttaatatacttcttttcaatattatcccaaatcctaaaatcaaaatcttttaatttcatttttatctcctccaatttattgataattatataataagcttagatttattttaattttatactttgatgtcaattaaaataaacaaactcagctttatgtttatccattgcagtctttacttcttttaggtcataactttctttagataattcacaaacgtccttgcaagataaagatacgttaattctatcaggatcttccataatataatcttttgaatataaaaagttccaaagattattaccataactatcacctttgtgggttatgttcaataatgttccattttttaagtcttttttaatatcttttttgtttttataataaaaagcagttgatgaagtcattttatctcctttaatagattatcatcttcgtgaatattgcttattacttccatatttacatatgaattatatactttaagaaaagctgtatcaaaatcaacttttcttttatgaattttattatcaaggtttctaacaaacctttctattttaaacgtttcataagcaacctactcttgtaatacgataaagttctccaataagtttattttctaataattttacttattggctttattggcttgtcttgccattttttcaactattttatataatcttttatattcgtctataatagattttatgatagcttccagatttctattactaatgtgagaaacagaaacataatcggattttaactctttcatagcttgcttgatttcatctatataatctttgatgatttctttgtatcttttcaattcttgtgattggagttcctctctataccaaggcatcttgtctttatagctaagtagatattgatttatattccatacttcgttcagtaagtcattataaagtttataatattgtttgttgctatgcggaccatcagcaagcttgtgtagaatttttaaagctttcttcccaagcgattctatatctttataatcttttttgaaggccagacctgatttgttattggctacattaatctccttgagcatatcatcaatagcagcttcattaataatggcttcattaataaatttcgtaaacgtcatttgttaccctttttaatagtttaattttatacataattataacagattaaccttataataaacttatttattacaaattatgtattaatatacttctttccaatattataatctatatactaaatcctaaaatcaaaatcttttaatctcctttccgtctttatcaaaccaattttcatttttaatcttctaacaattttttaatttcttctttttcttctttggaacaaatttctagtattttttctacaatttctatcttgtcagtattttttaaaaaactatttatgaatttttcttgctctgtataatacaagttttcataaattacaaaagcttcatctgctgtaacgccttttaactcatcggcgtaaaatccaacttcaaatttcattttaatctcctttgatttaatttatcaatgtaattatatagtaataaacttaaaataatattaaattagctagcagagtctaattttatttctaagttctcagtatttgtattcacttcaagtgtgctaataccagaatctacaaaagatttcatagtctctggttcttgttttgaatctttattaaaaatttgttcagcaaactcagttataggtccacgaaccacattaattaactcaccaccccaagtattaattatgctaggatttttaactgcattttgaagaactgttaaagcgttgttatacttattaatatattgattgtctatttgtgagtttgaaccaattattataactttacaatccttgtcaactcttgttaatatggtgctcattgacttagtagagatattttgggattcatccacaataacaaacgcatccgaaattgttctaccacgcaaagcaccaatccacatagtttcgataccagataactcaataatttctttaataccttcttgtatttttaaattatcaattttaacttttcttgatttattatcattagatttttcaagtctttttctaacaatatattctaaagaatcatatagtgggtgattaaaaaccgcaaacttttcgtcatttccagcaagatatccaatatcttcacctttatctaaagattcaattgagttacgtatataaacaattttactatattgtttttctttaactaatctgataccagtcgcaatagctaataagcttttacctgatcctgaaactgcagaaacaacttgtaaatctacattagtatctagcatagcatccacgaaatatttttgacggatattaataggtttgacatcttgtttttccaagtgtttttcgtctatgtaattaattctgtgattttgtatccttgctagttttttattaccatctttactctgtattaagtagttataattttcgtgtttataatctggatctacacttaaaatgctgctaagattttctggtaatttctcaacatcgagaactttaaaaaactctggaacttcattaaaatctttttttaaaccgaatgtctcagtttttaccccttcagatatagctcttatcttgcacatactatcatatgttataaaaatacaatctggatataacttagcaacttctataatttttctatcatttagaatattaataggttcatctgcgtgtttatattcttttttactagtaatagttacttttaaaagagaatcacccagtgttgtctcagtatagtcattgaatttattaagttcaatgacatcaagatttgataaaagtcttgcaaaattacgggcttggtatccaacttcatcgaataatgattttttagcatctaattcatcaataactgtttcggggattataatacgattttcactatcgtataaacgtgagagattatttacatcatctaaaatgatgttggtatcaacgacataagttttcattggagccttttgtcttttgattttatttatgatttaataaccttgagttttaaattacaaaaatttaaactttagttttagttgttttaaaagctttgaactttagtttagattgtttatatgttatgatattataatattataatattataagctttaaattaaaaaatgttttattttttagatttacttgaaacttttgaatccctaagcgctttcttatacaaagcttctgcagaaacacctataaaagtttctgttttagtttctataatttgtttcatattttcattaggtattttgactgctcttctatatattctgctattaatataaagtcttattattggaaaaaatccaaactttttgagcataggcttaattctataccaatctatatctaatggtttattctctttaatattctttttatttagtcgaaatatggcatttaaaagcatttttctcattggtatcgggcaccagtgaaaatttatacctaaggtataagatttagattttctgagtaccaggcacaatggagttctatcatatttaacactggtatctttaggattatatttaaaaattactaaattaccaggttttaaaatttgtcctttttcaaccgatttggttttaataagatttttaactaactttaaactatccattttctgactgttttgaagtatttatgagtctggatttccagactcttaagaattattggtctacagaaactacgttagtagcagctgatttaccatcttgtggcatattaaattcagatccattagaaataatccaatctgagaagctaaatgtgatatcacattcttgtaatgtatctaattgatcagcaccaacactaatttcaccaacaccacttggccagcagtttcttaaagtatattcagcaacttcattttctaatgaatctaattgacaaaccgaaacttctgtaaataaacctcctggattaccagaatgtgtatttgcttggaagttatcacaagctttcatccaacttaagaagtctttacgagtttggtgtgcattatccatataaaatgtcacagtccattgtgtatcatacgaagtatcaccaggtataggaagctttcttccttggttaaatacttcaatttgtccaatagttacacctggaaaactagtagctttagctaagcagttcaagctttgtaattccattttatgttgcacttctgttggaaatgaaagtttaacacggtattttgtagcttttgcaccagattttagtgcgtttttaatttcttcaattttgttagacataactgttaaaccattcctttgcttttgttttatttattattttgatgatttttatggtttaagattattttaagttctaaaattaaaatacgacactatagtgttaaactttacactatagtgtgaaatcttctgataggagcaagtaatggtccttcaaaaatataaggatagaaaagatatacgagttctaaagaatgtcttgagtttgtggtagtgttctacctcccagtccttcataaaaatattatagaagtatccacagttcgcttatcgacatatgtcttagcaaggtagagactattctgaacattgattagaactataaagacttccggtgtgctaagtttatactaacaaattcccgattaaataagaagtatgtatggtgttctgcacataaaagtctttatagttctaacattctaagtttagaatttaaaactaaaatataaccaaaattgtgagcatctctctgttcagatttttaaactttttaaattttttaatctttcaattaagttacattgcaatctaaagaaaaaggagcacattatgatgattttctctgtcaggaaatccgaaatgctcacaattttggttatattctaaatctgtttaacaatgatatttaaaagatctaatttatttatatttataattatatactaagtatccttaaaagttccttaaattttcaaatcttttgtcgataattttgacagctgctttaaatctttcgtctacagaaccacttaaattaactacattaataccgtaggtatctatatagtaatcgtagtaattactacaaatatttctaaattctaaatcagtagatctgacaccatccggaactaaatcaaattctggtttaatataaaaaactatatcatattttttcattaattcaatagaaactatttcagctaaatctaaaaatacatcaggtattgattttttaatctctactaaatacttagtataaactacagcatctaatattgttctttcgtatataccatctttgttaagatcttctatatgaatttgcaaagctgctttttgagtttccatatcaccatcttcatttatattaaaacccaattcttttaattttcttccaggccctggaataatatccaaattatatcgttcttttaataatttggctatagtcgtctttccagaacctgaaactcctgtaaatcctattttcatttaaacccctttaaaacctaattttggctatttaaaccatatcaaaggccattaatagttctaaaatccataatatttaataaaatagtattggcggaacctttataatctataagatctactaatttagtacttattttagttcttaaaccatctttagaatatcttacattatatataccgtgaacaattgggttagaagtatctaaagatacaatctctggaatgttcttataatttttaaattcttgaggaacttgacaacccaataaatgtattttagaatcttttaatagatttaatttatctaaatgttttataaaatctatccttgcttgtgttaatttagcttctttagtatcaccttcgtattcatagaagtagtctcctgaaaaacaaatagctaccatatctgcattttctttcataaacttaaagcaatctgttaattcttctaaagtattaccttgaacaacgcctattttcttaccaggtatactaaacttagaaaagtctctaaaagattgtattgttgcactagcattacctaaagcatcagggactatataatagaaattactaggattgatagaacctaattcatttgcttctttagcaaacttatcgtgatcgtataatgttcctaattcaaataaagaattatctaaataaactgttctacgcttttttaatgaatctatgtaaaattgtttgtattctgggtagatttcaaataaatgaactaaagcataatcataatcattaaacgttcttgatttttctaaaagacttaacggaacttcgtgagaaacaagcatataactcctttttgtttattatattataattgaacttaaagttctatgaatcttatgttaaaaactaaaactctagtttaaattattttaaaatttaagcttttaagtttagaaccaaagtctaaactctattgaatcgaactcttcataagtaggtattgcaaaagatttcatcatagcatccacaacacttttattaattattttacctgtagcatttcttttttcaagtctatttaatatcattgtatatggtgttaaaaatactactgctttcttatgataatttctaaccaagctcgaagtagcaaataatctacgcctcgatttaatcgaagtattcgttttatctattaaaatattttgattcttttgaagtgctcttaaaaacttatcattaaataaagaatcgatttctttttgatcagaatctgttaagtttctccaaatatctgaatattcaacttgattgtattttttaaaaccgtatctcattaaaatatcgtctcttgatatagctgctttatcattcatataaacataagttgatttaccagaacctggtaatcctactaatacttctaaaactggttcattggcaacattagatctatcataagcttcaatatttaaatcgggaagttcttttggaacttcagtgattctacctaaagcatcagcaactgaaaacttggataataattttaaatctctataaacataacgttttttaagtgtttctaaatcgaatttataaatgtcgtgatgggctactattttaattatatctattatttcttgtttggttagatttaaatccaaatcgtgtaaaacatctaatgcaaagaacacaccagcattttcgtgatttaaaaaatgtattttttctggattatttttagatggtgttctagttattattttaccaatatcgtgtaaagctgctcctaatattaatactttataatcaggatcatctttatataattcgttgactttggccataaccatttcggtgtgtataccaacgttcggttctaagtggtatttgtttggtgtattttcagtgccattcaaacatcgatataaagcatcaatatatttgtgatttaaatcttttaagttcaacattgttatctcctttttgtaattataatatattaaagcttaaaacttacttaatattttaaaatatatctaaaaattttaatatatttttaagttttaatattatataataatattatttaaaaataggatttaaatgaaagtaacttataaaaatataacgatagatctaaacaaaactttcaaagaaatactcattgaattaaaacagtatccactttatagaaaacaaattattgatattctattaaaagaccctaaatataatggggaatttcattcaatatacaaagactacaaggatttacaaaacaatcctaatttttgtgtaatttgtggaactaagacaaggacacaatattgtaaagaatgtctaaaatcaccagattttaacaaaatacgcatagctaaaatcaaatctacaaaattagaaagatatggtgatgctaactacaataatatagataaacataaagaaacaataaaagaaaaatacaatgtagaaaacgtatcacagataccagaagtaaatgataaaattagaaacaccaaagccaatacagattataccgaaataaacaataaaagaaaagaaaccaatttaagtaaatataatactgaatatgcgacacaaagtgaagttgttaaaaataaaacaattgaaacaaatctaaaaaagtttggagttatctgtaattctcaaacaaaggaatttaaagaatccgttcgtaaaacctgggattctaaatccgatgaagaaatacaaagaatcgctgatcaaagaaaacaaactaatttggaacgttatggttatgagtgtggtaataaagatttaattatagaatcttggaattcaaaatctgaggaagaaatcatagaaataaacgaaaagcgaaaacaaacaaatttggaactttatggagtcgctagcccaactcaaagacatttaaaaaataatgatttactgcacgaggattattttaagactttcataaaaaatgaaagatttgatgcagacgcctgttcaaatttttataacttaagcccgacaggtgttctaaaatataagaaaaaatttaacgtagaagaacctaatgttactagtatagctaaaacacaacaaaaaatatttgattttattaaaactgatataaaaaaatacaatgttaaaaatattataaagggtgaattagatatatttttgcctgattataacttagcaattgaatacgatggtttattttttcacagtagaggtttacataaacatagaatgtttaatacacctgattatgataaaaaatatcatttaaaaaagacagaaatgtgtgaagctttggagatacaattatttcatatttttgaatctgatgatttagatatatggttttctatgattaataacaaactaggtttaaataaaaaaatttatgctagaaaatgtattataaaagaattaagttataatgaagtagttgactttttaaatgagaatcatttacagaaatcgacagtttcaaaaattaatttaggtttattttataataacgaattagtagaagttatgacatttggtaagcctagatttaataaaaactatgaatatgaattaataagattatgcactttaaaatattgttcggttataggaggagcttctaaattatttaagtatttcttagacaattataaaccaaaaagtatagtaagttatgctaatagaagatttagtaaagggtcaatatataaaaccttaggttttaagttcgtagagaatactgagcctaattatttttatttcaaagatttaaaattgctggctagacatcaatttcaaaaacataagctaaaagaaaagttagagattttcgatcctagtctttcagaaagtgctaatatgatgctaaatggttatagaataatatacgattgtggaaatatgaagtttcagtggatccaaggatcgtaaaatccttgaatcttttgtaaattgaaccttgggtttagcttacaacaatgctgaagtcgtttgaaccgacattcgtgaatctgagatgaatgaactctgcaacataagtcggcttaatatatacgtctatgacgagttggttcgctgcaactacacttgctggattgtttgatgcgtcacatatcacaaggtagtcttggatcccgcggccagcttttacttgcgccaagaaaggtttgataatacttacaaggtaatttcttgtaaaactatcattgaactcaaatagactatacttcgacatacgccctaaagatctttccaaatggttaaacaagctaacaacgtttacacgatcgaagcttgaagctttagtttgtaatgttttttgaccccaaagaactgcaccagtgtttggaaacataactactggatttataccattcttgtaaagtatcattgtgttcaacatcgttcgctacgcgatgtccgttcgaagtaatggtaaacaacgaactgctttaactttcgttaaagatcagactatatcttgctcatatcataatgacttagagcgccccatttcgaattcgcttgaattctactctacttggtgtctataagaccctttcgatagtcgttgaacgttctcttttaaaaaaagagcttcgctgctgattagcatattgtaaagtgattaaaagtttcggagttttaatcacaaaatgcaaagtagaatcttttttaaatagattcaatttatttatttgttctacataaaattgaatcttttaaacaaattcaatttatttattttgtattatataattatagatatcatctatttcgatatcgcaccttctatttttacttatattttcaactgctggtataaatcttaaatttgatatgttatctattaaataagcgggtatattattgataaatcccatttttatagagtatatatgatctaaatgatacccattgtttttcagagttcctcttttatcataattttctaaagtttttaaatcgtttttattagtatatcgccaaacaacgcgtctatagtactcgaaatcaggtaaatcttcgggtttaggccaaacaccactttcttgcatttttaattctgtgtctatcatagaaatttaaaccattttcatctttttcgagattttgtatttgcatcctatcatagaaatttaaaccattttcatctttttctaatttttttaaatgtacaaattgataatgatctataatttcaccgttatattcaatctttttatttttcatagtttttgcagctttgatagcggcatttttaataatttctggattattcttataagtttcatttcttttaataatagctaatttaaagacttctttatgttcctgatatgctttcttagctatattgcttagatcttcgtgtgtatattttttacgcttggtttctttggctttgtttatagcttgctgtttttcttctggtgatttatttttaaaagtttctttaactttttcactctgtgattttgctaatacattggacatcgttgagttcgcgtgtctgcttgaacatccattagaaaacccttctctgagatttctaaatcttttcttatttccgcaagtaggacaaactaaatcaataggctttaaatcttctattatataataaactcgttctaatatgcaagcgttataatcgtctaagaattcagtatttttatatatttcttcttttaattctttgataaatttactattacgagtaaaattttcacagtttggatatttttctttaaattttttaatttcttttaataatttatatctaatagatatatcataagaataatttaaatttaatttagtagaacattttaatttaggtgtttctacaaatatgatcaaatgaggaagctccgacctttcctcatttaaagttaatttttgcattttattcctttggaaatattacaacttagccttccagcaattaaaggcttttttcaagttacgtttccgtaaccggtgacatacatacttttattatattaaaagcattttgttgctatcacgcatcgcaccagttgggctatatgccaacgcctcgcagtttttaatgagacctctgttaagaccagcagctgcataccagttagcttgattataatttgtttgagctttaagacctgcaatatctgcagctaagttcagccatctgtaaccaccaagctcagcacagtattgatatttgtaattgctacacaaagttacatatttagaatctatatttaaagattttctaaaatcaagtgttttttgattagcaattgtagatttataacccactgaacaactttttggtgcacccataaatgctatacagtcaccacgagtaatcgcaatatcagtagctgcttttggataagtttcgttacaaattaagatatcaacatcgatttcttctttgttgtcaaaaattgtataagcgtctataatatcgccaatacctggagctgaatccataccattttcaagtttaagtaaatcttcacctaaacaagtttttggtttaccttgaactgcttcatttacagaaactaagatatagcttgacttgccattaatcattgtttctatataagtaaattcatttttctcatttttatcagttaagcctaagcttacaataaatgattcttgaatttcgtttgcgtagataacaataacagcaaattgatcaccataaggaatataatcaaattgagaatctaatggtataccatcagtgatatattttcctttgttgaaatcatcagggtgtgcgattgcgacatcaattttattgccccactctcccggtgttttagcaaatatttttaattttgcatctttataaacaaatggtttagataatttatcttcatcaaatgtattgaagttactaatggtatgatcataaagttcatattctgacgcatcgtatttggtttcagaaccttctacaggaacttcaacacaagacgatttagtagccttaactaaataaactggaaaacctttagttgcttcaacaatagcttcagaatcctcagttccttcataagtaatatttgtgaaagcttcaccattgactatactgtcagagattgctaagattctgaatcttggatcagttaaaacatcagaaaatgctataatatctccgcgttttaattcagtgttagcacctctaagacttaaaatataattagaatctggttgagattcaccttccattaagtatactgaagtgtctgcatttagttcacctggttctttgtctaaagtaacaatagttacttcttgagttataaactctggtatatcgtagatatctgccatttattatcctttcttagctttagatttttggttagctctaccacttggatctgcatcttcggctttatcaaaactgagagattctttgttggtaattatgtcggaaatttcaggcaaatcttcaattgttactgatatttgacttgaaaaatctttatgaccttcttttgaaactgttacattaactgtagtgtttcccgcagctactggagtaatttttaaaatattgtcactaacttccaaagttgcaacttcactatcttgtatagtagctttaagtgtagcagattctggtaatgtagcagttactgtttgaacaccttgattaattttagctgtaactgattctgggctaaaagatactccagtaatttctggtaagtcaactgcttcagtaacggttacggttatagttttagtaacttcagtttttccttgagcttgagctgtgatttcaattgtagtggaacccactcttacaccatttacagttttcttatcactttcaatacttgcaatacctaagtttttagaaacaattgtataatcactagcatcagtgtcgatatttaacacaccttgctcgccttgaattatatttaattgttctggagaaacaatcaattttgtttgttctttttcttgaacgtcgaattttaattcaaatgaattagttctcgaaccttctttggtagctttaaaagttacaatagcagtccctacttttaatgcagttaaagatttattagatttgttaacaagaaccacatcaggtctatctgtttctacagtataagattctgcatcggttgttattacgtagctaacaacttcatcaacataagcacttacttggcttgggtccactactaattgggttaatggttgataatctggatttggtatttgcttaacttcatttctaacatatttaattttatattctttattagaatcgttgaatttaagaacttggccaacttcgaatttatcagttttttcgaatttaacgtctacagagtcagcttcgataactttaacaccttcgattttactagcgttaacatttgttttatatgcattttcttcaaattgtaagccatctaattgtgtgggtgtaccattgatgtctgctgcacgagaaacataaattgcaccactgtaagctaagaaattttgaacttgataataatcattataattctttgtattaggcataccgtaattatctctgagttcttgaacacttgagattaaagtatgtacaccaactggtcctttctcaaaatcaccaccaaaaacggcagcagagtcaccttcaacaggcgtaatttgagattgatctacttcagaaacctggataccagggctaagtaaatttgccattttaatccttttaatatgatttgatattacaaaaagtctctcgaactgcatcaagcttcgttgttgagctcttaaaccaatttcgatgcctttaggctaaaacgactaaagtatattggaatcttattatttatttaaggatttaaaaattgaattttaagagttttttcagtttatgtattaaaaattagattggggatttaacatccccaaattattgaagcaattaagctaaaatagttcctgttaaatctacaccgaatgttcttgcgtaattttctggttcaagtggattagtagctaagccatatcttgttcttgcaatcatacctggttgtcctgattcttgattcattactttttggaagcttaatggtacatatggacagaagaatccgagactatcttgagcggttgtacccttataaagaacagtgatataatcagatttagcatattgatcaacaattacattatatctaccatcataagtccctacattaccagtaaatacatcagtagctatattgcttgaactagaagcaaatttaaatgtaccgatttgatctaacatagtagcaacttttggagatacaagcaatgtattacctgaaccgcgtcttgtcattaacccgatgtttcttgcttctaaatctattttgatagcattacatctatatctttcaatttcccatctaccagcttctttgtgttcagcacctggacttaaagtatcagcgacaacggtagctgtattgtttacgaaattgataatctcacgatctatttcagtttgcatttcagcagcaataagattagctaaatgttcatctgcaagcacaccgtgttgattttttaaatcttcatacatttctaaagtatattcagctttaagttttcttgtttttgcctcaacagtatctttttcaattccaaaacctacagtgttcatatcttcagcaagtttttcaccgtcagctgtactatatggtcctgaataagtttctaagattttatggaaagtagcttcgttagaataaacgttaacgattttagttcctttattagcagcttcgttttggaattttttatcgctagttaactgaactaaagcagttttaccatctttttcaacgtgtataattttacctgtcgcacttgaagttgtacctgtaacagtatcacctttagtcacattagcttcaaacacaagaatttgagctttagaaactggagatatagcaccgtcttttttattacctgtatatctattgactaatgcataaatgtaacctgtaggcattgttaaaggttgaatacctaaaagttgattagcaactaatgctgggtaaacccttcttacaattggcattaagattggtgtaaattgagcgatatcactagagataacactttcacctacaagtgcaccttgagatgctaaagcagtgttgctgagcaatgtactcatcaatacagcttcactttcatttaaagcagcgtattttgaatctttaatataagactctactttttcattaagacttacatttttatccattgtttttaaccttttaattttttatatatttattttttaactgaattttaactgagcttgttagttgaacttagtagttagcccagttaatgtcagcgcctgctttgtttttaaaactttctttgatatcctttgaatcctttgaatcctttgaatcctttgaatcctttgaatcctttgaatcatcagaatcatcagaatcatcagaatcatcttcgtttgtttttttacaagcttcaaataacgcttctaatttagattcaaaaccttcacctcgttctaccaagctagctaattttttaaatttttcactttctacaagatttaaattagcagctaattcatcaatttttttagattcttgaagaatcgcaagttcagctttaagttctctattttcaacaactaatttatcaaattgatcacttaattcagaatctttgtttgcataattttcgagtatgtttgatccagcaacatctactaagttatcaaatatacttactagagtagcagccttttcattctcaacaacagcgtctaatttttcaagaacttcgtctttaaatttataaagttcttcattaatgaatgaatctatattttcagtaattttagattcaagttcttttttagcttctttgaactcttctactaacttgattttttcgagttcgatttgttcattagctatttcaacagctttaatttcaacagcttcattaaacacagattcaatttctgatttaactgattctgttagaacatctttaaagctatcgttgcttaaaactttgtctaacatttaggtacctttctttgaatttttttatatttattaaaatcggtttaattttgttttaagcttattttttgtagtgttggtagtgtcagtagtatttagtattggcagaatcgaagcaaatatcaattttaacaccaagtgtaatttatgatattgcttatatacataaaattaaaaatcatcactaaaaacagtttttttaggacttttatagaatttatatttaataagatttgcttctatataatcttttaagtatgcatcctctgatatcaaaaaaccaagttcttctaaagggatatcatttaaatcacaaaaatcttgcattatttccataacacattcatttttatgctctcttaaaaacttgtagaatttatttaatgttttaatttcctttgctattaaatcttggctaatattcattttgaatcacctttagttagatttacattaaaatgtttataattacttagaacgtttttaagttcagcgtaatcatcaaatgatataaaaccttcattgtatctaatattaatatttttgtatttgatttcagtggtatctaaaatattttcaatcatttttaaattaaaattgggtattgtgtaatctacatataattcattaacaatatctatagttgaagcattcctagattcattatgtatatcatattcagaattatacatacaagctaagttttcaagttctttatcttttttgtttttctcattgataatagctaaaatactattatgaattatttgtgaaatataactaaaacaagatactgattggtttgtaattttagattttaatgtatgatcgaagttatgaatatatttaaatacacgatagcaagcatcactataaaaatcatcttgccaagtatacccggaaaaattaggtttagttaatatttttttaatcattagaataacaatgttaccaaaatattcgtgagattttggtgatatttttacaccctcggatatactaataatatagtctttaagatctggatcttttgttttaatatattcttttatcttaatgtctaagtcttcatttatagaaccatcaggatcttcagagcctagatttaatttgaagtttttttcacgaatagctagcgattttagttcaagttcgttagtataatcgtgtttcatacgagtttcactcattttaccacctttagattttaaactttagttttaaatttaaatattaaatataaattaaatatatttttaattagctaatagttcagcttttttgaaatgctctaaagcttggtctgtattaccatacaaatctctgaattcttttaaatacatatcaagagcttcttcacacccaggtccaaaaattctgccagttatttcaactgctaaatcttcattatatccaaatttttccatagttctgagtttaatgaattgaaaaatatatggaactaattgctgagctttttgtttttctggagataatggtcttcttgtgtatacttctttagctgctttagcgcgacgttttttacgttctaatagtaggcttgtaaatctattatcgaatttacgttcgtgtttgaataattgtggtgcttttttgccattttctacaaaattattaatgatgatttgttcaaaatcattgaaaggttttttgttaacaattttagtgtataacttgcgtaatttttgtgtattgagaccttttttggttagtttcgtttcaagctcttctatttgtttttgagttttaagtcttgtattttgtgtgaataaacttgaatatctaagtcgtttgtaatccagcttgaataaattaaactctacttttaaacgcagatatgtgttaataatatcttgatgtttggtatacaatttgtgtttgtaagtcagtttcattattttcctttcaattggtatattatataatatataagcttaaaaaattcttaaatttattagaatggtttaaatatttgcagtcttctgtgttgatcaaacaaaaagccaagcattttttatactttttaatattgctttaagttttaagcatatgctaggatataatactatagtatatactatgacatatccaagcattttttatactttttaatattgctttaagttttaagcatatgctaggatataatactatagtatatactatgaaatatccaagcattttttatactttttaatattgctttaagttttaagcatatgcaaggata

SEQ ID NO: 18 - DNA, 36240 bp, Camplyobacter Phage CJLB-15
tttagtattatccttttcgaaacaaatgtgagccagttttttacatagcattatacttaacctactaattaaccaaccaaaacataagcaaagtaaggtaaaatctttatttgaaatttttatttttatcaaaagcgttctaaaaaagccaaattttgctttaaattaactaacacgcattttaacgccttaaaatatcattaaaatacaaataaaaaaaggtgtttaatgcaaaaagaatttttaaacattgatgaggttttgcaaattttaaacattaattctaaaatttatttgagtagatatttaaagaaaaatggtataaaagtattaaaaggaaaagctaaaccctatccaaaagatgaaattttaagacttgctaaaaaaagacaagatgaaaatcattgcaattctaaacaaaacgaagttattttgtatattgatgaaaattcgataaaagaaaagccaaaggcaaataaaacagaacaaatacaaacgcaagatgattttaagcctttaaatttagaaaccatagagcaagaactcacacaaaaaactatcaaagatttagaaaatttaggcatttataatcctttagaaaatgatattattaaaacttatgttaaaaatctcatttttttagaatgcacaagcaaggaaatggagaaaaaaggttttacaacaagcacagataaaggaacgcctattgtaacgcctgaacttatagcttttaattctttgactaaaaatattataggcttagcaaaagttttaggcataggctctccaaatcgtgcaaggctaaatttaaaagataaaaaagaaaaatcagcttttgatgtgcttttagaagatgaaagttaaattatggataaattaagagcaagagaagatatattaaattacgctttagcttatattaaacaaaaaaacaaagaatttgaaaactcgcccttttatattgatgagaaaatagctaaaaaagcggttttatttatttctcttttaaagcacaccgatggcgaattagccggtaagccctttcagcttttaaattttcaaatcgagtttatcatcgatatcatcgccacttattctaaggaaaaaaacgccagaagatactcttacgctttgctttttatcccaagaaaaaatggtaaaacagagttaatcggagctattttgctttattttttatttattgataaagaaaagggtaaaaaaatatattgtgccgcaaatgaaaccgaacaagcaaaattagtttttaatgctgcttcatctatggtaagccaagaagaagaattaaataaaatgtgctatcaatataaaacctatagagaaatccgtaagaaaaacgctaaatttgaagattttataaaggttctaacagctacaagtgagacaaaagacggcttaagaccttatgtttttatttacgatgagcttcacgctgccaaaaatggggatttatataaggttttagaagaaggaacggcaagtcgtgtaaattctttatgtatagtcatttcaacagcaggatataatcattttggagagatgaaaaagcaatatgattattgcaaacaagttaaaaatggcattataaacgacccatcaacttatgcaaagatttatgagcctgatgctgatgatgattggaacgatgaaaaaacttggatcaaagttaatcctgctttgggttatggcgtaaagcttgaaaaattaagagaatattatcaaaaagctttagcaaacgcaaatgatgaggtgagttttaaaacaaaacatttaaatatatggacttcaaatgctacttcttttataaaagatgatgattttttaaaatgcagttttaaagaacttgatttaaaaggcgatgtttatgttggacttgatctatctgctaccactgatttaactgctttagctttaatttgcgaagtggataaaatcttacatgtggattttaaattttatgcaccagaacttagtgcaagagagagaagtaaaagagataaagtgccttatttagaatgggcaaaacttggctttttaactctaacgccaggtaatagtgttgattatgactatttaattaacgatatcttagctctaaataaaaaattaaatatcaaaatgataggttatgatccatggaatagtttagaagtagccaaaaagttaagcgatgaaaatatagagtgcgttcagattagacaaggttttgcaagtattagcgaacctttaaaagaataccaaatcagagttttaaaacaaactttaaatcacaataacaatcctatttttagatggtgtaattcaaatttagttattgatcaagatgcaagagaaaacataaagcctgataagaaaaaatcaagtgaaaggatagatgcaatttcggctttagtcactgcaatcgccactaaaaacagcatagaaaaaccaaaaatcaatgtttatgaaaaaagaggtataaggtttttatagcttaataaatttagaagtaaaaatgagtaaaattatatttttcaaggagtttttttgataaattgtaatgataaatttgataaatggaataatgaaaagaaaaaactacaaataaaagaaaataaaataataagcataggtaagatttattgggttagcataggacaaaatataggcagtgaagtttatggaaaacataatgacttcaaaagaccggttttagttttaaacaaaatatacattgaggattatgttaatctttttgttggcgttccattaacaagcaaaatagaaaataaaacaggttttctttatcatcacttcacagatagtaaaaacagaaagcaagtagctctattatcacaagtaagaacctttgatactaaaagaataataagttattataatggaaaaatcaaaaaagaagatttagaaacaattagagaaaaaataacaaagaaaataatatccccgcacatggcggggtaactcgtaaatgagccaactctccttatcagaagaagtctaaaacctacttttaaagttttacaattcttatgatcactgagaaattatatcattttttttataaaacgcactttaacgcctcaaactttttttaaaataagtaaaaaataaaggttttgcatgttcaataaaataagatcattatttacaaaaaaagcacgaaataatgaatttgttaatagcttagaaattttattagaagataaaataaaagctgaggaactttcagcagtaattgccgcaatctcaaatattagcgagaccatagcatctttgccattaaatttatatcaaagaacaactgatggatcaaaactagcctctaatcaccccttatatgaactcatcaaaatcgcaccaaatgaaacaatgacaccttttacactctttgaggcttttatggtacaaatgttaatttatggcaatggttttttatatcctgttaaaaaaagaaacggggtgattaattctatagaactcatagaaaataaagacattaatatctttaaaatgaatggaaagtatttttatcaagcttactcaaaaaatggcagtattgttttaaattatgatgaggttttaaatgtgccttatcatactaaagatggagtaaaaggtatcgcaccgcttagaaaaagcaaaaataccacagaacttgcaacagctatagaacagcacggacttagcttttttaaaaatggaagttttacaagtggcgttatatctgtaccaaatgaattaagcgaagaggcatattcgagattaaaacaatcctttaaagaaaattatagccaaaaaaaagcttataatatttctattttagagggtggagcaagttatgcacaaactacaagtgcgaataaaaatagccagtttttagaaagcaaacaatttcaagtgatagaaatcgcaagactttttaatatcccaccgcacaaacttggagatttaagtcgtgcgactttttcaaatatcgaacaacaagagacaaattatatggtgcaaaccataacacctctaacaactaaaatcgaacaagccctaaatcgctttttattaaaccaaaatgaaagaaaagaattttattttaaattcaatatcaacgctattttaagagctgatagttcttcaaggtgggaaagctatgtaaaagctttaagtaatggcgtgatgagtataaacgaagtaagagccttggaagaaatgaacccaattgataatggaaacgatcatttaataccgcttaatctcgccaaaatagatgaaaaagacacacaaaaaggcaatcaatgatagaagtaaaaggcttgaacgaattaatgaaagatttgcaaagcataagtaaaaaagctttgccaaatgcggctaaaaaaggagctttagaagtagcaaaagaaatcacaaatgattataaaaagaatattcctaaacaaagtggacttttaaagcaaagtgttaaggcagtttctagttatactttagaaaaaggtgtttatcgtgctgcttcggttgtttttagaatgaaaaaagtaggtataaaaagatttgaaaaattaaaaaatgctaaaaaatggacacaagcaaagaaaaatgagagaaaacaaagaatggattattttgcgagtgcgtattatgctcattttatagagtatggattttttcataaaggcggagtgaaaaaaagtgcaaaaggaaaaccaaatataagcggaaaaaacacttttgtaaaaggcacttataccatgcaaaaagcaaaagagaaaatagacccaaaaatgcaaagcttggttacaacaaaactaaatgctgagttagacaaattaggattttaaatgaaggaatttttaagcgattttttaatgggactaagcaaggaattaaatatagaaatttacccactttcaaggcaaaaaacaaagctagaaaaagcatttttaatttatgaaatcacaagcgaagaattaaatttaagtatagatgataaaatcttaagcaaagaattagaaattaatttgagcctttatactccaaaatacaaagatttaagagagttaaaaagcaaaattgaaagttttattttaaaattttataaaaaacctattgaaattttaatacatggagaagataaagatgaagagagtggattttttacgagtgagatttttatcacttatcgtttataaatttcttttctatgtcctacttcaagacaaagaatagttaatttttcatcaacaaaaaattagaaaataaaatacaaaaatatagttttatgaaaaatatctcttaatacgcattttaacgccttaaactttttataaaatctccttacattacttatataaggagaaaagatgtcaaaagacaaaataattacagatgcccctgatgtgcaagggcttagagttttagttttatctcgtgctatggaaagtttaggaaaagaagctattcaagcaggatttttaacaagtatttcaggtcttaaaggtggaactagagaaagtcaaaaactaagcccaatcaacgatagagattatgaagaaatcaacgcagtgggcaaaaaaacttcagctactgtaaatatgaatttactttataaatttgttaaagatggtaatttagaaagctatgagggggtaaattatttagaaaaagcttttgaagaaaatgaagaagtttttatcatcgtagagattaatgatgagagaaaaaccatgcttaaaatcaaaatgaaattaacaggctttgagcttcaaagcgaagcaaataataaattcagtgcaaatatcacagcagaaaaaataggcgaagctaaagacatcacaccttttagatttgaagaaagtcaaaatatagaacacagtacaaaagctttaaatgtgggcgatgtgatgagtgataaaaaaggtaaaattatttatttttacccaaaagaaagcacacttgaaaaaccagaattaaacgatgaaagaatggtttatgtttttgatgaggtgcgaggtgttgtaccaaatcctagtacacaaacttttaacgaaaacaatgaatttataaccacaaaagaagctgataaagtttgggaaaaagaaaatgatgaaaatattattcatgaaagcaaaaccgaaccagaacaagggcagacttatgaggaattaaaaggaaaaacattatatttttatccaaacgccttaacacttctttatcctgcaaatgaagatattcgcaaaaaatacaccatagatcaaagctcaggcatagcaagtgaagccacaatgcaaacttttttaaatggaaaatttagcgatgctttaagaaaaggaggtaaaaaatgaaattcaatgactttttaaaacaacattctttaagagaaaaagaaattttaatcgaaggtattgatgaaaaattcacaattcgccaactttctatgctcgaacaattagagattatggaaaaaaatggcatagaaatacaagaaaataaagatgataaaatcagcatcgattttattaagaagaattcaaattttagaaaagaaatcatcttaaagtgtttagtagctccaaaaatcgatgaaaaaacctttgataatctcaatcaagagggtttaaacattatcgcaaaagtcgcagacgaaattttaaaatttacaaatgaagtcccaaagcaagagagcaagggcgattaatttatcgccttgcccttgcattaggaaaaaccataggcgagttagaacaaagtataacacaaagtgagtttaacgagtggatgtatttcttaagcaccgagcctttagcaagtgatagaaacgaaatgcaaatgagtattttacttaatatgttagcttcttttatgggtgtaaaatcgactaatgaagactttttattatgctctcatttaaaacatactaagcaaaatactaacgaaaatcaaaaaatcgatattaaaaaattacaagatgactttttaagtcttttaggatagatgatgatttatttctatattgaattctttttcgtttggataattttgcaaaatttgcttaaattctttcgtataatcatcgccaaaagcattatttttgatagcaaattccaaagcaaaagcactcataagcacacttttaccttgctttgtttttatgaaattttcatgagcttctttaaaggcgataagctctttttcgcaacttttataatcattaagaaatttttcatttttaaatattttttggcttttgctccacatcagaaaaaagacaaaacaaataaaaacaaaagcaaaaaaattaagctctatatatggaaaaaacataatttaaaaactccattttttatcttaaattctactcaaaaaaactaaaaggaacataaatggctaaaaatgttaaaatcggcgttagcgtagatacaaatagcggtgtagcgagtattggaggtttaaataaaagttttaatcaattaggaaatgctacacaaacaacaaataaatacataaaagatatagaaaaaagctttttaggactttcaaaaagcgtaattgacatgaacgcccatttaacacaagcttatcagggttataaaactttagcacttgatataaaaaattttggtagctcttttatagaagcaagtaaaagttttgagactgcaaaaactcaacttgcttttataacagccaccacgcattcaaatattgataccacaggaaaagccatatcacaacttgaaaaatggaaagccgctacaaaaagcagtgaaaaaacctttaaagattttaatgatttgcatactaaaacaggctattctttgcaggatttatcaagtatgtttcaatcttttgcctccacagctttaaataatatgagctttgatgaagctaaaaaagcttttgaaagtattatgatagcaacctcaaatacttccatgagtgctaatcaactttcaattactatggatagtttaggagctggggcatttagcgcaagtggagatttaagaagatttgctgaaagtttaggtattacaaatgatgctatgagcgaagcaaagaaaaatggtaagctttttgatttatttatagaaaaaaccaaagagttaacaaaatatacagactacacaacgcaaacctatgaaaagcaaatgcaaaaatttgaagctaatatgcaaatgttacaagctgaaatttcaaaacctatttttgatactcttaaaagctcgcttatagatataaacacttatattaaagataatgaaaaagaaattaaagcgggcattaaagctattaccgaatttgctacttcttttaaagatttggctattggtgcaggacttgcttatgtagcttttaaaagttttaattcttttaagaattcatctttttttacaagtcttagtaatggtattaagaatgttaaaaaagattatgatgatttaataataaaacaaaaagaaatgaaagaacttgttataaatcaaaggaatttaaaatttcaagcacaaagctttaaagatgctatcaaagatttagaaagattgcaaagccttatgccacaaaaagcaaaagaggttagcaatttagctcctttttattctacaagccaaaaaacaatgataagtgctgaaaaaatgctactccaacaagaagcccttaaaaatataagaaatttagaagaagagattaagaaaaatgaaactttaattaatgaaagtatcttaaaaagaaatcctttgttaagcaccataaaaggcactatgagtaatttagcaaattctgctttaaattttacaaaggctttagctccaactgctgggcttatagctttgatgacttttatagaaaagctttatacgaattgggataattttgacaaagctttagaaaaaacatcaaaaagaaagctagaaaacaaaagttcaaaagaattagatgagtatgttaaaaatcttaaaagtcaaatggatgccttagaagcaaatggaagtgttttgggagctcaaatcacatcaaaattagatttttggtatataaaagaaggtgtagaaagtgttttaaaaggcactgattatatgtttgaaagtgttaccggaaaacagctaaaaatgaataaagaagctagaaaagcttacgaacaaatacaggcaaatttaaaactagccgaagaagccgccaaaaaagcaaaggagcaagaatttaaactagaagctattgataatctccctgctagtgttagcaaagccatggaaagtttgaaagctttaaggataccgcaaagcacagaagaacaagccgaaaatttaagaaaacaatatgagcttatcagcgaaaccatacaacaaatcacgaataatgcaaattggaataaagacttagcaaaattagagcaatataacgctttagtagctcaaagaacgcattatgaagaatatataaataaacaagaagagcaaagattaaaaaaagaaaaagaaatcgccaatcaaaaactggcagaacgcatcaaagaacaaaatgaagccttaaaagaaatttcacaaataggcatgagtgaatacgataaaaaattaagccaaattaatgaaaaattaaaagtatggaaaaagttaggcattgataaaaacaaattaaaacaagcagaagaaagccttaaaattaatcttgatctagaaagtgcaaataaagactttgaagatactaaaaatttaatgattgaattttatgaaagtatagaaaataagcaggaagcttgggcattaaaagaaattgagctaagagacaaatacagcaaattattaagtgaaaatctcatcaaagaagaagattttaaaaagatgataaaagccaataaagacgcttattttcaaatgggcaaagacagtaaaaaagccatgagcgaagtagaaaaaaactataatcaaatgatagcaaatatgcaaaaaacgatagaaagtagcttttttgatgttataaatgggaaaataaaaaccttaaaagatttgtttaaagatttaggaaaaaccattttacaagattttttaagtccttatatttcatcacttagtggctttttatctaaggcaggagctggagtattgagcggtttaatgcctaattttgcttttggtaatgtgaattcacactcgcaaacaaatgcttttagctcagttgttgaatttgctaaaaatcaaggtttaaatttaaatagtgatggcaaatatcaaggtgtggttaatggtgttgaggtagtcatggataaaacaggcaccatagaaaaaggaaataatgcttttaataatgtgagtaatattatagagggtgcaagtaaattagatggcattatgagtggcgaatggatagataaagcgggcgccacttatgataaagttatgaattggtttggcagtagtcaaaatgcaggaagtgaaataagttttagtgatgctttaaatgcggatggttttagtgattttttaagttcaagttctgatattagcactactattgaaaattcaagcacaaatattatagatagtataggcaatggctttaattctttatttgataatttacaaggttatatcaattcaataggcacttttggcagtaatcttttagctaatggttcagcttatttggcaaattttttaggacttggtgcaagctttacaaacggtgcttctttggcgggtatgggattaagtggtgcaagtaatgctttatctcttggttttggtgggggcttgggctatataggtggcactttagctaatgcagcaatgggcggacttctaggttatggcataggaagcttaggtgattggctttttaaggctgatactcacgcaggaacaggtggtgcgataggtggtgcattaggtagtattataatgcctggcattggaactatagtaggtgggcttttaggatcagtcattggcggtatttttggaaaaaccaaagtaacaggaagcggcttacaactttgggaaaatataaattttagtgatttttttacaaattctaatttgcaaggttatgtagactatcaaaagaaaggatggtttagtaaaaaaagctggacagagtataataatttaagtgataaaaaaatcaaagaaatcaatcgtgttttagaaaaccaatacgcaacacttgtaaaattaaatgccaatttagataagtttgaattagtagctggaaaatacgctaataattctttatttgatacggctttgcctactgcacttttaaaaagctttttaaatatcgatgataaaagcgaaatcgatgcacaaattgtagcaatacaagaaaaggcaaaagcaaataatataagctatgcccagcaactttctaatcaatttggtacttttatgcaaatgcaaactagcattttaaatcaaatttataaaaatgatccaacaaaacaagcaaaaatagcttatgatgataccatgtatgctttaaaaactgcgatgagaaattccacaggtggatttagtctttttggattaagtgaagaaagctttaaagatttaggacaacttagtgccgaagcacttaataaagctttcaatgagagcttaaggcaagattttagccctgagaatttagaaatttggcaacaattaacacaagcttatacgcaagcacaagaacaagttaaaaatcttttaaattctatcatacaaaaaacacaagaacttatgcaaatcaatcaaagctttttaagtgctaatggtatttcaagtagtatttttgaagttaatcatctaatgaattcttacgcaaccttaatgagcggtttaaaagatgatttaaatgatagcgaaaaagaaatgctaaaggatatttttagtgctaatgataagcttttaagtttaggttatgagggtttaaatgaatttttaagcacgggtaatactgaacttagaaaacagcttgtagatatcattacacaatttaaacaaataagcgacaaacaaggcggtttaatcttttcaagcgaacatttaaacaaactcgctgaggtagaaaagcttattaatgcgtatgagaacaaagatgaaagcaaagaagcagatcaagtaaggttaaatgaaaataataaacttttaagtaaattaaatagcgaacttggtattttaagttctttgggttcttttagcactaatttaatcaatcaaagcatagctacaagcgagagcgtggcgctaaactacgataaaattttaaaacaagctaaaaatgattttaaaaatggcaatcttacaagttcaagctttagtgccttgcaaaacgctgcaacgcaaaaagcaaacgagatcaaaaatcaagcttcaagctttgcagagtatcaactacaaatgcttaaaatggcaaatgaaatgaaagatttaggtggtgaggcagatttaaattcaatacaagataaaatagaagccattacagaagaaaataaaaaattacaagaaaagttagatcaaactttaaaagacacttctaatatgactttagaagagttaaaagagtataaaaaaactcttattgcacaaagtgaagcagaaattgcaaaaatgatcgagtatttaggcgaagaaagccctatggctaaatatttacaagaaacgattaaatctataaaagatggcgcctctcttacagaaacaacgcttaaaaatttagaatatgcacttttgcaatatcaaaataatcaggtaaatatagataaagatttaaataatgagattaaaaatccttacaaaaaaatgaaagcttttgcagatggcgggatagttacacgccctacaaatgctttaattggagagaatggttatcctgaggctgtaattcctttaaaaaatggcaaaggtttaaaaatcgatgcaagtggagtttttgaaaaaataggcatcgcttttgaaaaagctattaataaaggttttaattcttttgaagaaaaactagacttaatcgcttcaaaaattgacaatgtagataaaagtgtaaaaagagcaaatatggatttaagtattttaactaaacaaactagagaaattgcagaaaatatttaataaggaaagaagatgactataattaaacctttagaatttgaagttttacaaaatttagctaaaaaagatgaaacgcctttatgggataaggaagtaagttataaaaataatgaaaaagtgcaatttaaaggttttgtttgggtaagtgcaagtgatgaagatacgcatgaagaacctgatgtgtattttgataaatgggttaaatttgcacccatcaatgaaaatgctttttttgatgatgaattaaatactcaaacaaaatgcgataaagcttggagtgtaaaattgaaagtagatggggtatttgatactttagcatttttaaatttagatgtttcaaaaataaagatagaaacattagatggcaaaatcatttatgaaaaatcaatgtattataaaaaatctcgcacttggtgggaatatttttttagcaaatttaaagtcaataaagaagattttgtgtttttaccttatcctattaactcagaaattttaataagttttgagcctgctaaaatagggtgtaatgtaggacatattttaataggaaaaaaagaatttgcaggtgttacaatctatcctgcaaatagcacttatataaattactcaaaaacttcaacaaatgaatggggagtaacaaatgtagtaactggtaagaaagcaaaatacttagaatttatagttgctgtagaaaaaaaagactttgattattatgatgatttaatagcaggactttataatactaaagccttatttataggagatgaaagcgaattgggctttaaaaaattaactacttttggaattttaaaagattattctgcacctttagaggatcaagattatatgcaatataaactaaatattcaaggtttgatttaaaaaataaaaaatatcttctaacacgcactttaacgccttaaaaattttctaaaatccttataaaacttcaaaaaaggattttaaaatgagttttaaaaacataagagcagataccgcaagacttagaagcgttagcgaagaaaatatgtctttaagctttgtcatggtttcaaattctaatgcttgtttgcgttttgattgggagcttggggactatatagaagagcttgatgtaaaaggtgcgagatttgaaaatcttaaaactctttttaaagatcataaaccaagcgtagataatgctatcgcaagaattgaaaatataagaattgaaaataatgagttagtttgtgattgtatctttgccaaagacgaaaaaagcttagatatctttaaaaaatatcaagatggaattttaagcgatgtgtcaattggttatagagttttaaagcaagttgtagataaaaaaagttcgcctaaaagggttctagttacagagtttgaaatttttgaactcagcgctgtttggaaaggtgcggataaaaacgctaaaaaacgctttgaagaagatgaagaaaaaaagaaaatcaaagccttaagtgaagctagagagcgagaacttaaacttttagaaatatcaatttaaacaaggagaaaaaacaatgcaaaaattaagacaagaaataggaaatttacacgaacaaatggtggctttatcaaataaggctaaaaacgagcaaagaagctttagtgctgaagaaaacacaaaatacgaagctttaatgcaagattttgaaagtaaaagaaaagaactctcaagagctgaagcagagctagaaagagaaaaatatttaaatgaggttgtaagccctgttttaggacaaaatcctaaaggagaggatgaagatttaaatgaagaaaatcatatgcgttcttttgtgaattatttaagaaatggaagtattgacaatattttaaaaagaaatgttttaaatgaaagcacagcagagcaaggtgggattttagtccctacaactttgcaaagtaaaataagagaaaaattaaatgatcttagtgttattagaaagattgctacagtgcaaaaaagctctagcaatcaaattatacctgtttttgatgagatgggggaattttcttggcttggcgaacaggaaagctttactgaagttagtgctaaatttagttctttaagtataggcgcacataagcttggcggtattattaaaatcagcgaagaactcttgagtgacaacattgcaaatcttgaaagttttatagtgcgaaaagccgctgaaaagatttcaaaaacagaagaattaagttttattaatggagatggaaataaaaaaccaacaggacttaaaaatgctaaaaaagcgtttacacttgcttcaaatcaaggtattacaagcaatgatatcatagatgcttttttcagtttagacagtgcttatcgtaaaaatgccacttggcttgtaggagatgagtttatgaaagctatttataaacttacagataatgataatcgcccattgtggctacctgctttaagtgctaatggctatgacacaattttaggtaaaaaggtagtttattgttctggtgttgatggttttggtgcaagcaaagtccctgcattttttggagattttagtttttatgaaatttgggatagatcaagtatgagttttacaagacttaatgagctttactctcaaaatgatttaataggtattaaagtgcgtttaagacttgatgcaaagcttatggataattcggcagtttgtaaaattgtatgccctgcttaaaggatggaagatgaaaaaagtagttttcaagtgttgtttaagcggtaatattttttataaaaaaggtgatgaggttttacttgaagatagtgaagccttaaggctcttagaaaaaggcattgtggaaatcgtggaacaagaagaacaaaaacaaaatactgatgaaaaatcaaatacagataaaaagccacaagaagatcaagaaatgcaagaaaaaccacaaaaacaaaacgaaaaagaagataaaaaaggtaaaaaatgagattaaaggcattaaaagatagcaaaaaagaactcatagacattcaagaattaagagactttttaagaattgatagcgatgtttttgatgcaaatttaaaacaatttttaaaagctggaatgaatgaatttgaaacaagaaccaatcgcattttagctttaaatgattatgaagttgaattttttaatgaaagggtgattttagctccttttaatgctttaaaaaatgcaaattttaaagccgagtttaaaacaaatggtggtgtgctttatgcaataggttgtgggaatatgattgtaaatttaggttttgaagaattgccacaagacataaaattgtggcttaaaaattatgttttaatggcttttgatggtgtgagtatgcctaaaatttcaagtgctttaatcactcgctacaaaatagcttatttttaaaaggcaatggcaatgaaagcaaatggatttaagcatagagttaaaatttacaaaaaagaacaaagcaaaaatgagtttttagaaagcgattttacgcaagatttactttttaaagaagtttatgcaagttgtaaaaatctaagtgcggatgttaaagagttaaatagtggcttatctttagtcgctacgcatgaatttgagcttagatttttagagcttgatttttcttattttctagtttttagagatgaaaaatatgagattgtaagcttggaagatgaaagccaaaacaagaaatttttaaaaataaaagcaaggaaatttcaatgaataaaatatctttcattaatactttacctaaagcacctgatatggctaatcctgttgattttgacaaggatgctaataactttgttaatgcgcttgttcctttttcaaaagaacttaatgattttattaaagatataaatatattaagtgcttccttgatagagctaaactctaatatgatctcttatactaatttggctttagagcaaattgacagtaaaacaaatataaatatcttaaaaatagaaaatttttgcaaagattttcaaaatgttttagagcaaaaagctaaagaaagattaaaagaatttaccgatgaatgcctaaccatagttgaaaacaaaggctatgagatgatagaaagattaaatgacaatggcgttggagctgattatatcgctatttctcaatctctaactcatagcttaagcttagaacgctttattatggaaagaggttttattaaactaagaaaagaagaagccctaaatttagatgatgtgaatttgagtttagaagaacaaagaagagatataaaccttgcccaaaaagctttagaaaatatcacaaacatactctcttcacaaaacgaaattaatttaactttaaaaggagaaaacaatgcttgataactcaaaaataagaagcacagagctttatgctacgctaagtcaagctactaaggatgttacagccataagagagtggctttatgcttcaaaagataggattgatgagcacattttagaaaatttaaatgcttttgatgaaaaagtaaaagaagctttacaaaactatgaaaacttaagcgatgaaaaacttaatatgctaaaagaactttataaaaaagtggtttatccttttgattatgtaagtgatgaagaacctacaatgcccaatgtgaatgaaacttggtttaaaactgatgaggctaaaatctttaaatttattaaaaatccacaaatcactttcttacaaaaagaaagacctaaagaaagaaaaattaatgatatttggtttaagcctatggatgatgttaatttacaagtaggcgaattttatctttgtgaaaaagtgttgaagaatgaagcttggataaacccatccttgcctgagaatttagaacctgcatttaatcaagaagaagctccacaaaatgcaacgcttggcgatatttggaaaaaaggggatgaatatcttgtttatattaaaaccacaagtggcaattcttggactagccctgaaaacccaagcgaatatacacctacttatgaaagcgaagaagaaccaagtgaggcaaaacttggcgaaatttggaaaaaaggaaatgagtatttaatctatgcaagagtgactaacgatacagcttggattttaaagtctgatctagggcttgatgcttttatttggtttaatgaagaaaaagaaaatataaactttatactttcacttataggggatttgaaaaaagaagatgaaaaagaagaaacaagcaaaaatgaaataaaggatctggaacaaaatttaagcaataaacaggaagaattagaaaatattaaaaagcaaatcgaagaagcattagcaaaagacccaccacaaaatgtagataacctcaatgagaaaaagacgcaattagagcaagaaatcacaaagatgcaagaagatttaaatcataaacaaaatgaattagaacaaatacaaaaagataaaagtttggttagtcaaaaaatgcttagtgatgcccttaaagaaaaagtaggattaaaaggtgatgagactttaaatggaaataagactttaaatggagataatatatttaatggcacaaatacttttaatcaggcattaacttctcgggccgatccaacaaatgataatcacttaactagaaaatggtatgtagattatggtggtggaattaaaaatcttggcacaactggcagtataaatctagatttaagacaagctcaacattttattttaacagcaaatgcaggaacaagcataggaatagctaattttggaggagtaggaaaaagcggaacaataaccataaataattgtcaaaatgtagtagcttttaatgccccttttaaatttagaatagctcaaagtggatttagtggcactgaaacttttgcttatttttgcatagcttcgaataatgtaagattagtaaggacttaaaatgaactgcctccttctttctaataatggcatagcactaaatttacctccatctttaggaggctcggttgcaaattataattatatgttaaagctagacatgatttataaacaagcagtggtattgccatcaaatattaataataaagaagtggttatgttaggcgaagtttggacgactggaaatatgtctaataaaacttctgcaaatactttgcatatcacatggaacaattttaactctagtgtagaattgcatgctttaagtaaatattacactgccaatgcaaaaatcaaagtagagaaaaaattcaattttggaaatataaacaacttgcaaataatgctaagttcttggcaaagcggtagtgcaaatgcaagtgctggttggaacttaaatgatggggatagattaaacccaagagcaaatttaacattatactggaattaagaaagggtaaatatgttttatgatttaaaaaataaaagtttaaaatatgatgatatttttttaaaagatgtaaaaatacaaaacgaagaaggtgaaattgatgcacaagatacttattttttaagtgcttgcgatgataagcttttaaaagagcttggttttgctaaagttaaagaagaagaaattccaagttttaatgaaaaaattgaagaacttcgccaaattcaaacttatgatgaagaaaataatctttatattatttcttatgagattaaagaaaaagcattagaagagttaaaagaattaaaattagaagaactaaaagctataaaagaagaaaagcttttgtttatgccttttaaaaatactatatttcaaattgacacggaagcaaaaattaatattagcggaaaagttagcgagataatgttagcaaatctcaataatactcctttggaaaatattgcttggattgataaagataataaaatcattacatttaacaaagaagaatttttagaatttggggttggtatcgctaaatatactgaaagtattatttttaaaaatgatgaactaagaaataaagtgaaaaatgccacatctttagaagaattaaatttaattgcatgggagagtgaaaaatgagtactgaaaatataataaaagaaggtgctatactcggttctttaagtggatctgcattattaggattgatggtttttgtcttagctgggattgcatggcatttatataaaactttacataaagaagctggggaaagaacaaaagaacttataagtgaaaccaaaaatactaatgttcttattagagaacaaattgcagtatccagagcaagtagcgatagtttggttaaatttatagaaacacattgctcaaaaaccaatgacaagctagaagctatagaaacagatcttatgagaatggatgaaaggcttgttaagcttactcaaataagaaatgatgaattaagaagtatttttaaaaaaaaggaaaacaatgactaaaacagaattaaaaagggtttgtgtaaagccatacgataaggacaggtttgaagtgatacaagattatgagtttattttgccaaattacaaaggcattgtaccacaaggttttaaaactgatggagcgagtattccacgccttttttggtctttgtttccaccttttaaaagtgagtattttagtgcttgtgtagtgcatgattttttatgtgaaaaagcaaaatcaagaaaagattacaaacttgctgatcttgttttaaaagaagcaatgcaagctttagaaataaataaatttaagatttttgttttttattgctcttgtaatttatttcatcagatcaaatgtttaataaaggggataagatgagcgtggatttaagagaaattgccataaaaacagaagaaatcaataaagattttagtgaagctttagaaattttaaaagaactttttaaaaatggagtaaaaccaagcgatgaaagtattaaaaatgctataaatgaagttttaacaagttttaactttataaaacaaagtgaattaaaagaaaaactagaagccttgctagaagagcttggcatcaatgcaaatatcaatgaagagagtttaaaagaagttgtattaaaagttgttttagaaaatcaagaaagtttaaaaggtgataaaggagatccttttacttatgaagattttacagaagaacagcttaaaaatttaaaagggcaagatggagctaaaggagctgatggtaaaagtgcttatgaactttggcttgaaaatgaagaaaacacgggaaaaagtcaagatgaatttttagaaagtttaaaggctcaaacaccaacaaaagaagaaattaaacctattatagaagagatgctcgaagatatgaaattaaatttaggcattaatggaataaaagtatctaattctattcccactccaaaaacaaaagctaatgttaatgatttaattataacttataatgaaaatgtaaaacaactttggctttgtgtggcaagtgatgataaatacacaagttggattaatttgcttggaaatgaaaatattacagcacaagagttgattattattagttttgatacaaatttaaatagtggtcaatatggcggatgtttaagtgatttgcgttttggttttgaaaattctttagcaagcactacgcaaattataaaaggacttaatgaaggcagttttttaatcactaaagatggaatgggtttaaaatctaaaaattatactgaagttagcgttctttcaaaaccaagtaaaaatcaaatagaaggaaatatcaaaacgagcggaatttataatgatcctgcttggcataatattaccaatgctttaaaaaaatatgatggcaatgcaaatgaatgctgtctttgggcttctaatataaaaaatagtgtaagtatagagctttttacaaatgaaattcctatgagtcttttttataggcaagctggatattatggaaatgtcaatctttcaaatataaaaatgcaaaaagcccttagagttcaaaatgaaattatagtcgagagaagctttataggaataaaaaaagaaattgataaaactacctatggtgataatgcttttttatttgaatttgaagaagaaaaatgagtttaaatctaaaaataaaatacaaaaaataaaaagaaaggaattataatgaaaataacaattaatagaagatacacaggaaaaacttgcgttattggtaaatttaaggttttagatgatgatgataaaattctttttgaatgtttttctttggaagaagacaaagaaggtttagaaagtggcaaagatttaagaatacctgaaggaaattataatttaaaaagacatagtccttcacgatttgaaaatactttaagaagtattacaaaaaaagatgatgatacaatgataaatgtttataatgatgatgtgccatcaagtcgtgcaattttaatacactggggaaacactgataaagacacacaaggttgtatcttgcttgggcttaccaaggataataataatgaaagtgtcggtcaaagcaggcaggcttgcaaagaattttacgacttaatgcatggtaaaaatcttgaagacattaaattagaaataacaaatgaattagcatgaaaggagataaaagtttaagtaggttaaagtttacaccccgcttttgcggggcaaggctaataagccttgactataattacacaaagtagtataattataattataaacttctggtatgacatttatatcaccacctttcgcgggtggaatttagccatagggggtcagacctacggctaacccttaggggtattatataaaaaccttacttaaacttctaaaacaaatatgataaatcttttatttggaaatgcaaagctttatatagccttagctttaatggcaatcttaacagggtatttttatctaagacttgatagcactcaagcaaaattagaaaaaagtcaaagtgatttagctttggctttaaaaataaatgaaaataatcaagaaaaattaaaagaattaaatcaaattcataaaacagaattaaaggctttaaatgaagcaaacaatcaaaaaaatcaagtacaagaaagggtgcaatatgttaaagaatacatttataaaagcaatgaaaataatattaccaagctttttaacgatgtcgttgataggttgtgggatgcaaactcaacaagtagtaaccaaaatagaaattcaaaaagtaaaaattccgcaagaactactaacattaagtcctcttgaaaagccaatagcaaaaaatgaactagatattttaaatgcttattctatgcttttttacaaatacaaacagtgtgagatacagattagaaagattaaggagttaaatgaggaatgatcctcatttacatctattctagaacttctgctttgtatttttcatactcggcttcactgatacaccttttttctttcaatcctcttaaaaattctaaatctctcattttagatattttttgttctcgtctataaggttttttaaccgctaaatacaaaatacatccaaaaatgccaaagaaaaacccaactataccccaccataagctgctcatatttctttgtttagcatcataagaaagttcaaaagcacatacaacagcaaagataaaatacacaagtcctgcaatttccatttttactcctttttaattaaaaattgtcacattttactttatatattcttaaattctcattttctacatcgtgattaggcacttggtaacattctttaaaattatcaccttttaaaatcttagtgtaagagcttggaatagcaatattgttttttattctttgtggattattgtcataattaaccaaatttaaaacttctaaacttccaagctttaaagctacttgtctttctcttttttcaattttattccaaactctttgattgatttgtggattttgtggagtaatgttgctcattaaaaaagtgcttctttgagcttgagttgtttttctcattgaagcattagaaagagtgtgtcccctgtcgtaaccgctgtttttataatcactccatgtggtgcggtattttttaggaatatttgtatcatcttcaaagcgtgggcgttttttgatttgttcgccttttaaattatccgcttctaatctataagctacggctttagtgccttttaaagaataatcataacaattaatataataaaatttatccaaaacttgtgagcagttttgtttagtaaaatacttggcaaaatcttcgcttggtttgtattgtgtataatcagcaaaagctagagtggataataaagataagattataagttttttcatttgtttcataccctttcaatttgatttaaaaatatctttgcattacaagagcaaaccactacacctataaatacataattttttaaagcacttttttttatttttttatctccaaaattaaaattatcactgctaataactatatcatcatcgaaagcattttttaaaatacgtttgcaaaaaagctcgttatcattatcgcgaaaaattactacatcagcatttcttatcttttctagtgaatttttagtagtatctatgatgataaaagagccattttgtataaaaggttccatgctttcaccataaattttaatcatatcatattgtgttttataaggcactcctaaaacatcagttagaaaagctttatctatgtttataagctgaaaattttcattttcatttgcattgccaaaacctgcacttgcacaaatgtctggaaaataacgaatggttatagtatctttgtggtgatgaatagagactgaattattagccttttttaactcatagtattttttcaatgcttgagctgaaagttgtttattgttccgccaattatttgcattattttttttatatcctaatctctctgctacttcttctaaactttttacattaaaaaaagtttttaattcttctactaattcataataattttccataaatataaccttgaaaatatattgacatatatttaaaattaatatataattctatacataattaatttttaaaaacaaaataattatttaactaagcaataagtatgccaagttttaaattaaaattgtattatgttattttaaggatttgaaaatggagtattggctcatatttgtatttttctttttcgggtattatattttgtttgattaaggcgtattacgccttaaaaattattttttttcttgctcgggtttatctcctctagtttttgggattatgggtgtagtagttccagtttgtggagttggttttattactttttctttattgtccgacataattatttctccttttacgatttgtgcaccacttgttattatagcaaaaaaagatatactagctccaataacaagaaaaacataaattttaccaatatctttactcatattattaataattttgttatttttatcgaaagcatctaatatagaagatatcatggcattaattccatttgtatgttctaaattatctgaatttaatttagacatctcaccgtattgatcttgtggaaaagctattgtattatttatttttaaggcaagcaaggaaaagaaagcgcaatatcctagaaatataattgaaacactaaaaagaataatagtaaatagatctgtatgggttgtttttatatagttattaagtatagtgatgtcacctgctattataaaagtgcaaagccacatgtataattttatagtttgaaattgtccagggattatacttgtcaattgaatatctaaatcttttcttttactttcaagttgtagctttaaattcttttcatagttctcaaatgaaatattttctttattttctgacattttaattccttgcatagtatttttataattatattaaaaacttaatatatttataattaatataaaaattaaaaatatatattgacatatatttaaaattaatatataattctacacataattaattttacaaaataaaataattatttaaccaaagcataaagtatgccaagttttaacttataaagtttttaggggtaaaaaatgatagaagcaagatcaattttagatgttttaagttttagaaaaactgaagaaaaggaagagcttagaaagtgttttaattttagtgatgaggtttttgaaaaaggacttaattttttacatacaaatgatgagataagcatagaagctgtgagtgatggactttttgaaaaaacgattatcagcataaaggtttcaaaatgaaacaagcgataaagcaaaaattaggtgttagtagcataacagaagcagggttaaaactaaatttagctcacaatgtcttaaatagttggctttcaaataatcttacaaatgcaaaggttgaaatagcccttttaaaactgggtttaagagaggatgaaagactaataaaacgcatagaaaagctaaaaagcgagtataaaaagaacgaaatccgtaagcaagcctatgaaaaatatatgagagaaattaaagttttattagaagagatagaggcggcttaaaagcctcattaagcacatttatctaagcactttaaaatcgcattttttaaagtgatagcaaaaagtgtgcttaaagggtttttgcaaaagttgcgttaagtggataaacgcctacaattgcgaactttaaaggtttgatattttttagattgcttcactagccttttatggctagtgtgttcttatattcattgcactcacaggcgacggtgtggaaagtgggcttttttaaagctttgttaatttaccaaaataccaaaagtcttttagactttgaatgcaggtcctatgttttggttagtgtttaaatgaggactaatgagaattcttttaaagtcctcaaatttatttatttcttcttaaattaagccatcttttaagatggctcttaagtcttcatttaaacactaaaaaattttaaggagaataaatgaatttagaactttttaaaaaagatgaaaataaagaaataagcttaacttctttggaaatagcagagcttacaggcaaggagcattttcatgttataagagatatagaaacttacttagaaaaagtggttgaagggggtatatccaaatttggagacacctaccaaaacacacaaaataagcaatcttacaagtattatcgcttaccaaaaagagaagtattgattttagtgagtgggtatagcgtagaactaagagcaaagataatcgatagattagaatacttagaaaatgagcttaaaaaacaaagttataaaccgctttcattaaaagaaagtttgcaaatgcaattagagcttttagaaaaaaatgaaaaacttcaagtagaaaatcaaagcctaaaaaacgaagccgaacaaaatgcacctttaattcattttgcaaatcgcattcaaaacacaaatgatgctattttgataagagattacgcaaaaatcttacacgaaaaaaataatcttgaaattggcgagaaaagactttttaagatcttgcgtgaaaaaggatttttaatgagtgataataaaccttatcaaaaatacatcgaacaaggactttttaaggtaagtgaaacgactgttagcaccattaatggcgatagacttgtaagcacgacaaaaataacaggtaaagggcaaatagccattttaaaagcgattttgaaagcaagttgatatagatttaagcgaatatggagacaatgaaacttttaaagatgaaattcaaatgccaagcgatagagttgaaatagaactatttacaggattttacgataaaaaaggaaataagatttatgaaggagatattttatattcttttgaaggttgttctgaagatgaagcttttaaatataaagttgtttttaaagaaggagctttctatttagttgaatgtggtgatgatggtgaagaatgggatgaagatttactaagtgaattttgtttagaagaactagaaattgtgggcaatatccacgaaaatgcggaattattaaatgaaaataaaccatcttgatttatttagtggcataggtggttttgctttttgaactaataaaataaggtttaaatatggataagaatttaaaaaaaattacagaattaaaaataaaatgtaaaaattgcgatacaaaaatcattacaaaaataggtaatgttattaaaacttgtccgcaatgtggaataaagtttatagatgaaaatttaggatataatctctttgaaattttaactgaattgttcaaaagtgttagcaaaaataaaaatgcagaattttattttgtttgtaaaaaggaatgtgatggaacaagaaatcgccaagataaaaaagtttaaactagagtgcaaaaattgtgaaacgcaaatcattatagatactcacaatagtattaaaaattgtcctgtgtgtggattgaaattttatgacaatttagaaagtccttttgaaaatttacacgaacaaattcttttaatcaataaaaataagaatgtaaaagtttattttgtttgtgaggaaaaagaaaagaggtaatataatgcaaagcaataagactttaggcgaaaagctaaaagatagcatagatttagctgataaagaagctataaagcaaagcgtaggttttgttttttctttggctaataagattttttaatttaaaaggagaattaatgacagaagagaaagaaaatattgttaattttaaaataaaaattatccatgaagaaaacatagaacttgggataatggctaattctttgttaagttttcaaaaattaatggatagttttatatcaaaagagcacggtataacacaaagtaaaatttttttagaaaaagttgaaactggtagtgatatatattctttggtttttgaaatagcaggagaagttttgcctattattgcacctattcaagcattaaatgaatttatagaacttatcatatcttttaaaaatatcaaatcaaaaagtatagaagaaatagaagaaaatccgcattttactaagtataatgccaataatttaaaaaatatatttgcacccgttactataaatcaaaatactttttttatcaatcataaaggtgaagaacttttgagaataaatagtgatgaagctgagcttatttatgaaaatgctaattacatttgcgaaaaaaaggaaattgaatatcaaaagatacatgaaaatgctttgataacgatgtataaaactacaaataaaatagacaataaaacaaaacataaggcaaagtgcgatgctttaagtccttatgcggttgatgttagttttagtgatgagaaaatagccgaagaagttttgaaaaatccttatggatttaattttttagtagatttagagtattataaaaacgataaaaataaaatcattttatatagaatttttaacataaaagataaaatatctttagaataaaagaaagggaaaaatgacaagtgaagaattaaaacaattttgtaaagagcaaggcttaacttataaagagttagccgagttaataggttttggtgaaggtgcagtaaaaaatgccatttctactgaaaaaataagttttcaaatggcacacgctattaatatgcttaaaaaaatttttgaactagaagcaaaattagaaaaagcagaagctatcaaaaaagactttaaagcgtggattaacgaaaattaatccacaaagtaaatttaaattacttctttatctacaaaaaataaaaataaattattataaccttgacaattagtaattattatgttataattgtgttatcaaaagtaaagataaattacttttgaaataaaagaaaggagtaaaagatgaacgctagtgatgtgctcgagttaatcactgctttaatctgcttgataacagccattatcaacgcaagaaagcattaaggcaaagggcgaaagcccttatcatcttttaccttttctattatatcaaaaaaggagttaaaaatgattttagaaattatagttttagtattagcgactttattatgtgttttatcggcaaaagtttataggcttgaaaaagaacttaaggagcttaaaaatgagtaacaaaccatacctagaaaacgaaataaaagctttaaaatatcagcttttaatcgaaaaacaaaagcacaaaaagactaaagaaaaggtttttaagcttaaaaatatacaaggggaaaaatacgagaaactaaaagcagaatttgccaaaaatcagctttttgtttttagagatgatgagctttttctttgggtggaaagtttaatgcgagaacttaaaactaaaattttatgcactaatgatgagctaagtaaaaaagcttgtgatatattagtatttaaattagaaaaacgaagaaaaaatttcaactattaaataaatcaccagtttaacagtgtttaggacattttaataaaccctaaacactcatttaatgtctaaaaaaggaaaaaaatgagttttaaacccatacaaaaagataatgatgcatttaaaaaagcacaaagagcaaaggtaatagaaagtttagcaatgcgtggctatgcacttgtaaagataagtagcaatggctttttaatgaaaaaaggttttgaaaaggatattttatgcaaacaaatcatagcacaggatacgacagcttccgtttcgttatcaacaaaaaaaccttttacaaataccttaaaagatgggggctttttgaaaaaatgcgaagcacaacaagaaataaaagcattgatgaatttgcaaaagacaaattcaaaggcataaaaaccaatgataaattttatccttttaaaatgcgttatatcaatataaaacctagaaataaaagcctttcaaatactatcattatattagataattctaaggcttgctttgagctttctaaaaagaataaaaaagcaaaagattactacatagaggtgcaatttaatgggctttatcagcctagtaaacaaatagaagctgaagtgtggaaaattttaagcaaaatgataaaaaggtttaaagcttatagtgtggatattgcttgtgattttgatgatgatctagcagtatctaaaccaagagaatttaaacaccaagaaaggtttagcaaacttaaaatctttggcgattttcatacttataaaacaagtatgtatatcaacaatcctcaaagtaaatactataaattagaacgcattttactttatgataaatacgaaaaacaaaagcactatcacaaagaaaacattaaaagggaatttgtgcgatggaaaagattagagcttacattgaagataaaggataagttcttagatagaatagaaaatgatatcaatgatgcattggatcttatgcaagattatttaagaatgataggaatttggcattttaatatgagagtgatacttgagcaaacaaagtatttaaacaatccacgttgggctaagacatttaagccttacgctttggcaagttaggagagaatatgaaagtaaattttatttttaaagggacaataaaatgttcaaaatgcaacttagaatttgtgccaaattctaaattttttaaaggtcttgatgaaattataggcgatgtaaaaagcgtgagtttagatggcttttgccctgaatgtgataataaattaaaagctacttttgaagtagaaaagatcacaagggagcttagcaaaacttatacaatgaggtgttaaatgaatattacaagagaattagaagcttatgatttagcaaaacttgttttaaataatgatcttaaatacttttttaaagatgcaaagattgtaggggaaaataaagaaagaagactttgtttttatttttcagattcttttgttttagctttatttgaaaaagaaaaagaaaacattttacaaagactaagagaagaatacaaaaagaaattagagttttacaaacgaattgatttggtgttttattctattgcagcaaaaggaataaatgagctaaaagcaagaagtaaagaagaacaagaagttttagaacgcggacttttaaaacttgaaaatataattaaaaggataaaaaatgaaaaaaaatactaatcagcaattagagcagttaaaggaattaaatcaaggtgagttaaaccaagagatagaagttttaaccaaaagagctttagcaattcatagatctatacaaagagttaaagatgaaagaagcatattaaatcagaatatcaaagactatcagagcgaatttaatgaaataatggaaaaaatagcctttttaaaagagcctaatttatttaatcaaaaaggaagtgatgatgtttcacccacagctttataacgaccactttcaaaattttaaaagatataatataccaaaagcacagcttgtaatagctgatattccttataatttaggcaacaatgcttatgcttcatctcctgaatggtatataaatggggataataaaaatggagaaagcaaaaaagcaaacaaggcgttttttgatacagataatgattttagagttagcgaatttatgcacttttgctcaaaaatgcttataaaagaacctaaagaatgcggtaaaagtccttgcatgattgttttttgctcttttgaacaacaaacaatgttaattgaagtagctaaaaaatatggctttaatcattatataaatttggtttttagaaaacaaagctcatctcaagttttaaaagcaaatatgaaaatagttggaaattgtgaatatgctttaatcttatatcgtgaaaaacttccaaaatttaacaatgatggaaagatgatttataactgcatggattggcaaaaagatgaaggtattcctaaagtacatcccacacaaaagcctgttaaattactagaaagattaatcactatttttacagatgcaggtgatgttgttatagatccatgtgctggaagtggtagcactcttttagcagctacaaatttaaaccgcaaagcttatggctttgagattaaaaaagacttttttaaaagtgctaatgaaattatgtttaaacacatagaaagaagcttatttgcttaagttagaaaggataaaaaatgaaagaattcaaagaatacataaaagctaaaatagcattagaaaaagagctagaaaatacgcaagaaatgttaaagcaaacgataaaagaaatgttgcttttaagaaacgacaatgcttttaatcaaaatgcaaacgatgagatgttaaaagctattaataaaaattggaaaataacagcttcgcttgagagtttaagtgatacattagaaattaaagtgctagaacaaagcacgagctataatcgcttttgttttggtgatgttttgattttaatcagcaattttttaagctatgaagagcaaaaagcaattattgcaaaattaggctttgatttagagaaaggagtatgaaatggcaaaatttggtaagatagaaaaattattatcaacaaaagaagtagcggagtatctgggatttactccgctaaaaattcgcaaaatgagaatgcgagtaaatcaaaataaatttaattttcctaaagggattaaaataggttctacttttaaatatgaaaaagccgaaattgataaatggttgcaaacttgcaaggtgatttaaaaatcccctgcaagtttttcgatataatctccccaccactgcattaactttctttttaattctatattttcactacgattataagcttttaaaatggcgtttttttgctcgtgtgctaaacactgctcggctatatccatactcacaccatgatctaattgatgttcgttggctaaacttctaaacatagcacgaaagccatgtgcactttgaatacctttatatcctagtcgtttattgatattacaggtgatattctcgctattacacccattttttgaacttccagcaaatatataatcattgactttcattttcttttgttcttttaaaattttaagcgcttgagaatttaaagtgataatatgttcttttctcattttcattttttcagctttaatagtccatatagcattttttaaatcaatttcatcccaagttgcttttataacattaccggggcgttgtgcagtcaaaagattaaaaagcattagatttttatgtgtttttttaagatctgaattttttaaggctaatatatattctttaattttatcgttttctagtagagttggctgatgaattacttttgaagcttttttaaaaactatggaattatcaatacttgtcacagggttattttctacgatttcaagttgcaaagcatatttaaagattttgttaatccagcctttagcttttataagtgtagggatttgatgctctatggttttaagtgtttcgatgacatgtgaacgcttgatgctttctatatctacatctttgaaattcttaaaaacgccatttttgtattttaatcctctttgtatttcttttagacttaatccatcagccttacatttttctaaaacttcatcatatatatcgccaaatttaagtcttttagcgttttttatgttttgtccttttgcttttagcttaaaagcatttaaagcgatttctctaagctctgctaaggaaagtaacggatactctcctatttttatataagtatcatttgcttgtcttattttaaataattttttaccactaggataaataaaaacatataagccttttaaactcggatcagcaaattttataaattttttatcactttcgcatttaatgctttttaaaaaactatcggtaagtttgttaatttttgccattaatttttctctcttttttagtgtctattttggtgtaaaaagtagcccattttgtaacccatttttggaaaagtgacccacttttttaagaacattatagcacattttggaatataaaagaacgatatagaacaagctttaaaacattttattataggcatttgattaatatattaaagcaaaatagggatttgataaaaaagagtaatggtggatttagcagaatattaaaaaaagtatctaaatacctataaaatagatattttatattttatagtaacccattaaataacccagttttctaatatgattttttaatattaaaatccgattaaaatgcctataaacatatttcttaaaatccgattaaaaatgatatgtgcttttattaaaatccgattaaaaacaatacgataatctttgccagtgctttttaatataatagtgtttgtataaaaatataaaaaatggtttttgtttttttgctttcttagtaaagagcaataagtattccataattgctaatttaatctttgattaatagttttattattttttatatattataatttttaaataaaaatatcattccttaaagcttcgtttgttaattacttaaagacttcttatgtttaataaaaaagatattattgttaatgcagttcccgttaagctttttgcaagtaatttaggtttgtatgataatttttatagaaatgtaaatgagcttaaaagtggttttaaaatcaaacaagtaggaaataatttttttgttttgcttcctgattggtttataaaattgctagagataggatatgattgttatgtgattaagccttatgatgattttaaatatgaatttaaagttgaactttctaaaaaaactgaaataggattttacaaaaatgacaatttataaactttgcaagtgtggtaagaaaatacaaactcatttaagaacttgtgaagaatgtgataaaacttttaagaaaatagcaaacaaaagatatgattgttttaaaagagacaaagcaagttcagatttttataacagcacagcttggagaaaattaagaaatgcttttataaataaaaatccattttgtgcgaagtgtggaaagtttgcaaaaattatagatcatattgtgccaattaaacaaggtggcgagaaactgagtgaagaaaatttgcaaagtttatgcatagtttgtcataatgaaaagactaaaaatgagcttaagggatggggtatgtaatctctatgaaattcagcctatccttttcggtgtatgggctgaatttcat

SEQ ID NO: 19 - DNA, 37233 bp, Camplyobacter Phage CJLB-15
tgtcggcggaaaaataaaatttccatttggaaaaataaaacttccataaaagtggaaattttatttttctacaaaccttaaacttaaaatataactttattaaaataaaactaacaaaaaattcgtttatgatgttcatcttctttaacaatggttttcatatccaaataatgctttactatatattttggaatattaaagtcgtaatcagagtgtggctttaaatcaaaacgattaaaaggtttgtaatttttataatattccctactgttaaaaaatctaggttctactatgtcaaaacttgatgtgtctccataaaaatttggtggataatacatatctatactttcatcatcttttaaaaaataagtattatataaagcttcgctcaactcatcacccctatgcattatttgcataggaaaatagcttccttctggtatttcatttaaaaagaagttgatatagtagcgataagcctttaagcttaatttgctttttatttgaacgggatttgaaaattcgtgtaaatatctttttctagatcgtatatcttttttaagatattcaggaagctcactttgccattttaaatatttgaacatttgctcataaacctcttttaacaatccaatatcattacaatctttaactgtatatgccaatattttttcatacttgttaagctttaaaaaatcgttccaagttactggaaaacatttgtataaaaattctttcctaacaaactctccataatcaatttggctagtttgaattaatccagccgtgcaagctaattcaacctcaacatcttcattctctggagtttttatggtaaaaatttcatgtgaagttgtttgaaatttgttaaatttcaagtccttttttcgctctttttctttttcaaaattttcatttattttttgcattctttgtttatgtacttcatcaattttttgcatttcctgcttatattcattccaaatttcttttaccggcttatttggtattccttttatttttctatataaataattacataagagaaaaataaaaataactgctaatatcgataatactatattcactttatttcctttaaattatataatagaacgcaaaaccttaccctgtataatgatttcaacttgtgagtcttttaagtccaaactatagcttttataatccttatttacactaataatatctaaaactttacttattggatctaattgcaaaagtttaaccataagttgattatcaaagtttaaaatgtatagtccatctccttgatactcgtgtatttcttcaaatataacccaactatcaggtaaaagcattggaatcatagagtatccatcaactttgatagcttttacattttttggagttgttttaaaaaaggctttactaagttcaagcatttcacctgtttcgtattcctctaatcctatcaactcattacctccaccagcagaggctgaaatattaagttttggtatagaataaaaattaatttcttgtttatttctatctttatttagtgcattttcctctttatcaatgtaaaattttttacttaacttgcttatattatcaaaatattttttgctaataggtgttttgcctttttctatattaataatttgctgtcttgttaaattaagcttattacctaattgttcctgtgtaagtcctaatttttctcttatttgtttaaaatcatttgcggtcatatattacctttataaaaagtaaaatatttaacatattttattgactaatgtaaaattttttactataatacttcaattaaaattgaaattttatcacaattaaaaataaacttcaattaaaattgaagtattgaaggagaaaaaatgattaaagcatattttgaaaacaatgctattaatgtaaaagcttttgctagaactcacaacattagctacgatattttacacagaattatcaaaggcgaaattacaggtgaaagaaatactaagggtagtacaaaagcggtatttaaaaagctcttagagctcggcatcattaatgagcttccgcaaggattaaaatagtgtatttcttagaaaccaaagaagctgcacaagcttttaatgtaagcacaggtgctttgagacttgcagcaagtagaaactcaaataaatacgagtggttaaaagtagataatgaaaaaggcggcaggggtggcaaaaaactactatttaaaataagcaaagataagcttttaaccgcctttaaccaagaattaatcactaaaaatactttaatttatgatgaaaaaatgcaaaaagttaaattgagcgaaattattactaccgataatttaaaaactataaataatagtttaaaaactagtaatttaaatttaacagagtcaaaaataaatgatgatttggctgttttaaatttaaaatttgaaaatttaagcgatgaacttaaagaagatgcgaaaagtaaagtaaaattacttaaacaagtagaaaaatatattgaaggtggtcttacactcaaaagagcattgtttttatgtaatgtagaatggagaaattattctaactggcgttcagactataaaaagtatggcattctaggcttagtcgacactcgcggacttcaccgcaaagataaaactaaacttagtgcttggatgcaagaatatgccttaagagagtatcgcacctttggagcaggtggatttaatttcactgagctttggtggcaaattcataaagaagcagctactaaagaaaattatgactttataggttttgacttaggggaagtaaagccactctttagtgtaaaaaccttgcaaaactttattaaaaactactacaaagataaaccattagaacattgcattattactcaaggcttagatcgtgcaaaatctaagtttctccctgcacaaggaaatcaaagagagctatatgacatgaaaaacatgtgttggcaaatcgatagttccccagctgatattatagtaagagatgatgaaaccttagagcctttccgccctcatatcttaagtgtcgttgatgtctttagcggtatgggtgtggctactttagtaagtaaatcaaattctttaagtttgacgcgtcttttatggaaagctatagataagtttggtaagcctgatatgattaaaggggataatggaaaagattatctttctaaagattttcaaagcttgcttgatgggcttaatattacctatgatgcagctattgcttatgcaggagaacaaaaagctttagttgaaagacgctttgggacacttcaacatgcaggaatttctaaaatgcatggacatattggcaataatcttgccaaaagagaaatgatagagcaaaaaactcctaaaaaagatagacgtgctaaagatgaatacggctttgctaaaaaaactaatcaaaaattacttcttacctttagcgaagcttgtgagtttttagaagctgaagtgattaaatggaacatgagcaaagttcgtcgtaaaaaaggcattaaaactccacttgagctttggaactcgtgcgatagagctattgtaaaaatctcttatgaagaatttttgtttaacgctggaaataaagaacttagggtcgtgggtaaaaaaggcattaactttgaaagtagagtttataaaagtgctttaatgccaagtgttggcacaaaagttaaatgtgtacaaaatatcgataatattaaagagcttttcatttatgatttaagcggaaacttcctttgtctagcacttgatgaaagtatcgctaaacttagtaaagaaagctataaaatgcttaaaaaaggttatgaaagtgaagttaaagcgattaaagaagtgcttaaaaaagatgagattgccgtctttactaaacttaatattaaacaagacttacaagatttacaaagtgcttttgaaaactcactcgtagaagctaaagaggtgcatcaaaaatcccttgcaaaagaaactttaaaaactcaaagagaattagaagagattaaaaacaatgctaatgcggatgagcttattttaaacgctaaaaaagaaataaataacgatgaaagcgagtttgacatggaagcttttgtcgaaaagaaatattttgctggttaaaaattgtttaaagcttgattaattcaagttttaaagagtttttactcataaaaaacaaaaggataaaaaatgcaattagtagaacttactaaaaagtttttaagcacccaaaacatctctcaaaacaatctctccgatcgtttagggattaataaaagctatatggtgggctatatgaaaaaaggaagtagctataaatacgcttcaaaagtagagtctttacttgaaaaatacattaaaagctttgtggaagaaaaaagcgtgaaagagcttcaaacaccttttattgccactaaagatgcaaaagcaattaatgtaaccattgaaagtgccatgagcaatcgcgaaatgggagtgattattggcgaagcggggactggaaaaagcagagccattaaagaatatgccactaaaaatggaacaagagtggtgctttttgaagctacaacagaaactagtaaaagaatgcttttggtggggcttgaaaataaactcaatgtgtgttttaaaggttctttggatgataagattagaggcattgctagcgagttagcaagaacttcaaaggttttaattatagatgagagtgagcatttgccgtttcgtgctttggagtgcttaagacgcatatatgatttttcaaatactgctttaatcttagtaggtactagaaaacttaaaaacaatcttacaggcattggcagaaatgattataacgagtatggacagctaagctctagaattggtgcaaaatgggaattaaaaggactttgctaccaaaacaaagaaggtttaaaaaatgaagatttaaaaactctttgctcctattttaatatagaagataaaaaagcaattgatttggtttttaacttagctcgtggcaattttagaaaaagcgaaaagcttttaaaaagagcttgtgaatttgcagatggaaaagcggttgagcttaaacacatagaagccgcagcttcatttttaatgttgggataaaaatgacctttgaagagatagcaaaagaactgggtatttcattgacgcgtgttcatcaaatctataaacacgctattaaaaaattaagaagtcctaaaaataaagataaatggcttgctatctttgaaactttagacttaatagagcaagaaaaaacaaaaagaaacaatttaatacaaggagtagatcatgacaacaatgattaaaggcgaaaaagcagactatagtgcttcattgtttgaagtaaaaggtgcgggtatttattttaaaaaaagcggcacttttgtggatgttttaaaaggaatttatcctgattatattgcacaaaaaattcttaattttcatttgaataaaaagctgaataaaagtgcttgatttaaaagcactttaattgcgttttttctttttaagtctttttttaagaagacttaaaaagggtaaaaccctaaaatcatcaaaaaaggagaacaatgccattagtttatatagcaagtccttataaaggcttagctgtgcaagaaagcagacgcaaatcattagccataagcgttgccgagcaagaatgcttaaaaattatacgtgaatgtgaagattttacgcctatttcacccatactacaatttagctatttggaagagaataaacacagagacaaagctttacaaatggggagagagcttttaaaagcgtgtgattatatttatcttagcaaacacaaagacgctaaaaattcaacaggtatgcaagaagaattagccttagctaaaaagcttggcattaaagagctagttttggagttgcccttacaataagggcttaaggataatcaagaaaaaaactaaacacgcagtgcttttaagatatggcgtaattctttgggattatcaaattaataaatttaatttaaaaggagaatagatgcaaataaataatttagaagatgttaacttagcacttaaaaaagtggcagaacttagcgtaaaaatagaaaagattaatggcgaggtgactttagcttgtaatgagattaaagaagctcgtgcaggagagattaaggttttaagtgatgaacttaaatatatagagcagtgcattacaaccttttgtgaaaataataaacacgagtttgcagaaaaaagaagcaaagaatttacctttggcaagattggctatcgcttaagtaaaagtgtatctttaccacgtgtgaaagaaaaactagaaaacttaatcaaagctttaaaaagctatggacttaatgattgcattacttataaagaagaacttaataaagatgctattgcagagcttgaagatagcaccttagtaaagctaggacttaaaagagttgtaaaagataattttagaatagagccaaagattgaaagcttggagattgaaaaatgagagagctttccttagcgacttttaaacttttaaatagtgtttttaaaacaaaaacagctcattttaatggctttttagaacttgattttaaaaataagcctaagctaaaaaagcaaagctttaaaagaaaaaagaaaatgacttcaaagcaaaaaattagacttaaaagaatttaacaagtccgctaaggcggatttgattaagtttttaaaacttaatttaaaacaaaaggataaaaaatgtatgtcaatgtaagcatagatgcgagtgatttagaagatatagatgctcatgatttggctgaactttttgaagatttaagcacaaaagagcaagaggaattctttggaattatccataaggatatcaagccattagaaagaataagagctattctttctaatttgtctaatgatgaagcacttaaacttttaaaagaacttaataatgagtttaaaagcgatgaggaatggcaaaaaactataaaaagtataaatggaggtaacaaatgaaactacaagattttgattttagagtttgggataagcatcacaagggttgtggtaataaggattgcaaatgccaaacaaaatatgtttatggtgaagaagccaaaacaaggttatctgagtttaaagaggattgtgaaatagagctttttacagggctttatgacaagaaaggtaaaaaagtatacgagaatgatattgttaaagttaaaagtctatacgattactttttagcaaaaatcagcattcacaaagaagggactttttattttgaaggaaaaaatggagattacataggctctttaatttatttagttgaagatgaaggatatactattgaaactatcggcaatatccacgagaatcctgaacttttgaaatgttaaaaaatattaaaaattttaacataaaaatgaaatatgttaaaaaagccaaaaaatttaacaaagtccattgatttaatgggcttgattaagttttagcaaggaaaaaagatgaatttggattttttaaatgagtttaagttaaaaaataaagatttaaacgagaaattagagtttttaatccctgattttttagttaaaaaagcaataactattatttatgcaaatggtggaagtggaaaaagttatttaagtgccgccatttctaaaacactttgcaaagatacaagggttaaaagcatcgtttatgttgacatggataatcctttaaatgttttaaatgaaagaggttttggtgaacttattttaaatgaaagcaaattcacttatattcacagatcaagcttaaaaacttcagcttatgagcttttagaaatgattgaaggcaaaggcgtagcaggaagctatgaaggggttttatttgtacttgattctttacgcaattttgcagatattgataatgatactaaaatgatgtctttaatgtctttactcatgaatttaagagaatgtggggcaaccattatggctttacaccattctacaaaagatggcagagcttttaaaggctcaaatcatattagaaactcaagtgattgcatgtattttttacaaaaagtggctaacttagaacaaggctttgaagtattgcttagtgtgcaaaaagaaagagcaggaattaaagatcaagccttttttatcaatacaaaaactctaaatattaaaaacaccgacttgcaaaacgctaaaatcagcgataaagaagaagcttttatagataaagttttaaagcttttaaacgaaaaaagcctaagcacaagtgagattttatcggctcttgatgtaagtaggagtgataatttttcaaggaatactttagagaaatttaaaggtgttttttgggaaagtgagcttagcggagagaatggtcgcacttttgtttggaaaagtttaaaagctgacaataaaaacagcaacgacaaagaattaagcttatttggagatgagttatgaaatttaaccctccaagcaaagaagatttaattaaagccattgatgagtttaatgctaaaaactcttgctctatcccttattttatagcagatagctttataaattactataagcaagacgatggaagatggctcatggctaataaaaagcctttaaaatgctggaaaagagcgcttaattcaacttggcttccaaagttagcgaacaaatacaaaaataaagataagcaaaaagctttagcttcttggctagaagaggagttttaatggataatgcaaaagaggcactaaaagagctttttggtattagtgaagttcaagcagtggttatagaaaaactttattttaaagccaaaacaccaaaagatatattaggctttaaaaaatactatgatttaaccatgttaaaaaagcaatttgttggtacaagctatgaaaaactttctcttgtgtgcgcctttgcagagcttgatttaaacttaaggtacaaaaatatagagtcttttttagaatggcttttcatttcattttcaaatcgttttatttttcaaacaaaaaaaggagatttctcatattcttttgtacttagatattatgatggtaacattgtttatgatgagttaggaaagcctgttttaaagcatgttgattgtggagataatctttattttattaatgctaataaagagctttgtgatgagcaaagaaaaccactgaatgtaggagagttttataataagctagttgaatatatgtttaaaaaccaagataaaattatttttgataataaaattgaaataagccctgttattaaaactcaaattcctagccaaactaaaataaataaagattacgagcaaaactatttagaatacaaaaagaatcaaaataagctttataatgcaaatattgataaattcacttcaaaactagagcaaattttaaaggctaaaaaatgaatactcaaaacactttaaaaaagcacttaattaaaatcattcatactttaagaaaagatgctaatttaagcgatgatgaaagctatcgctgggttttaaatcaaagatatggcaaagcttcaagtaaggatttaagcatagatgaacttagggactttgctataactttgggctatgatgaaaagtttttaaaaaagcaaaataccaaaaaagcaaggtattttaaaaaagaaaacactaaaagcggaagggctacaaaaaagcaacttaatatgatacaagccatttggagtaaaaatgctaaaaatcctactcagtgggctttaagagagtttattaataatattgtaaaaaagcgacctttgcatctttggtatttaagtatagaagatgctaataaagttatcctagggcttaaaaatttagaaaacaacagcacacattaagccaaacgaagctaatgttgtctcatcaaaacaaaaggagattaaaatgattttagaaatacattcttacgatgcagagttttttttaaccttaggcatagaaaaacactcacaaattgcctttgctgcaaaaagaacaagccttgaaataatgcataatggaatcactcatcagattaaaactgataaagattttgggattttgcttaatgtggtttgtaatatcagagaaaaacttgatgagagttttgaggaagaagataaaagcttggttattgatatagatgaaattgtggctaaagtttgcaaagaattagagtaatgctctaattcttttttctttctcatccatagggtattgtttatcccaagcctccataagttttctttcttggtcggataatctgatattataagttttgctcatatataaatagcttcttgcaatccagcctttagaataatttgcaggataaaatctttttgctttaaaatcagtataaaccttacaatttccatattgagtatattttaaattagtaggagcctcagcatatctaaaattgcttctatccccatttatctctcctatggctggaactaggttttgtttatcggcttccatttttgcaaaagttggatcatttttacaagcttttctgccaccttctttccagcaaggtaaatgctttccaaagttttgggcgggcataatatgctcccattctatgcgtttgattctttggttaatttttccttttttggtgtattcgtttctaggagcatataaatcacttttaatcacttcaaaactaatatattttccttttttattaaccttaaaaggtgcttgacaataaaaatcataccagtaagagctccctagatcattataaaattttactaattcttttttgctttcttcaaaacttttagcatttaataagcttaaagcaagtattaaaacgcttattatttttttcatttattctcctttttattttttaaaattataccctactaaataaaatttaacttttttgctataatttgcaaaaacactcaaataggactagcattgcttagcaataacgaatactttgaatattttattgattttgtgaaaaataacgacaaacgagaaatcttaaaagaatttggcggtgcaaatatttacataccaagctataaaaccttacttagagatgaagaattaaaacaggattttaaaacactcataaaacagggaataagcactaaaaatgcaagtgtggaatgtgctaaaaaatacgatttaagtttaaatgcggtgtatttaatcactaaagaattgagagaaaatttagaaccaagtttgttttagctctcaaactccacgctaattatataagcttggtcattaaaactatgactcacgcttttaatactaaattcataatgatccatattaatatctttaatcttaagttttccacctgctcttatttcacgcccaataagctcacatcttccatttaatccacctttttgaagctcattgagttttgcttgtgcttttttaaaagcttcattatcattttttggttgtgagatttgcattttatatatattctccccacttcctacttttatgctttttatctttgcctcatttatatcttgccattctgctattacggcactatattcatttctagcactttctgaaatttctaatgaaatacattcttttaaagctatttcaaataaaggtaaattttcattcttgcttgtgatattagcagcattatcgccaatcttaccatcttttggagtaatgattaaagtattttcttttacacagcaaataaaaccataatcaaagcatatactatataagaattctaaattactttgattattttgtaaaatacttactatattttgatcctctccacttgttttgatttttagattgttttcatttgcgatttttcttgctatggtaaaaagagtagtgttttcaaagcttcttgtctttttctcttttatattaacgctgccttttccactaaaattaatagcacttgctctaacttcagtagtatttgaagtatagtttttactcactacattcacactaaagcttccacatttataaagcttttcaaagccaagccaaagctctaaactatccccaaaaagtggcttggaataaagcccaaaaacacttaaacttatctcatcactttcagctttttctttatcttcataactaatgttaataagatttttagaaagtttttctgtgatatcctcacctttggcaataagtttaaacttaggttttcttaccataaagccttttccttgctttctttgattttaatactaggtaaaatcactttatcccctgtttttaaaagaggctctaatcttggattggctaataaaacttgattaaaatacaaaagtgtcccataatgcttatagactatactatcaagcctctcgttgtttttagctatgtaaatcttactcatcaaaatccctttctaaatccatgctaaagctttgtgctacaaagccacttccatctacaaatgcacttctgttttcatttaaggataaaatcacaaatttaccataatactttccattagctcctgttaagataaaagatctttgttcttttgccatattctcaagcttatctaaataagtatttctatccccttttaaaggtaaagttttgccttgtattttaatcttttcgctttctttagaacttgcaaataaagcattatgattattaagcctattttgactttgtatgttatattctaagcttctttctaaattatcaaaatttaaagctttaaactcaaattctcctaaagctaaaaccatttaaactcctttttagtttcatcaagctaaaattatcttaattagataaggttgatacctaaaatgtagtagtaggatagtccaaattaattggggtatgtattgtgagtgcaagtctcaccgccttatctgatcttaatatatgtcttattatctttattaatcgcttctacttttcctaatgtaactattgcattggttttaccaaacttctttagcttataatcaggggtaattacaattttattgatacgactagcatcttttttatcttcaaagaaatacaataaagaattatttgcattatcccaataaacttcttttgcttcatctaaaactttaacaatttgcttgatttcatccgcgcttaaagcctgattataacttgcctttcttttaggacttgcgtgtaaaagattgtttttgctcagtgtaaagtataagtcttctaagtcttttttattaagtttttctaaaaactctttggtgcttttatccattttacctacttgtatgaaattgataggatatttttgattatctttaatgatgacttcatccaccatatcatctaagcttttttgccaagtgtacagttctttttgatgagtgaagcttttaacttcttttgtttttttagccgctgcacttaacatatcaagttttataaagttttgaatgacttcagtgtttttttgtttataaagctcatctaaaagctcttcatcattaaagccattaaattcgctttctttggcatttgatggtggtatttttaggcctttaacttcactttcacctacttctaaaacataacacctgcaaccataatcatgcatagttacatgcggataatgactatcccaaaaaggatcatctttatgtaaaactatgccatcaaaggctctgtgtttgtccctaaccaaagaatctttttgggtgcagtatttaaaataaggtttagtgcttttcatttgattttcatagatagctttagctttagcttttcttgagttttcctcaaagattttttttaatcttgcactattaaaatgagtttttttaacttcacctgttttagggtttataacttcctttgaaccccaccaacctttagcttttaatttctcctctgcaatcttactccaagtgctaaatttatccccatttttaatagcatttactaaagtatcttgcatatcttttaacaagctttcatccataagcttagcaatagtaaagacttttttatgggttgaatatgaaagttcatcataatcaaaactaagctctggctttttattttttaaaaaatcaacagctttagtaggttctgaaaaaaatcctatttttgcacctgtcattttaatcctccaagtatcctaaaatactggaattatttaaagctataaaaagatgtttttcaaactcgctttgctctaaactagaaaaattttctttaagtttattgagtgcctcgttaaaatctttacaatcttttacaatgctttcaaattgctcttgaaaaaactttgacatgctctcatcgacttttaagtattctttttgttctaatcctttgtcaataaaatcttcttcaaagctctctaactttactttgttttcaaagacttttttatcattttctaaatctttaaagtcttttttttctaaagtctctcttataagctcaccctctacattataagtgtttttaatgtattcttcatcaaagcaaaagcccatgttaaaaagttttaagtccctttcgcaaagctcactttttggttctgcttcgctaaaaaactgcacatagagttcatctttaaaatgattgatttctttgaaaaacttaatggcacgatttaaaataaaaagaacgatttgtccatcttgggcggctaaatcttttcttatttgattatgtgattcagccgctgctaaagaacctccgcttacttgagaacttaaattagctcctaaaaccacgcttcttatttgattatctaagtaatctattatttcattataatttgccttagcctttggctggattaaatcaagctcttcttctttatcaatgaccgcactatcgccatttaacatttgatgaatttcagaagctagtgcatcaggatcgctatctgtttttgcaactgcccaaggagaaccaaatctttctaaaaactccatccaaaactttaaacttgcatttttaagctttactggaaaataaagctttgttaataaggcatcgccatttttaaataaaaaattagagccaaaaagtccataaattgcttttttatcttccacaatttcttcgcaaccattgctattataaactaactcatcattttcattaaagccaaaatttctaaaatctctttgttttaagattggatagtaaaaaccatcttttaacttgtaattaacttcaaatacattaagcccataaagataggtttctaagatttgacttaataaatcaggattgaaaagatactcaaagctttcttttattttttcgttttcacaaacgatttgaagctcttttgctaaaatcacactccttcgtgattgatgagcttgagtaaagcttagatctttaaaaatcattttttgatcgttctcgctgattttaagcacatttaaatagcttgagtttataagagtgtttataagactattgttttttaatatcacttctcttttggatttgatttcttttttcatatttttcctttaaaaacgccttattcttgaaacagagttaaaatgatgctttcttcttttaatgctacttttagttcttgctaataaaaatgctcctgctaagctatcaggtgcatcatcatttttcccttctggaaattctaaaagttgatttataagcatagtttggcttttatgtaaaaaaagctcttcattttcaaaagcaaggcttaaactctcaatgcgttcaaacttgctaacgctattatttttaccacgcaaaggcaaaaaaactccactttctaagcttttttcttgtaaccatttttttaagaaaaattgaccgccattagtttcaatttcaatcaagcgacatttataaatcttttgaagattaaaaatggtttttataatgctttgtgcttttaagatttttacgatgctttctgctacataaaaaccctttgcacctttgccaataatggtaatcgcagtaaagtcactttttgctttttctcctgctgggtcaatatacatataatactgattaatggcaggtaaatcatcataaaaattaatgccatcaaggctaaagatttgattttcacttcttggattattgagttgctctttattaaaagcttttagattttcagcccttaacttcattaaatcttctaagcttttggcttctttccaaagaacttttgcccctttatccattaaaactttattttttaaataaaattgatgagcggtattaaaatcagcatttctataaagcatggcgtattcatcccataaatcaagcctttgtggaaactcttcgatggaacggaagactttaggattccaaaaaccaagctttaattttctagataacacgctatcattatgtaaaatggttccaatataaagcacatctaagcttccatccgcactccctaagtttaaaaccgcttcatccacccaatcttctaatttatccctttgatctttactcctgacattagtatcattttctaaatcatctaaaataactaaatcaggtcttttaaccccatatctaaccccacgaagtcttttaccactgccaaaggctttaatctttacgccattattacttacaaactctcctacgcgccaagtcttgccaattcctactacttcgggaaaatcaagctttaaatgcggattatcttcaagctctgctttaatagcttcaagcattccttccataagttcgaccgcatctgaaatctctactataaagcttttataattaaaaactaagcaccacaaaggaaagagttgtgaagtgtaggtggatttaccatgagctcttggtgcagctatggcgtgtttttcacctttactttcttttttaagtgcgatttttgtaaaaacttcatttaagtgcaaatgtaagccacattctcctttaatggtaaaataatgcggaaaataagttcttgcaaaataatcaaaatccacactcgctcttttaattctttcttcttttaaagtaggatctaaatggctttcatgcaaaaattgagtttttaattcattttttagctcatccatccattctaaaaagtcttttctttgcatagcaccttttagttcatttggagtgttttcgtgcttttgttcgtttgagattaaaaactcatcgagttcttctttggaaaaaagcattaaatatccattgctaaaatttctttttctatcactccactttctaaaagtgatacaagttttgctacgcaatctttatcattttttaaatgacttatgataatttcaaccacttttttagcaacatttaaacgatagctacttggatcttctaatcttgcaacctttctcatttttgaaaagctatcgcctatccttgcaatggcttcagttttcttttctgcattcattttttcatcagtatttatattttcaatcgcacaaaacatttgctcagtaaaactttcatataatgaggcactttctttatcttttatttttgaagttaaaagattagctttttgcttatcccaatcgccatctttggctttatagtttctaatcgttttttcattgcggtttaaaatttttgcaattttaaatatatcaaaacctgcaatataaagttcttttgctaaatcttttaagttgttttgagacttcgcggatgaagtaaatttatccttacgagcaggagtttcactctctgcacccacctgaaggccacacccgacctttgccatcttaggctttgtggtggaagttaaatttttagccatttaatctccttaaatccattctttttcttttaattttaaacgctctaaatttgttttgtggaataaagttatcttcgttgatttcagttggaatttttttatttgccatttttaaaagtaaatcattagcccactctctaatctcttctaagctttcttttggaaaatcatttcggcgttttaattccataattgtaagctttacacagatatcttttaaaagaggagttgggtttttaggtatctttataaaacttgcaatataactttgtgcatcattaatagcatcatcaatcacttctttatcacaaaccccgtcagcatttaaatcgctaagctctgctatggcatgaacgcttaattctttgattaaatccttttcatctatcataaaaaaatgcgttttagtttctgtgataagcttttcttctaaaatgtcttgataattcatttaaaaaaaccttttttaatgtggttaaaatatggttaaaatcgtttaaaatctttttctaatatctttttagctttaaaagcattttttgcctttaaagctaaaattgtgcgttttactctaaaacaagcttaataagtccatttggtctggtgcaaactggcatggctctcatttcgcctacaatttcaattccagccccacgaggtaaaatctcaggcttagaaacaaacattaaacttggtgcttttcctaaagcatcagtatgatttgctcttgtataataaatgcgattagaattatcctttggcacaaccataccctcagtgccttttaaaaattcaacgctttttccatttgtatttttatattttgcactataacggcgatatttggtgccatataaaattaaggacttatctttctcatccctacttgcaagatgatttttataaagatcttcgcttaatgccaagttagaaatagccgcaaaaagttcatttccacaaagcacttcataatcagcacttgttccaaattcatcaataattgctgaatcaatcgcatcacaaacactgtctaaagtcacactcccatcttttttaacactaatagctttcttacttgcacttccaaaatcaaaaagcacatttcctttgccatctaaaatcttgccaaataaagcaccatttgccatatattcaagcgtagtattaaagctttctttcatttctttaaccaaaaccccaagagctccacttaagcttttagcctgagcttcttgcaatgctaaagaccttaaagaattaatctcactcgcactgattctttttgctaatgcaaagcgtggtaaaggtatatttaaaatataagcgtctttagtattttctaaagaatgttccccattatctgaaatgctatttaaaacaattccagcaccttttataatttcaacccttacggtgctctctaaacttgggattttatccttaaaaaaagtatcacttacaaagcgaggtgaagctttggtttgattaataacttcagttatttttgtacttgaaaaaagttccaaaagttgctctaaatccatttttactccttagtattaataattaaattttgcataaaagcctttttaaccgcacttacatgaacgccttttaaattgatttctcctgctaataaaatcccataaattccagaactaagagcgtgatctttaagcattgctaatttaacattttcttttgcactaatatcttcatttggacattttttaaagctttctccaaaatcttcgctgattaaaagcgttccaagagctaagcttccattagtttcaagatctattttcgcattaattgaaaacaaatctttattgataaaactttcaaggctttttggcatagcaattaaaggatcattgcttaagctttttggtgtgacctttgatggcatttcttctcctttttcatttataaattccttagtggtttcattttcactcacagcttcttcattgactaggttctcatcttctaaagacaaagctttaggtaagtctccagtttccaagtcttcattttctaggttttgggtttcttttttagctttagccatttttaatcccctaacatcattttcacaacatcaaactcattagtttttgctgtgtttttatttgcaaaaacattattttttggaacttgcacttgatcattcttggtatctaaaaagcttttaaagccttctaaatccttacaagcatacattagcgcccattctttttgggaattagcaatttttccgctatttaaagcattatcaactaaagagcttgctaagtttttaacgctttcttcgttttgtttttttaaagcttcattttgtaaagcgagtgagctattttcattttttaaagctataatctgagattctagctctttgattttttcatccattttctctcctttgttttgatgaatattatttttgttagcaatgagttcgcctagctcatcaataaatggtgtattagttagtgcgactgagtgaagcttagctcttactagttctccacttttattgtcttttgaattaaattcaaacacaggggataaatagcggtattgcttatttgctatatattttttagcctcttcgttaaactcagccttagccattaaggcatcattttccaaataaagctctttaatccaacctgcagcaggtgctttttcattttttaagctttgatgctcatagtcaataaccaaatcaatctttttttgattaaaattatcaatcattgagtttaaatctttatcatcaaccttaaacctgccattattatgccctttccactcacccttaattgccacttttatgggcttatcattgctaacttcgactaaattttctttattgataaaaagcattttaaatccttaaaaaatcatcttttggtaaaaagctactttgcaaagttcttgcataaatgcttaaatagccatgatcgcttattccttcgtaaacctttttaagatctttaagctctattctaaaaccattgctaggttctgcatttaaaagcactttatcaacagcttctattgcatcaaataatttatgcttagcatcaattctgtgtttaggagcttttgattttgtatgggttaaaatataaagtttccaagttcccactttattttctaaatctttataactttctccttcaaaatcaagcaaaagcgaagcatctaaattattaatacaacttgctatgttttgggtgtcttcaaactcgcctaaatacattcttactttaaaatcttttaatagttctaaaagctcattttcaaaacttttaagcatttttcatcctttaaaaattagcggcaattttaaaatgagttctttttttaatcaagcaaattattttttcaaagagttttagcacaaaatttttctagtttttgggtcagctttttaactaaacttacgacattttaaaggagtgaaaatgaaaaataacccttattttaaagaaagcgaatttaaatgtaaatgcggcaaatgtgaattgcctcaaaatgtgccaagtgatgagcttatagacattctttgtgaaatcagagaacattacaatgctcctgttattataaatagtggatatcgctgcaaagagcataatgcagaggttggtggagcccctaaaagccaacacgctataggaagtgcagcggactttgtggttaaaggagttaaaacagaagaagttcatcaatatgttttaatcacctatggcgaaagaggtttagggattgctataaaacataattttaatgatccttatgctgggtttgtacatttagacactagaggcaaaaaagcaagatggacttatccataaggaaaagattgtgtttagttttattttatcaaggtttttaagtccttcaaaaatagctttttttgttctaattgctctttgtggttttttatatttaaaaaacaatgctttagctttagaaaatgaaaatctaaaacttaaagctttgcattttaacaatgaaatcaatgtttttaaagataaattagcccagcaaaataaagctattgataaattaaaacttgatttaaagcccaaagagactttaaaagaagttttaaaagtggataaggtttttattaaagataaaagctgtgagagtgaacttaaagcttataaagaattatttaatattttaggagcaaaaaagtgaatgataaaatgagaattttcctattaattataccttttgtttttttaagcgcttgtgcttctaaagatattttgattaaaactgaaatcaaagaagttaaagttcctattaaatgccctttaaaacttcctttaaagcctttagacaaaaaagacttagaaagtgctaaagaaatctctaaatattacttagaagttgaaaatatagccaagctttgcacaggagagaaagatgaaagaaaataataaaatgataaatcaaaaaagcattgcaaaagatcttcttatagctcttttgttttcaacttttgcattagctttattatatttatttgaaatttttacaaggagctagcaatgaaattagaagatatatttgtatatatggttttaatgatagtaagctttatagctggacttgtaggaattgtaacaaaaaataaattaagcaaagctcttaatttaaaaggtaaatttacactctttttaaaaggtatgctaggttctatgtttgtagcatatctagtttttgaaattgtaaattatcttaattttggcataaagcttagcgttgcagtgggtggttttgcagcttatatggggacagatgcattgcttaaaattgagcaacttgtagaaaagttaattaataaaaaaatggaaaaactataatgaacgaacttggcatcatttgcgacattaaagacaataaagctaaggttgctattggagatatggtaacggattttttaagtgtttttcaaagtctagctaattcttatgcagtgagcttttctcctttaagaataggagagcaagtattagtcatacctgtgcgtggggatttaaatagtggagttattttgcgtggtctttaccaagaaaaacatagagcaaaaaatacagatgaaaatacttttaatatagattttgaagatggaacgcatttagaatacaactctaagagtagcactttaaaacttgatgtggttaaaaatataaatatcgcttgtgtagataaaaccacccataaccaaaacaacaccttaaatactaaaaatcatactacaaacgctaataccataacgcttaatgctccaagtattaatttaaatggtaatactcaaattgcaggagcaatttctacaagtggcgaaggtggggcaagtggtacttttagcataaaaggaaatttaaacttaataggcaatttacaagttagcggaaatataagcgatagcaaaggtgatttaacaaatcatacccattcttgtacttgtggtgccacagcttcgccaagataggaaaaactatgaaagaattatttttgcttttattttcattagtcttttttatgctcttttgcatgggggcattttatgcttttttaaacctaaacttttttatcaaaagcatttttataggcttttttatagcttttatgtttttaggattttcgcaaatgctagaaaacatttttgaattttacaaaggtttaaaatgaattacatggtaagcatcgaagaaagtatcaaagacattttaatcactcctttaggctcaagagtaatgagaccagagtatggttctttactttatacactcatagatagaaaaatcgatgatgattttaagataaagcttactagatacactgcagaagcaatttcaaagtgggaaaaaagagtaaagctaaaaggtgtgagacttaatgagtgtaaagacaataaattaagcattaccttgctttttgaaaattatggggatttaacaatggagctaggcaaatgagtgagcttttaagtgcaaatgatagctattttaaacaaagctttttaaaggatatcccttatccacaaatcatagaagagcttgattatgaaaagcttttaaaagcctatgaagaactttttaaaagctttttaaaagataatgtagagcttttagaatctgacccttttaaagccattttagaagctttagcttatagagaaatgataattagagcaagaattaatgagagtataaaagcaacttatcttcattatgcaaagggaagtgatttagataatgtagtagctaatggctatttgatacaaaggcttaaaggggttaagcccacagctaaagtagagtttgaattaaatactttacttacctatgatgtcatcatcccaaaaggtgcaattttttcaaatgaaaaagcagaccttgccactttaaaagaagaagtggtgattaaaaaagggcaaagtaaagcacaaggtattttagaacttaatgaatttattcaaagcaaagaaagtaaaaccgagtttttacaaaccccactgccttttatagctaagattaaacaactagaatttttcaaaggtggagccagtgaagaaagtgatgaagccttaagagaaagggctgtaatgagtgtacatcgcttttcaaccgcaggaagtgaaaaaggctatatctatcacgctttaagcgcaagtgcaaaagtagcttccataaaagctttaaacaatggagcaggaaaagtaagagttatcattaaaagtgaagatgaattaagcgttgatgtggttaaagagtatttaagtgcagatgagcgaagacctttaactgatgaagtcagcgttgagttagctaaaaaaagagagtttatcgtagatgccaaacttttgcttttagaattaagccgtgctaatgaaataagtgaaaagattaatgctttgcaaaaggactttgatttaagtgtggatttagcactgggatttatttataaatgtcttcatcaagacggagtttataaaagcgaaattttaagcattaaagaaaaaatcataaatgaagaagagcaagaattaaaagacttacctttagcaaacataataatagctgatgatgagtttgcaacccttagcttttcacttagttatgaaaaggcggtgctatgaatacactaatactaaaccaccatccaaaacaaagcaaagccattgatttaagtgctaaaacaagatttgaagatttaaatttagctagtatcacaaatctagctctaaattgcgatgaaagattattgccaattttagccaatgcttatgatgtaagtattgatggtttaaatgaaaaagaagcaagaaagctaatatctaaagccttgcttttagacagatacaacggcacaacttgggctataaaagaagctttaagagccgtatttcctactgcagtggttaaagagtggtttaattatggcggaaagccttatttttttaaagttaaagtaagcacaactaatgttagctttgatgaaagaacgcttaatactttagaaagactaatttatgattttaaaaatgttagaagcgttttagaagcaattgaaatagagattaaaagtaaaaatgatagttttaatgctaatgcacaaataagtggagaaactatagaaatcttaccttttcaaaccacttttttagaaaatgaaattaaaagtactaaaaatgtatttggaatttttatgtgtgaaataacaagaactaatattgattttaaaggagtgtattaatggcaaaaagtgaatactataccatactaacaaaaattggcattgctaaatttattgctgcaagagcaagtggaaatggtatcaatttaaaaagctttaaattaagttcaaaagttattttgcccagtgaagaaatgcaaagcttagaagagattgtatatgaagctaatattagtagcaaaagcgtggatgaaagcaatccaaactatgtgaatttaatgtgtcatgtgccaagcgatgtgggcgggtttgaagttaatgcagtaggcatttatgatgaagcaggagatttgcttgcagttggaaatgtcccacgcacttataaacctatcttaaaagaaggcagtgctaaagagcttatgataaaaattgtcatggagctttctaatgcagaggaagttattttaaaactagatcctagtgtgattatggcaagtcgtgattatgtggatgttattaaagtggaactcaatcttaaaattgatgctttaacgcaaaaatatgatgcagagtttaaaaaagtatgggatgagtttgctaaatatcttttagaaaataaatttaatacagaaattgccaaatatgttactttagctactaatcaaaccattacaggagccaaagactttaccaaactacctacaagctctataaaagctacaaatgacaatcaatttgtaaatttagctaccttaaaagaaaatcaactcaatttaaaagatccagaacttttagcattgatagggtttaatacctatcttgatggaacttctttacttaaatctcattctatgtctaataatgtgatatacacaaatacaacaggaggaaaaacacctattgcaataaaaattcaacaaatcgataatgtagtcaatcaagctagtattagtatatacataaataattctttaataaaaaaaataaatgctatacaatacactaattcaacaggtaaatatattccattaacacattatgaaggtattttgaaaccaaatgacacatataaaatagaattgtttaatattgttatggataagccaaatattgaggcaacaattttaaatgtccaataaggagaaaaaatgaaatattttatagacaaaaacgataataatcaaatttatgcttatgaggatgaagtgagcgatgagcaaattaaaacaggtttaacacctattagcgaagaagagtttaatgctttaacaagtcctcctaaaagtgaagaagagcttttaaacgaggcaaaagaattaaaaataaatgaaatcaatgctaaaaaagaaagcgttttaaatggtggattttcttttaaaggtaaaatctatcaaagttctaatgaagatcagttaagaattaatggagcagtaaccaatgctcttgttaatcctaatttaattccttatattgattggattgcgcttgataatacaactacaagatttagcgtagatgagtttaaactctttgcaagtagcatggcttattttgtgcaagagactatttttaaagcaagtgctttaaaagaaaaagctagaaatgcacaaagcaaagaagaacttgatttaattgtttgggagagtgaaaaatgactaaagcagaattaaaaagagtatgcgtaaagccatacgataaggacaggtttgaagtgatacaagattatgagtttgctttgcttagttttaaaggcattgtgccaaaaggatttaaaactgatggtgcaagtatcccacgccttttttggtctttgtttccaccttttaaaagtgagtattttagcgcttgtgtggtgcatgattttttatgcgaaaaagcaaattcaagaactgattataggacagctgatttagcattaaaagaagctatgactttgcttggatgttcaagacttaaaatctttgtattttatcattcttgcaatctttatcatgcaataaaatgcttgataaaaggaaaataaaaaaaggtgagctacccacgcagtgggacgggggctttagcaaaagcgactttgggcggattttattcgcacaaagtgaaagcataaaaaggagttaaaatgaaagattatggaatttcttttattccaaatattaatcaaggctcaaaagagccaagtgaacctatagttagtgataagcttaatgctcaaaaagttaatgagcttatagataaaaaactaaagctttttaaagaagagcttgttaataaagaggagcttaaaagtctcattcaagagattttaaaagatgagggttttcaaaatacaaacataaaaatatcaaaaaccccacctaactacaatacacaagctaaagtaggagaaatttgggcggttgtagaaagtaaaaagcaattatttatttgcactgctaatgataatgattttacaagctgggttgatttactaggagatggtagcaatgatattgcccctaaagaaaaaatcatcatcacatttgataacactacaacaggtggacaatatgggggttgtatgagtgatttaagacttggttttgaaaatggttttgctactccaaataaagttcaagatgagtatgaaaacgcaaaatttactatgactaaagatggtaatggtcttaatagaagcgattttactatagattctaatcctattgcaggagaaaaccaaattttaggaacgattaagacaagtggtatttatcaagaaacctatcacaaaatcgcccatgtgtttaaaaaatataatggtggttctgatgagtgttgcttatggtctagctcaggaacgagagaggtaagcatagaacttgaaaatacaccaatgcctaataagctttttgctagaggtaatggatattatggtcaaacagaaattaccaatgtaagagtaaaaaaatccatttttataggtgagcaagaaattcaaagtgaagattttaatgttgaaaagttagaagctagtgctgatacttatggagattatgcttttttatttgaaatttctaaacaagatcaaattgttatgaaaaaagagcttaatttaaatcctaaaaaaacaaaaaatacaaaaaatgtaaagaaataaggagtgaataatggcagcaaattatggagttaattttaatattagcaatggtgcggcaagtcctattaaagtgcaaagtgatacgcctataggtattgctggggctataaaaggtgcaagtaaagaaatgatttacacaaaggctggttatgaaagcgtggatagctttccaatctttgccttttcaaatgtaagcaaagcaaaagaatttgtaaacgatttaatcaaagaaaataacttacaagattttagacttttagatactttagaatgtatcaatctacaaaatgtttctaatgtcataattatcagcttttttgaagaaagcgaggaaagtgaaaacactttaaccaatattgttaatgccatagaagcttttaaaaaagcaaagcacaaaacaggctttaaccctgatttaatcattgctccttattactcacatgaagcaggagtaaaggctaagcttgaaagtgtggcaagttctatgaatatcacagctattgtggatctttacgctacaaatgttggcgaagctattaatacaatggaggcttttagctctaaaagattaattgctgcttggccacaggttcaaatcttaaatacacaaggaaaatacgcttatgttccacaatctcctatcatcgcaggtttaatagctcatacagatggagataaagaatatggctttagtgattcttactcaaatagagtgatgaatggggttactggcacagagtattttatagagtttatcaatggctttgattgtgatgcagaaagactaagaaacgctcatatttcaacttgtattttaagtgaaggttatcgctcttggggtggggaaactagccatgaagatacgatttggcaagatttagctcgtgtaagaacctttgatcgcatagctctagcaggacaaaaagcagcttttaaggctattgataaaaaagcaagtgaattatattttataaaaatcagcattgaagaattgctaagagatttaaaaggagctaaggttttaattggctatgaggtaagctgggatgaagaaagaaacacagatgccaatgtgagtgctggtaagttttatctaaatataaaaatgatgaataatccaatcgttaaacaaatcactttagagttcatctactctgatgaatgggcgagtgatttgattaaaactattagtgcggatagttaataaatttttacaaggagaaaataaaaatgaaaagaataattggcgaagttatacaggaaggtaatatttatatagatggacaaggttatcttggagtggttagaaatttaaaattgcctgatatagaacaagagatgattgaaaccaaaggagttttaggagcaaattatagtagcggggttttaaagcctttagaaattagctttaaattagccgttgttgatccagtgctttatgcggctttctttcatactacttttagcgagattaaagctcctttgctttttagagaaagtgttcacaaaggcggtaaaaactatggtattagtgctgagtttttaggagagtttataagcataagtgaaagtgatcatgaaagtggaaaagaggtggaagctgaaattaaaatggcagttcatttttacatgcaacgccgcaataacattccaatcattacctacgatcataaaaacactattttaatgataaatggggtggatatgatgagtgatgtaagaagcaatttaaccctttaaacactgattaatcggagtttaattaataatactgggattttaggattaaagtttggctttttgggcattgcgtagcaatgggtggggaagcctttagttgcttctcaggcggaattacttccgccataaagaaggataaaaaggaaagaaaaatgaaagaaaaaataatcaaacttgaaaatggcgaagaattaaaaatgagagagccaaatgtgcgtgtactcaaaaacgccactaataaaggtgaaaaagaaatggagcaaactatttgtatgatagctgcacttaccaataagcaagaaagtgaaattgaagatttgaatcttaaagattttaaagctttacaggacgctcttaaagattttttggtagaagcaggagttatagcttagaggctatagcccttataagtcatactttgcattggggattaaatgaagttttagatttaagcttagatgagtttgaagaagctttagcaatttcaaaagaatttttaaaggctaagagtttttgattgttttatttttcaaaaaataaatttttaaaatagcaaaaagaataaaatctaaacttattacaattagccaagtgggtaaaataagcaataaagcaatgggtggcattatcatcactaaaatagcagttatgataatgcttataaaataagaaaaaataaaaatagccattgtattaaaaaaaccatcacttgcactttgatagcttatgtaaaaagcaggtatgagcgttgttaataataaggcaatatgtgaaattatatcatcgttaataaattttaaaactttcatagtaaagattttaaaatacaatcgcttaaaaagggttgaatatggaaaatgctggaagtattggaattggtgttattttaggactagcgattaaaaacgcaagtgccgttggcaaggtagttaaagattttagcaatttagaaaaaatagcagcaaaaactaaactcggcattaatggattgcaaaaagaattaaacactcttaaactcaatgccaatttaagagcggaattaaaagctcaaagaaaaggtttgcaagatgagtttttaagtttaggtaatgttattcgaggtggaattattggtaagggtttaggagaagctatcagctttgaatctgctatggctgatgtgagaaaggttgtgaattttgatgaaggcgatgatattaaaaaaatgagtgctgatatccttaagatgtctcaaactttacctgttactgccaatgagttagcagctatagctgctgctggaggacagattggacttggttcaaaagatgtaagagaatttacaaatcttgtaactaaaatgaaagtggcatttgatatgagcgctgaagatgtgggagatagcgttgcgaaaattaaaaatattttaggcatttctttaaaagacatggaggatttaggcgatagtattaataatctttcagataatagtgcatctaaggctagagagattattgatgttatgaaaagaactgcagctgctggaaagcaaataggatttactaaagaacaaattgcggctttaagctcttcttttatatctttaggtaagggacctgaagtagcaggaacagctattaatagtctttaccgcgttttagccacagctgataatatgggaactaaaactgaatctgcttttgcaaagcttggtataagtggagcatttttaaaacaagccagttttgatgatcctcaaaaagctttagatatgtttttacaaagaatttcaaaactagaccaaaaagaacaaatgggcgttttagttgatatttttggtcgtgaatttgcagatgatatggcaactcttgttggagggcttgacacttataaagaagctttaaaaaatgctggtgatgaagcaaaaaaaggctctttacaaagggaatttgatacaagggctgctaccactgaaaattctattatattaatgaaaaatgcttttaattccttagctgttaatttaggttcggtttttttacctgcaatatcatgggtgagtgctggaatttcttatcttgttaatagtatcacttatatcacaggacttgtccctggtcttaatggggttttaggaggacttatagccacttttttgctcgccaaacctgcagtcttagcttatgctattgctaaaaactatcttaaagattgcaccattttacttaaaagtgctttgattaaaacaagaatacatcttttagcttttcgtaattcttgtatattatctaatattactttaaaagcaaaaaccgtcacaactactatttacacaacctcccttaaagccttatcttttgttttaggtgggcttaataaagtttttaaagccgtagctattggtattagagtgttaagcatggctatgatgagtaatcccatcggtcttattttagggggcattgcaatagtggctgggcttattattgcaaattgggataaggttaagtcttggtttaaatcttttatagaatggcttaaacctgtttgggagcctatatacaatgtcattaaagcagtatttgataaatgtgcccttgtatttacaagttttaaagatattattatgagtgttgcttctccattagctgagtttttaaattctatttggcaaggtgttggcgatttcttttatagtatttttggttctttatttgattggtttgcttctaagctttcttgggtaggagatatgatctcatctataagtggctttataaaagatgctcttgattttgtagggcttggagatgatgaagaagttaagataagccaaagtgaacaaaacaaagaaaaagtctttactacaaacacttataaagatgaattagctgagacaaaaagtataaatcatgctccaagctttaataatggcaatatcaatataagtgttaatggtacttttaacatagcgactaaagatggcaattttaatatgcaagaatttgcaaatactatacaaaaaagtgtatttgacgctttaagaaagcaagaacaaaacaaaattaacactacaatttatggataaaatatgagtgaatatatagaaataaaagggcttgaaaacttttttaaagcttgtgataaattaatagatatggataaacacgggcaaagcattatggcgggtgctggagagagtataagaaatagcattatagactcttttaaaaacgaacgcagtatttttaatggaaaatggcaaagcttaaaaccagctaccataaaacaaaagataaaagatggtaagaataaaggaattttaaaaagagatggagaattaagtaatgctttaaattggcaaagcgaacctaccaaaagcggagtagaagtctttaataatatacagactaaaaatggctttaaatatggttatgttcatcaatggggaaacagaaaaagaaaaattcctcaaagagcttttttacccatagataataacaaagtcttgcacccaagtataagaagtgtgatttataaagatactaaggattttattgaaaaaattgttaagaagtgacaatatggggcattgcatagcaaggaatggtcgggcgtggtctttagtgatgcgactttttggaaaatcgcaatttttcaaaaagtgttagcaagaatggcaaggaagactaaagccttcctttttctaaaaactagcaaaagcattatagctttgtttttaaagcaaagcttttttaattttattttgaaaggagtttgtatgaaaaataatacagacaaatttctaaaaactagcacacttactaaacctacaagaactacactaaaagctccatttgcttgggtgggtggtaaaaactatttagctaaagaaatcattgctttaatgcctgagcataaaagctatattgaagtctttggaggagctttaagtgttttttatcaaaaaagtgcttcaaaaatagaagtcattaacgacattaacgacgagcttattaatttacatctttgtataagaaacaaaccccaaagcctagcaaatgtgcttaattctatgataataagtagaaaaatctttcatatgcttaaaaataaagaaattaaaccaagaaatgacttagaaagggctgctttttatttttatcttatcagtacttcttttggttcaagcatgggacaatttgctatgaataaacaaagagcaccaaagagattatgtagggattttagcttacatacaaaaagacttaaaaatgccagtattgaaaataaaagctttgaatatattttaaaagaatatgattacaatgaagctttattttatttagatccaccttatgtaggaactgagaattattataaaaacacaggaggttttgggctaaaagaacatgaacttttatgtaatttgcttaaaaatatcaagggtaaatttatgctttcttataatgattgtgagcttataagaaagctttataaagattttaattttaaggagttgaaagtaaggtattctttaaataataatgttttaaaaagaaaagaaagtaaagagcttttgattatgaatttttaaaagctaagagagtaaaaatactctcttttattttagcaaagagcttaaaaactttagagcttctttgctaaaatctttattgcattcttctaggtaatttttatctaaaatagcaccgtattttaataaaagcaaaatcgctccaaaattattatgagttattgcataaaacataggctcttcgcccatgcattctttagttgcactcataccatttttaagatattctaaaacaagttcattgttatggttgcaaattgcgtttataaaagtcttgctaaaaccttttttgatatctactattactttactcatcttatctccttttgttttgataagacaagattagctttgcttggctgaatgtgtgctgttgtttgacatctttttgaaatcaatttgtattaacccaatcttgcaccacatttaataaatgattataatcactactcatggcttctttttgaaatttacttatttcttctttgcttacacctgctttttttaaagccttgcttactcttgctagaatactaaaagcattgccatcttcgccaactaatttcacataaacattaggatatttcatcttttctccttaaaattcacaaaaggtactttttaattcgtatctttgtttttcatcattatatttaactacaaattttctacctataatatatctttcaaacaaaggaacttgtataagacttttatcttcattcatctcaaggtttttagcgattgaataagagtttatgcccatattataaatagtcataagctctaatatattatccctagcaagataatctttttcttttaaaagctttttgtacaaaatcctaaattcactctctaaatcttgtatgattttttcttttaattctttatcggtgtaatttttgatatctttcatgtttatctccttttttgatagaacaaccttgtgttttacactctctgtgagattagcttgacttagcttattgtgtactgttacatcttagaaagttctccaattactacaccaattagcaaaaaatctccatttttataaaatatatcttcatataaaggatttaaagagtgtaaaatcactccatcatcttgttttaaaacttgttttataaaaagtccatctctagtattaatcacacaaatgcttttattcttaaaagccttatttctatctattacacaaatacttccatcttttataagtggctccatgctttctccatagcaagtgataaactcacactctttactaccaaaaaagtttaataatttttcatctacaataagctcagagcaatctattaaatcatttattccgcctccgcctaaactcgcatttgttttataaagctttaaaattttatatttattctcacattctaattgatctttaggagagacaccatagaaaaaataattaatgcttatattcctctcatttaaaaagtttaagatttgtggataaggaatggagtttctaaatttcatggaattaaaagtatcaggattgattcctaattctttggctatatcttttgtttttaaatctcttttgccttcactcgcaagtatatcctttaacttttcaatcacttcttgcatttgcattttaaatcctttgattttaacttcaaagaatttaaacataaaatttcaaaaagcaattaaaaacttttgatttgaaagatttttaatataagagcttgaaaaatctaacttcaagctctctaaattgatatttaaaaacatcttactaagctatttttttaacaagatttcataaaaaattgcttcattactttttaagttttctatgtaactatcttccaaagcttaatgccatagatagttacatgctatttttatataaaaagtggttaaactatgattatatagtgttttatggggatagttacatcaataagaaaatataaaaatactttaagcaaaaatgtaactatcctagagggtaaaaaacacttttgggatataaaatttaaaatcaaagctcgtgtttatccatcttttaaacagcatttaatcacttttttgggacaaagcggacattttgggatatttgggatattttacgctttagattaggaaagataaaaagtcatttttgtaagctttaaaatcctattatttgggatttttgctaaaattatttagggatagttacatgttctttttaaaataccccttaca

SEQ ID NO: 20 - DNA, 2324 bp, Camplyobacter Phage CJLB-15
taagattgaaagttttcatccattcatttctaacatctttatttatagtatactctttgccatttttgcctataaatcttaaagaattgtctttaggatcagctttatccatgaagaagttgtcgcctttggttaaatctttaacttttgaattaaattcttttctagcctcttgtgcttcttctttgagtgttttatctttaatactttctataaattctttagccgatctatcaaaatcttttaaattatttatattactaaacccccttcgcatttgtattcttgttccagctcttttgccaacttcccataatctcataaaataaaaagctatataatcagtgaaattattaacaagcattgttttagctctttctatgaaatttgtacttattccatgtcctagttcttttgcttttgaatttaaaataccatctattacagtttcaaagttagtacgtaaatcacctattgtttttaaaacttcaatcttctcttgtcctgatttgctttttggtttaaagttttcaaaattatccatgaccgctttataatttactgcaaatttgggattattggcatctcctatatttactttatttttttctaaagctctagttattatttgattatctaaaactttaatctcatcatcattaagtccttttgttatagcttcataattcttttttggattagtttcattaagtattttatctatatcttttgatatctctttttcacttccttctagtttttttcctaatttacttttatcatatactttaaaatctgcataatcttttctaatcttggttaaaatctcttttgcttcttggggattatcagcactttttactatattttctaaaaatgcgtcttttaagctatttaaaaaatctttatagttgtaacttgagctttcttttattttattgcctatagcatcaattctatcgtaaatctctttaacgcttttaccatctaatgcaccgctttttgcttcatgaataaaattttttatcatagctggtgtgctttcactataaacacttgagtttaaaactatatcatctatggtttgcttatctacttttacaccatttggattaagttcatctagtttatcaagtccttttccaaattcatcataagctctttttgctctagcatctcttaaagcataaagctcatcagccttagaagcattatttaaatttaactcttttaatatagcctcatcttgtaagtgtaaagagtttgcaaccttatttgccattttagggtcatttgctaaaacacttcttgccatattagctaaatcatcattcataaaagaaagattaataagatcttgttgattcagtgctgcttcttttgaacctatatttttactaatattatttagtgaattagttacgttgtctgctgtattttttacaaaaccattttttgcagtatttgagaaatcttttattttgcttgccactccatcaactaatgcatttccttgattaacttctaaaggcatagctcttgatttttgcaatatatcatcataatttctatttccgctttctattagctctcttgcataagcttttgaagtttcgctaccttgtgaagctaaatcatttaaaatactagggcttatttttctaagcttatcccctatattttcttttaaattaccaccttttactgccatgccatctatcatatctttaccggcttgtgctcctgtttttgccatattataggtattttttaaagctcttgctcctttgacaactcctgcaaaagctgcatcacctattaaagaaagtcccgcattttcacccataagcataagagcttcttttaaatttgcatcttgatttgtatcttttgtatttccgtagtaatcatatcctgcccctaaagatgcacctaatgcaccacctgcaaccataccaactccgccacctagcattgtaccgccaatggcacctgctgttcctaaagccatactagcaccattatctcttaatccacgatataaatcacccattgcgctaccttgcactttagaataatttccgttattatcttgcacccaataagatccatcatcatcttgtaataatcttccacgccctgatttttgcaactcatcgcctaaatctctcataaactgattactttttcttgctacttcattatcatcagtaaaaataggtttagaggcattaaatttagattgcttatctaaaatataattacttaaatcatcagcactcatggatggatttttattataatcatataaatcccttttatat

SEQ ID NO: 21 - DNA, 2023 bp, Camplyobacter Phage CJLB-15
acaatagcttttaataaaaaattaaataacgttttgcaaaacaataatgaagtttatttggacgaatttttaaaatcaatacagttttttttacaatttagacaaaaaatacaaaaagatgggcgtaaaattattgctaaagaaaatatatctagaagaatgttttactattttgattttaaagagaaagatgttatggataagataattgataatattgattttaaccatattgggaatattccaaaacaggcattaatagaatttaataattttatgtctcatgtttgcaccgcctactctttatccgataaagatgaaaacactgatatttttttaaaaaatattgaacgagcaataaaccatattaaacgaggaacgctcgattgttataaaattataattaaagattattttatacttgaaaattcaactttacctataggtcttataggtcttaaaaatcaattgttcaacttaagaattaatgaatataaaaatttaggaaacaatagtatcaatattttagagcaatttaaaaaaatagttcaagaaattatgaaaacgccgtatttaaactcctaattttatttgttataattttaattaagaacttaagggcagaatctcgccctttacaattgcgaaagatgtatataaactttcacttctcttattgtaattcatagtttgcaactatccatgtatttgtcttatctccttttcaattatcttttatattttaaaaaataattacatgaatttatgctataattaataatcgccattgacactactcacgcttaaagtgtcagtattaagcctagctttagtgcgtatcggctaagctaggggcgataatattaataaaaattatatgcagttataatccactttttatctttacctttataatcaagtgctaccataactctactattcttaacatcaataaaagctctattattacctttttttacatttccattatttataatattttctatttcttttataaaatttaaagctttattttttgcttctattttatttaacccttgtttaatgaaatcttcttctcttcgattgacaatatgacttaatccaaagtttccatctccccaaaccaaatcaatatcccctaaatcttttctatgaaaagcacctgctacctgcccttgtttttcaatgagtagtttttgtaaagcaccttttccatcgtgataatattctgcataattttcgccaaattcttttaaaggttgtatgtttaattcttgttcgattttaccccttaaagcacttggaatatctttttttacacctttatttgtgctttctttggcattgattatcatctgtctagttaagttgtattcaacagtatttaaattcatcttatctaaaaaatcaagtttattgtctttattctcttttagaaaattatcatatctttttagaatatcttcactagcctttttatcattttgtatttttttatcaagcctttgttttacgctttttttattctttttctctacttctttagcctcaatattttcttttatatcttccattaagtttgttttaggtttagtttgggtagaatttttatcagagaacgacacttgatttgtctctgaagatgccctagatgtcggtaaggctctcgcattattataatacactgcctcagcattcttaattttattttttatattattttgtttctttggcgaattgctaattatagtcaaatgcgtttcatagtctttgcctatacttgtaaaataagtctgattatctatatttttaataaaaataaaatcatctttatcttttaagattgcctgtgggctttctaaagtttctttgatatgtggtatgtatttaattctatctttttcaatcagctttagtaaacttccttttgtaagttttatttctctatcttttaaagctatctttgcttcttttggtatattagggatatattcatcatcgatatttttaagattgaaag

SEQ ID NO: 22 - DNA, 8218 bp, Camplyobacter Phage CJLB-15
ctaatatttcccatatgatttgttaaattttggtctttgaaattatatttttcatattctttagcatatttatctttatttttataaaaatcatttattacttcattttttaaatttgataaatattcacttgtattttgattttcactttgacttgctccatcttgcaaaaatgaaataatgttattttcttgtggtttttctaataaaaattctcttatattcattatattaatccttgtttttttaattcttctacgctaacttgcatttttctacctgcttgattaactaatattacattaccattagcatcaggctctgatatttgagcattaattccattaaaactaacgctatgtaattttggtgtattttgattttgcacttctaatgtatttttggctaaatcattttgtatattttgattagttgttgaattacctataattactgcatttttactaggttttgagtatttttcatcccaataaaaagcttttacctttggagcataattattataaaaatccatattatttttataatcttctatagcactttgtttctcaatatttgtttttgcgtttcctagtctttctgctaattccattttaaaagagtttggagcttctgctaaccattctcctgctaatgcttgagctaccctttgattatttgcttccatagtataaccattaatagggaaattggcttgtatattctctaaattccatttagcatttttaccaccccttaataaatcactttgcattctttttaaaaataaatcacttgcatcatttaaatccgtgctttgacttccccatccaccaaaaccacgctctatagctccattccaaaaaccatgggttgtatcatatgttttaccttgattacttgctaaatctaaaaactgagcgtctgctttatatcttgtattgttttgtaaatttgcattgttttgactattgaaaccttgagtattactaagaactccatttaataaatcttgctctttttgttttgtatttatctcattttgtaatttttgaagttctaataatcctttttgataatttaaatccttgtaagccttattagcatttatcgcttgctgtcttaaagcattttgcatggcatattgtctagctctttggttataattcatttgccattgctgatctgctatatttgctctttctttttgataatcaaagtttctctcattttgcaagatttgattgttttgcatagcctcattaaattccatttgttgctttcttaaatcttgctcttgctgaaactcattagctttaactttatcatcaaaacttttgctcatgatgtcatataagacaccaccgacttttcctgcgttttgtataacgcctgtatcaggattaaatactactctttgtgggttataaaatgccattttgtttcctttattctttcttttaaaataaaggatttaaggaagtttgtgtataattttaaaaggtgtggtgccaagggtcgccacccttagcactaaattaccacctagaaaggcggtgaaataagatgctacaaatcttaatagttattatactactttgtattattgttgtcaatgcaaattaacaatcaataaacaaagccccttatacaaggggttaagatttaccctttaaaacaaactccttaaatccaaatctatttaattactccaaacactttgaagtttattttccgtattctttcttctatttaattcttcattagctagatacttattgaagttataagcatctttttgtaactcataattcttttgtgccatcttttgctgattataagcaccatataaagcaccagcaccgcctaaaacatttcccaatctatcaaaattagttactttatttgcatcagaacttttaaataaccaatctccaaaattgctaaaagaattttttaatccatttaaaaaaccactactacttgctaaatttggagtaaaattgcttgttttcatcaaagtatctgcaaagctagatcctaatcctgtaccaccttttaaagctgttataaaatccataatttctcctttatactaaacttaataattctttgcctagatctatctcgctaacttcgcctttttttaacttatcgttaaaatcactagttcttacattattatttgcacttgataaatcttcagcttttttggcattatttgattttccgaccaaattaagcaaggttttccagctgtcaatattaccttcgcctaaaccatttaattttgttgcaagttctgccatagcctttaaatccgcatcaggataggcttttcttaactcgctttctacttgtgcgtatttagcgattagtgcatcttgctcttctttgtctttttgctttttatcaagctcttcaagcctttttaatttctcatcaagtccatcaagtcctaattcttttaaatactgctctctttgtaattcttgttcgcttggctctttttttggattttttaaagcttcaagctcactcattaaagcatttaatttgttgtcattttcacttttataagcttcaaacatcgccttataatcaggctcgttctcattagcaacctgcataggttcattatcttctacttgcgtaggttcatcgccattattagcaacttgtcctttatcatcatctgttatgacatttattaaatcttttaaagcatcattttccatcttcttcatcctttattttattgattattatgtctaaaaaagccatagtatctaaagcttttaaccttaactctttctcatcgttattttttgctatataaaaacattcactatattttgctttgataaaatctattaatttctttcctcctttagttttagatatatcacttttaatttcaatattaagcattagcttctccttgcatttgtggattaatatcttcattattttcaaaagcaaataaactatttacattctttacacctaaaattggtaataattctttagtaagttctttactagcatttataatcccataagcagaatttgcatcgcctatgctcatatacatttgatataattgtgaaaaaacttgcatactagcttgaattcctgcacgtctaatttctttattcatggcacctgtgccggtttgaattttaaatctaaaactaggtatatcctctctttgaaaaccattaaaaaaactatcttctccatacttaaaaacaagcattgcaaatctatcaaataaaggctctataaaagtttcgttatactgtcttatgtagtcagcacttcttcttccaccttcttgtgcttttatgctaatttctgttgctgtttcattttgtgcagtttgagctccattgttttgtggactaactcctataacttctgtgagttcgctttctaaaagctgtaaattcattcccgcactatttacatttggtggtggtaatatttgcacaccctttggatcgtctgtatatattggttttcctaaggtttctatatcttctctgcttactcccattgattttggcatcattattttaggcatgatatgagttcttactgcatctattaaaagatttctagttatattaatttcatcttgcaaaggcatagcagaagccattataggctcgccataagcacttacatagttttcgttatctatctttttaagttgtggtagcattgaaccccagataaaaggctgtccatcttgcaaagtaacttcatttctaagtaaattattttcaaataaggtagaaaccacccactcatcatcgttttttctttcataaatatcataaagctttacttttttatactcatcatcttcatcaaaaagctttttaatttcattttttttataaaatcctagcttttgtctttcatggatttgattataggttaggtaaatttcattgactatatatcctacatcctcgctatttaatgcatttggatcaaagaatatactatcaatatctactctttcaatgcgtggcattcccttatgccaagtaaccttagctatacttgttcccacaagtaaaacatctaagaaaagcggttgaaaaatcttaaacatattgattttaccactataaaaatcaattgcattctgccatagctctataatcgtatcatcgctattaatgtaagtttcaatatctgccattctctcactattaaaatatacatcatttaagctagtgattaaatactttaccttagcgtttatttttggtatgtaaatacttgatttatttctttttctcaatttttgcattaccttattttcaagcaaataagcatcttgcaactctttaaagtgtggtttgtaattttcatatccacttttactttcgctaatgagttgtgttaaaaacgacactctctcatcattagttctttttgttttcattcataattctccatattgttgttttgcttaaatttgttatttttaaaatatctttttcattcactcctttttcaaataaaaactccgcaaattctcttttaaatttctttttagaaatattattaaaccctgatacaagctctaaaaattcatttgcaagacttgactttatagcctcatcgcttaaatttgaaagcttttttattttgtttacatcaattgcatcatagatcattaaaaactcaccagccatcataactccaatcttcattagtattgtttctgctgtatagtttttcaaaaaaagttaatgccaccgcatcgctaacatcaggacttttgccatagttcttttttaattgttcttttgaaactatctttaaaagccccttgtcgctatattcatattcaatcattctcatatctttttttaattcttcatctttaacaagctccatgtgttttaagtttttagtaaatgtaaaatacatttgcgctcttttatttaagtattcattactggttgcagaatttgcagaatttgcctcaaatacaggcaaaccataatttaacaagacatcatatacgccaacgccaagaccacaggtatctataaaaataccttttggtttatcttcgctttgattgtattcggctagtattttgtttgctaattctatagttccaagttgtgagtattttttaatctcataaattacaaaaccttttctttttgctaaagcactcttatcatctccatatcttgctacatcaagcccccaaatattctcgccttgcattttttcaatactaaaagagttcttgctcatcgcattttcaatttcacttagagaaaataattcagcactcgagctatctataaactcgccataaatttcttgcttgacaacttcactaccttctccgcctacttcttcaattaattctttaatttgctcttcttttaaaaatggattatcataacttgagaattgaaaatgtttccaatttttatcgctgagttcttttctgcaaagttcataaaatagattttttcctttaggaactccaccgataatcgctcttgatttagggttatcaagcaacataggtcttatagcgttataccaaagatactctcctttactaccttttaaaataattcctgcttcgtttaagataacaaggtcatatccaaaaccttcgatattttcacttctttcagcacttctcatatgaagcactgctccattaataattagtttcttatcttgcacactccatgagtaaaaatcttttggcaagttttttaactcaggtgtaaaatataactcgtaataattttgtaaatttgcttgtatggtatccacccataaaacattttgtcctaaaagcaagttttcgataacaaacttagcacttccccttgtaaaaccaagtcttctgccctttgctacagttataaagcgtggatttttatcatcaaaaactttaagttgtgccggagtgtaagaaaaatcgatttttaatttcatttgatttcacttcttataatttcaattttttgaacgttatcgctgacaacttcttgtttatccacatatccatgttgattttttagcaagaacatactaacgctaggagtataagtgccgattaaggaatggtttaaaatatccatttcacatttttgcttagcttgagatacaatttctccaaaatccttatccttctcccactcgcctaaagtttgtattgtaattcctaaatacacagctaatcccacttttgttttaggtgcaaaaataatactctccttagtttcttttaagacaactctttcattaaaataactctctatttttgaaacaagctcttcttttgtcatacttttgccatttgtcatcattctagccattaagccaccccttctttaaaattaaattctttgatttctaagtttaaaaaagattttttaaaactaataatctcataatcgccttttaaaacattcttatcgttttcaaataacgcatctaacacgcattttacgatattgtccccatcgccatgccttttgctgttaaatcctatttttaaagaaaactcatatttcttttgcttatcaaaagcttgaaaacagctaatatcattttgtcttctaaactccatttgcaagagttttttaaaatctaaatatttaagataatctttacatacaaatttagatctttgcgtggttcttttataaggaactgggttgctttttaaatcaatttttaaaatatacttttccatttcagactatcttaaatttagcttatatttttaaaagccattttgcttttaagaattttttcaaatctactcttattctcgttaaatagccttttttcttcagctttttcaagctctctcatttcatctaaagttaaaactctttctatttctcgcactggtaaagaatgctctaaatctcttcctatcctatcttgatttttgaacatgaaatcaactaaagcttctttaaattctccattagctatcaaattaccatctttataagtgatttgcttaaaagcattgatgcaaattaaagaatcaatagattcttgatttattttaattttttgattgcttccgtaatttgcaaaatatgagtatttaaaatcgcctttaaaaactctaaagcaagcttgatttttgtatttattgcaaagccattctaaaaaaatttctttgtcttcaaaacgctttttaaactctatttcagctcttttgcaaactcttcttaatttctcataggttgtccctacgatattctctctttctaaagtttcgaaataaaaatctaagaaagcatgaatatccttaacgcttttgagatatctacctacaatatcagttgcttgagccttattaatttccaataagtccattaaaatttgtattttttcttgcattttttactccttaaaagcatcctaagagcttgtttttgttctcatctttcattccgtaatactccatcaagctatcaaccacactaggattggcttctttttttctgttaaaacgatgattttttcttgcttcattttctttagcgtatttaagccatgtataaagacttcctaccacacttgacattctttttccatttcttttccattccctagcatcccaatagcctataaaatcattagccaactcttcaccaaagtttgtgccatttttctcattaaaagctattatttgtctcatgagttcatttgcatttgggactttaaactctttttttgccattttctctaactcctttttgccaaaatcaataaagctcgtcacaaaagaggcgttttgattagaaacgcattctttcttttcttgattattttttaaattttctaaattctctttttttataaatttattattattaatatttatattatttataaatttattatcgtgtgcgtgcgtgcgtgtttctatataatgtaaattctcttttttttcgttttcagtagttgattttctgtcgattgatgaagtgttatttttaagagttttgcttagcttttcatcactgcttttaagcaaagataaagctttgttaaaatgttttttaatttgataattttcatcttttaaaatccactcataaaaatttaaagagccatttctaacctttttaatttctaaaagtctgagttcaattaattcttttttggcaattcttaatctatttaaact

SEQ ID NO: 23 - DNA, 2353 bp, Camplyobacter Phage CJLB-15
atatcaccttttccataaatgtcactagtatttgaaaaacaagcttcattatttttcaaattttcaaaaaaatctaataattctttatccttaattttaggaaacaaaaagaaatctgccattttttagtcctttggtttatttagataacaaaacgcgctaaaattataccttttttatagttaatttatacttattttatatgttttatatacttaacttataggttttttatagtcttgcttttttttgaaaatatatatttttatttcaaaacacactatttttgaaatagctatttttggaaaaatccttaaaactaaactaaggagaattcaaaaatggctttaccttcaatgggacatacctcacccgcaacagaaaatgttaagttaaaacaatcaatatatgaaacgattattaaaattggagctactgaaacaccaattctaaataaaataggcacttcaaaggttacaaatcctttaactcatagttggattactgatacttttgaagaaccaaaaaagaatgcaaatttagagttaagtaaatttgtaggtgaaacaaaaaacacagctcaaaaaactacaaatgctactcaaatattcattaccgaagccatggtatcaaaagctttattaaaagcaaatcaatatggtggcaatgaaatggagtatcaaataggcaaaaaaaccaaagaacataaaatggatatggaatatgctttatttggtctaggcagagatagtgatgtaaaaaaatcagttttcaaagattatgttcaagcacaagaagcaacaagtggagaaatggctggactttttcattatatcgctaaaggaaaagatagcttttctgatggaaagcgtggaaatgtattagcttttgatgaaacaggagattggagtggaactgcaacagaactaacagaagataaacttaatcaaatcttacaaaccatttggaatagcggagtgacgcctaaagatgtctttttaggagctgacttaaaaggagctatcaataaattcgctacaagaattttaggcaatgaaacaaaactagcaggacaagtagtgagccttgaaacagattttggaacggtaaatttccatatgcatagattattaagccctaaatatggtttgggtgatgttttaattgctggggattttgagtatatgaaacatgggctttatattcctactatgattgaagatgttccaactgatattactgcaaaagcaaaaagattttatacgcaaagcactttagaagtaagaaatgctgatgcttttgctataggcgtgggattaactagtggaaataatgcaaaggctaaagcggttttaaaagcagcaaaaggtgcataatgctttgtgctacggctaaaaaactcattatcgctaaagttaaaaattcttacaaaatgatagaagatgatgaagttttgaaagcctattttatggaagcattttattatattttatcaaaatgtgttcctagcgttcttttaaaaaatgtagagcaaggcgaaaaagtttttaggcaagttagaaataatcattttttgattattcctgatgagcctgattttgacaatgaaaaagaacatttaatgatagatgaaacacttagttttgctgtgattaattatgtttgttatttgattacaagatgcgaagaaaaagactttctggcattatgtgacaagataatttatgagtatatagctaatgatggcaaggagcttgatgatgaaagaacatggttgtaattgtaatttcacaaaaaaaattaatagagctttgagttataaagactatgtgcaaagtataaatagtgctgattttatagcttatttagatgataaaaaatggcttttagccatggatgatctgcttttcttttgcgaaaagagaattaaagatagtgattattatgaaggttaaaaatgggaacaagcttaaatgaattaaaaacaggtagagaaaaacttgaaatcataaatcaagttttagctagaataaacagcatttcagaagcaatagacaatacaagacttgatgaagttgtaggcttaaaacaagcttgcgaatctttaaaaaatgaatgtttaaaatttaaaaatgatattgtagataaaaatgatgatattttaagcaaatatgatgatattaataaaaaatattcaaatataagtgtaaaatacaacaatgtaaatgcaaaatttgattatattaaagaagcgtatgaagatttttctttaaataaacaagaaatacaaaacattaaagattttttagaaaataatacagaagagtttgagaatttaaaaaaagatatacag

SEQ ID NO: 24 - DNA, 1434 bp, Camplyobacter Phage CJLB-15
cattattataaaatgattggttcaaatcatcataactatatgtatatacattatgattgcgaaaatttaagtatttaagaataccttttacaccacaataatcgtaaacattaaaaaaaacaatatttctttcaatattctcaagttctgagaaatttaaaatgttactcatattttggataccaacatagttctaaacatttacaatttttatgtgggcaggttactacaatattatcatctatatttttaatgtgcttaaaacaatcattcataaaagtgccatcaatatctaataaaaaatttaaaggtttgcattttatatctttggtatttagtcgtaatatttcaaaattatcatccaaaatattgtcgtgtgttttgtatttgagattccaatcaaacatatataaaattttgctatgtttttttgcaatactatccaatggcactccattacaatcgtgtataggatttataaaatagttaatattatgtttatcgaacaacgctacaacattttctacaagtttgagttttaccgtgttaagtgatattattttacgagtcttaattttataatattttaaaataaatttaaaaaagtttttgccgtggtaggatgcaactataaaaactttgctattgttaaaattatatgaatgtagaggtgctgttaaatttgttatgagagcaatctgatttatataattattatgcactagtatttccacaattttattcaatttggggtgtaaagtaggctccccaccaactaattgtatattaactggtctgtggatatgtttttttaaaaataacatcaaagttgatatttttataaatttagatttattaatattattgtgataaccaatacaatatgaacaattgaaattacaagcgtctgtgacgtttatgctaattataggtaaaacttcttcaaaacctcttaccaatttcatttgcggtactccattatttcataatcttcacaagctatttttttacaatttatatcaacaccgaacattgtttctaatttattagattttaagttacgacatttagacgtaaatatgccattatcataatatatcaatttggggttgcatagacaacccagtgatttattcagattatttttaaaaatattaaaatattgttcatccctagttagattaaatctattggttaaaatatttttattgtttaagaagatttgttcaaaaaaattaaaacatttttcttcaacaggaactttcaatccttttttatccgttaaaaaaattagaaaaaaatgataattatttgtactgagaaaatcaattatttttgtagggtaacctaaaactggtaacgctacatatagttgttttattgtttgtttatttattatgtttataaaactatcttcatcaatctgattaggat

SEQ ID NO: 25 - DNA, 1042 bp, Camplyobacter Phage CJLB-15
ataaaacacgctttagttttgaatttgaaaagacattttttggcgatttaaatgtagattggagtgcaaatgctaatttaagatatagtttttaaataaaaaataatttaaaaattgtatttttattttaagcttttttgtttataatacttgcttttacatttaaaggataaagatgaaaataaaagttgggattttaggagcgagtggttatgcgggaaatgaacttgttcgcattttgcttaatcatcccaaggttgaaatttcttatttgggttcgagttctagcgtggggcaaaattatcaagatctttatcctaacacccctttaaatttatgttttgaaaataaaaatttagatgaacttgaacttgatcttttgtttttggctactccgcatgaatttagtgctaaacttttaaatgagaatttattaaaaaagatgaaaatcattgatttaagtgcggattttcgtcttaaaaatcctaaagattatgagctttggtataaattcactcatcctaatcaagagcttttgcaaaatgcggtttatggactttgtgagctttataaagaagagataaaaaaagcaagtttagtggcaaatccaggttgttataccacttgttctatcttaagtctttatccgctttttaaagaaaagatcattgattttagctcagttattattgatgcaaaaagtggggtaagtggagcaggaagaagtgcaaaggtggaaaatcttttttgtgaagttaatgaaaatatcaaagcttataatttagctttgcatcgccatactcctgaaattgaagagcatttaagctatgcagccaaaaagaaaatcactctacaatttacccctcatcttgtgtctatgcaaagaggaattttaatcagtgcttatgcaaatttaaaagaggatttgcaagaacaagatatacgcgatatttatacaaaatactatcaaaacaataaattcataaggcttttaccgccgcagtcgcttccgcagactcggtgggttaaatcaagcaatttc

SEQ ID NO: 26 - DNA, 1337 bp, Camplyobacter Phage CJLB-15
gcgtttaattgtctaaatcctaaataattttctttttctccatttttattgatatagctaaaatcgttatttttagctacaaaaagattaaaaatagctagtttttgctcttttctggttaaaaattcaaaacaaataaaagtattattgcttccatcgcttgccaatttatcatataaaaaggctttgcggaaaactccgctataaagcccaccttcacttaaatactctacgcttggcgaataatttgccacttcaaaacttgccttaaatgctggtaacattataatcctccttttaattgtgttaaaaattcatctttattacttagaacttcttgtattttttcacttgtaaataaagaatgtttttttataaaattgttttgctcttgggtgtttaaaccattatcactcataaattttctaagttcagcacctaaagcttttatctcttttgctttattttctaaagctattttttcatcactaccccaaacttttaaatcttcatttggatttaaaaatcgcttttcctttattgtttctaattcactttcatcaagcattccaagtccgcaaatacttaaggttacacgcctttttgcttttgtgatagctttcattattgcgtttgctaaattatcgccacctaaatttttaatatttaaagcacctgtatcgcaatcagttcttccatctggtgttgctgcgtaggctgtaaccatataaatatcgccaacttgtgccacttctgtttttgtaatacttacttttcttatttgtcttagttgatctgttgctgatttatttgcatataaagtaagtttgccatttaatactatgtattcaaaaggctttgtaagcatgtttaagcttaaactttcacaaagatttttaacataactcgctcgttctacatcactaagttttgataaatcaccttttaccaaagccaactcataaggattaaaatttatttctaatttattttcttcttttaatacaacttcattactcattttatgctccttttttgatttttaaacacattgaaatactttctttataaaactctttaggcacagtaatatttttttgctctaaaaagcccttataatcaattgtagttctactttgcggataaattgtaatatccaaacatcttgctttttctccatttgctaaggctatgagttcttttttaagactttctagcttttctttaataggtttaatcgtgttttcaagccttataatttcaatcgttagattttttgctttagtatcttcaagctctttatattcacttttttgatctatgatataatctaatat

What is claimed is:

1. A dietary supplement and/or nutraceutical composition comprising one or more of an isolated bacteriophage CJLB-4 deposited under ATCC Deposit Accession No. PTA-126839, CJLB-5 deposited under ATCC Deposit Accession No. PTA-126840, CJLB-7 deposited under ATCC Deposit Accession No. PTA-126841, CJLB-10 deposited under ATCC Deposit Accession No. PTA-126842, CJLB-12 deposited under ATCC Deposit Accession No. PTA-126843, CJLB-13 deposited under ATCC Deposit Accession PTA-126844, CJLB-14 deposited under ATCC Deposit Accession PTA-126845, CJLB-15 deposited under ATCC Deposit Accession PTA-126846, or a combination thereof, or variants of said bacteriophage which have average nucleotide identity over genome of ≥99.9% relative to said bacteriophage, said variants having lytic activity against *Campylobacter* species or strains, wherein the dietary supplement and/or nutraceutical composition is formulated as a lyophilized or spray-dried powder, an enteric capsule, or a syrup, wherein the bacteriophage in the syrup is stabilized with an effective amount of an agent selected from the group consisting of: a water-soluble polymer or sugar, a derivative of cellulose, a low or medium molecular weight polyvinylpyrrolidone, a glycol with a molecular weight of 4000 or 6000, sodium alginate, a protein, a lipid, a polysaccharide, and a mixture thereof.

2. The dietary supplement and/or nutraceutical composition of claim 1, wherein the composition further comprises a probiotic bacteria.

3. The dietary supplement and/or nutraceutical composition of claim 2, wherein the probiotic bacteria is in an amount of 100-10 billion Colony Forming Units (CFU).

4. The dietary supplement and/or nutraceutical composition of claim 1, wherein the composition further comprises a probiotic yeast.

5. The dietary supplement and/or nutraceutical composition of claim 4, wherein the probiotic yeast is in an amount of 100-10 billion Colony Forming Units (CFU).

6. The dietary supplement and/or nutraceutical composition of claim 1, wherein the bacteriophage is in an amount of $10^3$ and $10^{11}$ PFU.

7. The dietary supplement and/or nutraceutical composition of claim 2, wherein the probiotic bacteria comprises one or more *Lactobacillus* species and/or *Bifidobacterium* species.

8. The dietary supplement and/or nutraceutical composition of claim 7, wherein the one or more *Lactobacillus* species comprise *L. acidophilus, L. rhamnosus, L. gasseri, L. reuteri, L. bulgaricus, L. plantarum, L. johnsonii, L. paracasei, L. casei, L. salivarius,* or *L. lactis,* and the *Bifidobacterium* species, comprise *B. bifidum, B. longum, B. breve, B. infantis, B. lactis,* or *B. adolescentis, Streptococcus thermophilus, Bacillus cerus, Bacillus subtilis, Enterococcus faecalis, Enterococcus faecium,* or a combination thereof.

9. The dietary supplement and/or nutraceutical composition of claim 4, wherein the probiotic yeast comprises *Saccharomyces cerevisiae, Saccharomyces boulardii, Saccharomyces cerevisiae* var. *boulardii, Issatchenkia occidentalis, Lachancea thermotolerans, Metschnikowia ziziphicola, Torulaspora delbrueckii,* or a combination thereof.

10. A dietary supplement and/or nutraceutical composition comprising one or more of an isolated bacteriophage CJLB-4 deposited under ATCC Deposit Accession No.

PTA-126839, CJLB-5 deposited under ATCC Deposit Accession No. PTA-126840, or a combination thereof, or variants of said bacteriophage which have average nucleotide identity over genome of ≥95% relative to said bacteriophage, wherein the composition is formulated as a lyophilized or spray-dried powder, an enteric capsule, or a syrup, wherein the bacteriophage in the syrup is stabilized with an effective amount of an agent selected from the group consisting of: a water-soluble polymer or sugar, a derivative of cellulose, a low or medium molecular weight polyvinylpyrrolidone, a glycol with a molecular weight of 4000 or 6000, sodium alginate, a protein, a lipid, a polysaccharide, and a mixture thereof.

11. The dietary supplement and/or nutraceutical composition of claim 10, wherein said dietary supplement and/or nutraceutical composition comprises one or more of an isolated bacteriophage CJLB-4 deposited under ATCC Deposit Accession No. PTA-126839, CJLB-5 deposited under ATCC Deposit Accession No. PTA-126840, or a combination thereof.

12. The dietary supplement and/or nutraceutical composition of claim 10, wherein said dietary supplement and/or nutraceutical composition comprises variants of said bacteriophage which have average nucleotide identity over genome of ≥98% relative to said bacteriophage.

13. A dietary supplement and/or nutraceutical composition comprising one or more of an isolated bacteriophage CJLB-7 deposited under ATCC Deposit Accession No. PTA-126841, CJLB-10 deposited under ATCC Deposit Accession No. PTA-126842, CJLB-12 deposited under ATCC Deposit Accession No. PTA-126843, CJLB-13 deposited under ATCC Deposit Accession PTA-126844, CJLB-14 deposited under ATCC Deposit Accession PTA-126845, CJLB-15 deposited under ATCC Deposit Accession PTA-126846, or a combination thereof, or variants of said bacteriophage which have average nucleotide identity over genome of ≥99.9% relative to said bacteriophage, wherein the composition is formulated as a lyophilized or spray-dried powder, an enteric capsule, or a syrup, wherein the bacteriophage in the syrup is stabilized with an effective amount of an agent selected from the group consisting of: a water-soluble polymer or sugar, a derivative of cellulose, a low or medium molecular weight polyvinylpyrrolidone, a glycol with a molecular weight of 4000 or 6000, sodium alginate, a protein, a lipid, a polysaccharide, and a mixture thereof.

14. The dietary supplement and/or nutraceutical composition of claim 1, wherein the isolated bacteriophage is CJLB-4 deposited under ATCC Deposit Accession No. PTA-126839, a variant thereof having average nucleotide identity over genome of ≥99.9% relative to said bacteriophage, or a mixture thereof.

15. The dietary supplement and/or nutraceutical composition of claim 1, wherein the isolated bacteriophage is CJLB-5 deposited under ATCC Deposit Accession No. PTA-126840, a variant thereof having average nucleotide identity over genome of ≥99.9% relative to said bacteriophage, or a mixture thereof.

16. The dietary supplement and/or nutraceutical composition of claim 1, wherein the isolated bacteriophage is CJLB-7 deposited under ATCC Deposit Accession No. PTA-126841, a variant thereof having average nucleotide identity over genome of ≥99.9% relative to said bacteriophage, or a mixture thereof.

17. The dietary supplement and/or nutraceutical composition of claim 1, wherein the isolated bacteriophage is CJLB-10 deposited under ATCC Deposit Accession No. PTA-126842, a variant thereof having average nucleotide identity over genome of ≥99.9% relative to said bacteriophage, or a mixture thereof.

18. The dietary supplement and/or nutraceutical composition of claim 1, wherein the isolated bacteriophage is CJLB-12 deposited under ATCC Deposit Accession No. PTA-126843, a variant thereof having average nucleotide identity over genome of ≥99.9% relative to said bacteriophage, or a mixture thereof.

19. The dietary supplement and/or nutraceutical composition of claim 1, wherein the isolated bacteriophage is CJLB-13 deposited under ATCC Deposit Accession PTA-126844, a variant thereof having average nucleotide identity over genome of ≥99.9% relative to said bacteriophage, or a mixture thereof.

20. The dietary supplement and/or nutraceutical composition of claim 1, wherein the isolated bacteriophage is CJLB-14 deposited under ATCC Deposit Accession PTA-126845, a variant thereof having average nucleotide identity over genome of ≥99.9% relative to said bacteriophage, or a mixture thereof.

21. The dietary supplement and/or nutraceutical composition of claim 1, wherein the isolated bacteriophage is CJLB-15 deposited under ATCC Deposit Accession PTA-126846, a variant thereof having average nucleotide identity over genome of ≥99.9% relative to said bacteriophage, or a mixture thereof.

22. The dietary supplement and/or nutraceutical composition of claim 10, wherein the isolated bacteriophage is CJLB-4 deposited under ATCC Deposit Accession No. PTA-126839, a variant thereof having average nucleotide identity over genome of ≥98% relative to said bacteriophage, or a mixture thereof.

23. The dietary supplement and/or nutraceutical composition of claim 10, wherein the isolated bacteriophage is CJLB-4 deposited under ATCC Deposit Accession No. PTA-126839, a variant thereof having average nucleotide identity over genome of ≥99.9% relative to said bacteriophage, or a mixture thereof.

24. The dietary supplement and/or nutraceutical composition of claim 10, wherein the isolated bacteriophage is CJLB-5 deposited under ATCC Deposit Accession No. PTA-126840, a variant thereof having average nucleotide identity over genome of ≥98% relative to said bacteriophage, or a mixture thereof.

25. The dietary supplement and/or nutraceutical composition of claim 10, wherein the isolated bacteriophage is CJLB-5 deposited under ATCC Deposit Accession No. PTA-126840, a variant thereof having average nucleotide identity over genome of ≥99.9% relative to said bacteriophage, or a mixture thereof.

* * * * *